US010858650B2

(12) United States Patent
Lee et al.

(10) Patent No.: US 10,858,650 B2
(45) Date of Patent: Dec. 8, 2020

(54) METHODS FOR MODULATING ATRX-DEPENDENT GENE REPRESSION

(71) Applicant: The General Hospital Corporation, Boston, MA (US)

(72) Inventors: Jeannie T. Lee, Cambridge, MA (US); Kavitha Sarma, Waltham, MA (US)

(73) Assignee: The General Hospital Corporation, Boston, MA (US)

( * ) Notice: Subject to any disclaimer, the term of this patent is extended or adjusted under 35 U.S.C. 154(b) by 447 days.

(21) Appl. No.: 15/522,171

(22) PCT Filed: Oct. 30, 2015

(86) PCT No.: PCT/US2015/058338
§ 371 (c)(1),
(2) Date: Apr. 26, 2017

(87) PCT Pub. No.: WO2016/070060
PCT Pub. Date: May 6, 2016

(65) Prior Publication Data
US 2017/0335317 A1   Nov. 23, 2017

Related U.S. Application Data

(60) Provisional application No. 62/072,962, filed on Oct. 30, 2014.

(51) Int. Cl.
*C12N 15/10* (2006.01)
*A61K 31/713* (2006.01)
(Continued)

(52) U.S. Cl.
CPC ........ *C12N 15/1093* (2013.01); *A61K 31/713* (2013.01); *A61K 39/395* (2013.01);
(Continued)

(58) Field of Classification Search
CPC .. C12N 15/1093; C12N 15/113; C12N 15/11; A61K 31/713; A61K 39/395; C12P 19/34; C40B 20/08; C40B 50/06
See application file for complete search history.

(56) References Cited

U.S. PATENT DOCUMENTS 5,491,133 A   2/1996  Walder et al.
5,576,208 A   11/1996 Monia et al.
(Continued)

FOREIGN PATENT DOCUMENTS

CA    2805791      1/2012
CN    101619312   1/2010
(Continued)

OTHER PUBLICATIONS

International Search report and Written Opinion mailed in international application No. PCT/US2015/058338, 14 pgs.
(Continued)

*Primary Examiner* — Jeremy C Flinders
(74) *Attorney, Agent, or Firm* — Fish & Richardson P.C.

(57) ABSTRACT

Methods and compositions for modulation of the activity of alpha thalassemia/mental retardation syndrome X-linked (ATRX), e.g., modulation of DNA-ATRX or RNA-ATRX interactions, and methods for identifying and using compounds that modulate DNA-ATRX or RNA-ATRX interactions, as well as the compounds themselves.

2 Claims, 46 Drawing Sheets

Specification includes a Sequence Listing.

(51) Int. Cl.

| | |
|---|---|
| *C12N 15/113* | (2010.01) |
| *C12N 15/11* | (2006.01) |
| *C12P 19/34* | (2006.01) |
| *C40B 50/06* | (2006.01) |
| *A61K 39/395* | (2006.01) |
| *C40B 20/08* | (2006.01) |
| *C12N 5/00* | (2006.01) |

(52) U.S. Cl.
CPC ............ *C12N 15/11* (2013.01); *C12N 15/113* (2013.01); *C12P 19/34* (2013.01); *C40B 20/08* (2013.01); *C40B 50/06* (2013.01); *C12N 5/00* (2013.01); *C12N 2310/113* (2013.01); *C12N 2310/1241* (2013.01); *C12N 2310/14* (2013.01); *C12N 2310/15* (2013.01); *C12N 2310/531* (2013.01); *C12N 2320/11* (2013.01); *C12N 2330/31* (2013.01); *G01N 2333/914* (2013.01); *G01N 2500/02* (2013.01)

(56) References Cited

U.S. PATENT DOCUMENTS

| | | | |
|---|---|---|---|
| 5,623,065 A | 4/1997 | Cook et al. |
| 5,652,355 A | 7/1997 | Metelev et al. |
| 5,661,134 A | 8/1997 | Cook et al. |
| 5,914,396 A | 6/1999 | Cook et al. |
| 5,919,619 A | 7/1999 | Tullis |
| 5,965,722 A | 10/1999 | Ecker et al. |
| 5,976,879 A | 11/1999 | Kole et al. |
| 6,015,710 A | 1/2000 | Shay et al. |
| 6,040,142 A | 3/2000 | Melki et al. |
| 6,046,307 A | 4/2000 | Shay et al. |
| 6,063,400 A | 5/2000 | Geho et al. |
| 6,080,577 A | 6/2000 | Melki et al. |
| 6,107,094 A | 8/2000 | Crooke |
| 6,143,881 A | 11/2000 | Metelev et al. |
| 6,146,829 A | 11/2000 | Cook et al. |
| 6,197,944 B1 | 3/2001 | Walder et al. |
| 6,210,892 B1 | 4/2001 | Bennett et al. |
| 6,277,573 B1 | 8/2001 | Koester |
| 6,284,458 B1 | 9/2001 | Anderson et al. |
| 6,294,650 B1 | 9/2001 | Shay et al. |
| 6,326,199 B1 | 12/2001 | Cook et al. |
| 6,346,614 B1 | 2/2002 | Metelev et al. |
| 6,359,124 B1 | 3/2002 | Ecker et al. |
| 6,451,991 B1 | 9/2002 | Martin et al. |
| 6,531,584 B1 | 3/2003 | Cook et al. |
| 6,608,035 B1 | 8/2003 | Agrawal et al. |
| 6,653,466 B2 | 11/2003 | Matsuo |
| 6,653,467 B1 | 11/2003 | Matsuo et al. |
| 6,677,445 B1 | 1/2004 | Innis et al. |
| 6,727,355 B2 | 4/2004 | Matsuo et al. |
| 6,753,423 B1 | 6/2004 | Cook et al. |
| 6,831,166 B2 | 12/2004 | Manoharan et al. |
| 6,919,439 B2 | 7/2005 | Manoharan et al. |
| 7,015,315 B1 | 3/2006 | Cook et al. |
| 7,033,752 B1 | 4/2006 | Melki et al. |
| 7,041,816 B2 | 5/2006 | Ravikumar et al. |
| 7,045,609 B2 | 5/2006 | Metelev et al. |
| 7,341,835 B2 | 3/2008 | Blume et al. |
| 7,683,036 B2 | 3/2010 | Esau et al. |
| 7,687,617 B2 | 3/2010 | Thrue et al. |
| 7,709,456 B2 | 5/2010 | Corey et al. |
| 7,838,657 B2 | 11/2010 | Singh et al. |
| 7,858,592 B2 | 12/2010 | Shames et al. |
| 7,879,992 B2 | 2/2011 | Vickers et al. |
| 7,888,012 B2 | 2/2011 | Iversen et al. |
| 7,960,541 B2 | 6/2011 | Wilton et al. |
| 8,067,569 B2 | 11/2011 | Iversen et al. |
| 8,092,992 B2 | 1/2012 | Kuwabara et al. |
| 8,110,560 B2 | 2/2012 | Singh et al. |
| 8,129,515 B2 | 3/2012 | Esau et al. |
| 8,153,365 B2 | 4/2012 | Wengel et al. |
| 8,153,602 B1 | 4/2012 | Bennett et al. |
| 8,153,606 B2 | 4/2012 | Collard et al. |
| 8,222,221 B2 | 7/2012 | Corey et al. |
| 8,232,384 B2 | 7/2012 | Wilton et al. |
| 8,288,354 B2 | 10/2012 | Wahlestedt |
| 8,288,356 B2 | 10/2012 | Obad et al. |
| 8,318,690 B2 | 11/2012 | Collard et al. |
| 8,361,977 B2 | 1/2013 | Baker et al. |
| 8,361,980 B2 | 1/2013 | Kauppinen et al. |
| 8,404,659 B2 | 3/2013 | Kauppinen et al. |
| 8,415,313 B2 | 4/2013 | Mourich et al. |
| 2002/0160379 A1 | 10/2002 | Cook et al. |
| 2004/0002153 A1 | 1/2004 | Monia et al. |
| 2004/0005666 A1 | 1/2004 | Hayden et al. |
| 2004/0038274 A1 | 2/2004 | Cook et al. |
| 2005/0226848 A1 | 10/2005 | Kuwabara et al. |
| 2005/0246794 A1 | 11/2005 | Khvorova et al. |
| 2005/0261218 A1 | 11/2005 | Esau et al. |
| 2006/0089490 A1 | 4/2006 | Melki et al. |
| 2006/0128646 A1 | 6/2006 | Christensen et al. |
| 2006/0270624 A1 | 11/2006 | Cook et al. |
| 2007/0032446 A1 | 2/2007 | Cook et al. |
| 2007/0111963 A1 | 5/2007 | Corey et al. |
| 2007/0166737 A1 | 7/2007 | Melki et al. |
| 2007/0191294 A1 | 8/2007 | Elmen et al. |
| 2007/0292408 A1 | 12/2007 | Singh et al. |
| 2008/0015162 A1 | 1/2008 | Bhanot et al. |
| 2008/0125583 A1 | 5/2008 | Rigoutsos et al. |
| 2008/0139472 A1 | 6/2008 | Lauterborn et al. |
| 2008/0176793 A1 | 7/2008 | Simons et al. |
| 2008/0242629 A1 | 10/2008 | Crooke et al. |
| 2008/0249039 A1 | 10/2008 | Elmen et al. |
| 2009/0082297 A1 | 3/2009 | Lioy et al. |
| 2009/0092988 A1 | 4/2009 | Schwartz et al. |
| 2009/0099109 A1 | 4/2009 | Shames et al. |
| 2009/0123467 A1 | 5/2009 | Bedi et al. |
| 2009/0143326 A1 | 6/2009 | Obad et al. |
| 2009/0181914 A1 | 7/2009 | Rosenbohm et al. |
| 2009/0221685 A1 | 9/2009 | Esau et al. |
| 2009/0258925 A1 | 10/2009 | Wahlestedt |
| 2009/0326051 A1 | 12/2009 | Corey et al. |
| 2010/0021914 A1 | 1/2010 | Moeller et al. |
| 2010/0087511 A1 | 4/2010 | Singh et al. |
| 2010/0105760 A1 | 4/2010 | Collard et al. |
| 2010/0124547 A1 | 5/2010 | Bramlage et al. |
| 2010/0197762 A1 | 8/2010 | Swayze et al. |
| 2010/0210707 A1 | 8/2010 | Li et al. |
| 2010/0210712 A1 | 8/2010 | Hansen et al. |
| 2010/0216238 A1 | 8/2010 | Baker et al. |
| 2010/0256223 A1 | 10/2010 | Moeller et al. |
| 2010/0273863 A1 | 10/2010 | Corey et al. |
| 2010/0280100 A1 | 11/2010 | Collard et al. |
| 2010/0286141 A1 | 11/2010 | Durden et al. |
| 2010/0286234 A1 | 11/2010 | Elmen et al. |
| 2010/0317606 A1 | 12/2010 | Chan et al. |
| 2011/0039910 A1 | 2/2011 | Crooke et al. |
| 2011/0077286 A1 | 3/2011 | Damha et al. |
| 2011/0086833 A1 | 4/2011 | Paushkin et al. |
| 2011/0130557 A1 | 6/2011 | Pedersen et al. |
| 2011/0150868 A1 | 6/2011 | Yu et al. |
| 2011/0159587 A1 | 6/2011 | Krainer et al. |
| 2011/0172292 A1 | 7/2011 | Hansen et al. |
| 2011/0207217 A1 | 8/2011 | Corey et al. |
| 2011/0237606 A1 | 9/2011 | Chai et al. |
| 2011/0237649 A1 | 9/2011 | Collard et al. |
| 2011/0237650 A1 | 9/2011 | Collard et al. |
| 2011/0237651 A1 | 9/2011 | Collard et al. |
| 2011/0251261 A1 | 10/2011 | Burnett et al. |
| 2011/0263687 A1 | 10/2011 | Mattick et al. |
| 2011/0269820 A1 | 11/2011 | Singh et al. |
| 2011/0294226 A1 | 12/2011 | Melki et al. |
| 2011/0294870 A1 | 12/2011 | Collard et al. |
| 2011/0319317 A1 | 12/2011 | Collard et al. |
| 2011/0319475 A1 | 12/2011 | Collard et al. |
| 2011/0319476 A1 | 12/2011 | Collard et al. |
| 2012/0004184 A1 | 1/2012 | Collard et al. |
| 2012/0004278 A1 | 1/2012 | Chang et al. |
| 2012/0010156 A1 | 1/2012 | Collard et al. |
| 2012/0046236 A1 | 2/2012 | Collard et al. |
| 2012/0046344 A1 | 2/2012 | Collard et al. |

(56) References Cited

U.S. PATENT DOCUMENTS

| | | |
|---|---|---|
| 2012/0046345 A1 | 2/2012 | Collard et al. |
| 2012/0064048 A1 | 3/2012 | Collard et al. |
| 2012/0083596 A1 | 4/2012 | Elmen et al. |
| 2012/0088817 A1 | 4/2012 | Collard et al. |
| 2012/0094934 A1 | 4/2012 | Collard et al. |
| 2012/0095079 A1 | 4/2012 | Collard et al. |
| 2012/0095081 A1 | 4/2012 | Collard et al. |
| 2012/0129917 A1 | 5/2012 | Collard et al. |
| 2012/0135941 A1 | 5/2012 | Collard et al. |
| 2012/0142610 A1 | 6/2012 | Collard et al. |
| 2012/0142758 A1 | 6/2012 | Collard et al. |
| 2012/0149756 A1 | 6/2012 | Schumperli et al. |
| 2012/0149757 A1 | 6/2012 | Krainer et al. |
| 2012/0149759 A1 | 6/2012 | Collard et al. |
| 2012/0157333 A1 | 6/2012 | Kauppinen et al. |
| 2012/0165394 A1 | 6/2012 | Singh et al. |
| 2012/0171170 A1 | 7/2012 | Collard et al. |
| 2012/0190728 A1 | 7/2012 | Bennett et al. |
| 2012/0252869 A1 | 10/2012 | Collard et al. |
| 2012/0264812 A1 | 10/2012 | Collard et al. |
| 2012/0277290 A1 | 11/2012 | Collard et al. |
| 2012/0288869 A1 | 11/2012 | Schwartz et al. |
| 2012/0289581 A1 | 11/2012 | Chang et al. |
| 2012/0289583 A1 | 11/2012 | Collard et al. |
| 2012/0295952 A1 | 11/2012 | Collard et al. |
| 2012/0295953 A1 | 11/2012 | Colalrd et al. |
| 2012/0295954 A1 | 11/2012 | Collard et al. |
| 2012/0295959 A1 | 11/2012 | Collard et al. |
| 2012/0309814 A1 | 12/2012 | Collard et al. |
| 2012/0322851 A1 | 12/2012 | Hardee et al. |
| 2012/0322853 A1 | 12/2012 | Collard et al. |
| 2012/0329727 A1 | 12/2012 | Collard et al. |
| 2012/0329855 A1 | 12/2012 | Collar et al. |
| 2013/0035372 A1 | 2/2013 | Collard et al. |
| 2013/0035373 A1 | 2/2013 | Collard et al. |
| 2013/0053428 A1 | 2/2013 | Wahlestedt |
| 2013/0065947 A1 | 3/2013 | Collard et al. |
| 2013/0072421 A1 | 3/2013 | Collard et al. |
| 2013/0072546 A1 | 3/2013 | Collard et al. |
| 2013/0079505 A1 | 3/2013 | Moeller et al. |
| 2013/0085112 A1 | 4/2013 | Collard et al. |
| 2013/0096183 A1 | 4/2013 | Collard et al. |
| 2013/0116300 A1 | 5/2013 | Collard et al. |
| 2013/0137751 A1 | 5/2013 | Collard et al. |
| 2013/0143946 A1 | 6/2013 | Collard et al. |
| 2013/0164846 A1 | 6/2013 | Saetrom |
| 2013/0184325 A9 | 7/2013 | Collard et al. |
| 2013/0210893 A1 | 8/2013 | Collard et al. |
| 2013/0245095 A1 | 9/2013 | Collard et al. |
| 2013/0245099 A1 | 9/2013 | Collard et al. |
| 2013/0253036 A1 | 9/2013 | Collard et al. |
| 2013/0261065 A1 | 10/2013 | Collard et al. |
| 2014/0142160 A1 | 5/2014 | Lee et al. |
| 2014/0227271 A1 | 8/2014 | Yan et al. |

FOREIGN PATENT DOCUMENTS

| | | |
|---|---|---|
| EP | 0 999 270 | 5/2000 |
| EP | 1 044 987 | 10/2000 |
| EP | 1 752 536 | 5/2005 |
| EP | 1 695 979 | 8/2006 |
| EP | 2 021 472 | 6/2011 |
| EP | 2 023 940 | 6/2011 |
| EP | 2 431 467 | 3/2012 |
| EP | 2 548 560 | 1/2013 |
| KR | 10-2011-0050134 | 5/2011 |
| WO | WO 1989/005358 | 6/1989 |
| WO | WO 1992/000386 | 1/1992 |
| WO | WO 1993/013121 | 7/1993 |
| WO | WO 1994/002499 | 2/1994 |
| WO | WO 1994/017093 | 8/1994 |
| WO | WO 1995/033852 | 12/1995 |
| WO | WO 2001/036627 | 5/2001 |
| WO | WO 2001/066129 | 9/2001 |
| WO | WO 2002/038738 | 5/2002 |
| WO | WO 2002/103015 | 12/2002 |
| WO | WO 2004/113867 | 12/2004 |
| WO | WO 2005/013901 | 2/2005 |
| WO | WO 2005/042018 | 5/2005 |
| WO | WO 2005/044981 | 5/2005 |
| WO | WO 2005/089169 | 9/2005 |
| WO | WO 2006/063356 | 6/2006 |
| WO | WO 2006/069584 | 7/2006 |
| WO | WO 2006/130201 | 12/2006 |
| WO | WO 2007/002390 | 1/2007 |
| WO | WO 2007/004977 | 1/2007 |
| WO | WO 2007/047913 | 4/2007 |
| WO | WO 2007/076328 | 7/2007 |
| WO | WO 2007/086990 | 8/2007 |
| WO | WO 2007/112753 | 10/2007 |
| WO | WO 2007/112754 | 10/2007 |
| WO | WO 2007/115578 | 10/2007 |
| WO | WO 2007/133812 | 11/2007 |
| WO | WO 2008/025069 | 3/2008 |
| WO | WO 2008/029619 | 3/2008 |
| WO | WO 2008/061537 | 5/2008 |
| WO | WO 2008/103761 | 8/2008 |
| WO | WO 2008/103763 | 8/2008 |
| WO | WO 2008/113832 | 9/2008 |
| WO | WO 2008/132234 | 11/2008 |
| WO | WO 2008/138904 | 11/2008 |
| WO | WO 2008/151639 | 12/2008 |
| WO | WO 2009/043353 | 4/2009 |
| WO | WO 2009/046397 | 4/2009 |
| WO | WO 2009/061851 | 5/2009 |
| WO | WO 2009/064920 | 5/2009 |
| WO | WO 2009/124341 | 10/2009 |
| WO | WO 2009/127680 | 10/2009 |
| WO | WO 2009/134710 | 11/2009 |
| WO | WO 2009/149182 | 12/2009 |
| WO | WO 2009/151546 | 12/2009 |
| WO | WO 2010/000665 | 1/2010 |
| WO | WO 2010/007522 | 1/2010 |
| WO | WO 2010/014592 | 2/2010 |
| WO | WO 2010/065662 | 6/2010 |
| WO | WO 2010/065671 | 6/2010 |
| WO | WO 2010/065787 | 6/2010 |
| WO | WO 2010/065792 | 6/2010 |
| WO | WO 2010/076248 | 7/2010 |
| WO | WO 2010/093860 | 8/2010 |
| WO | WO 2010/093904 | 8/2010 |
| WO | WO 2010/093906 | 8/2010 |
| WO | WO 2010/102058 | 9/2010 |
| WO | WO 2010/107733 | 9/2010 |
| WO | WO 2010/107740 | 9/2010 |
| WO | WO 2010/115993 | 10/2010 |
| WO | WO 2010/120820 | 10/2010 |
| WO | WO 2010/122538 | 10/2010 |
| WO | WO 2010/127195 | 11/2010 |
| WO | WO 2010/129746 | 11/2010 |
| WO | WO 2010/129799 | 11/2010 |
| WO | WO 2010/129861 | 11/2010 |
| WO | WO 2010/135329 | 11/2010 |
| WO | WO 2010/135695 | 11/2010 |
| WO | WO 2010/138806 | 12/2010 |
| WO | WO 2010/148050 | 12/2010 |
| WO | WO 2010/148065 | 12/2010 |
| WO | WO 2010/148249 | 12/2010 |
| WO | WO 2010/151671 | 12/2010 |
| WO | WO 2010/151674 | 12/2010 |
| WO | WO 2011/017516 | 2/2011 |
| WO | WO 2011/019815 | 2/2011 |
| WO | WO 2011/022606 | 2/2011 |
| WO | WO 2011/025862 | 3/2011 |
| WO | WO 2011/031482 | 3/2011 |
| WO | WO 2011/032109 | 3/2011 |
| WO | WO 2011/038205 | 3/2011 |
| WO | WO 2011/038210 | 3/2011 |
| WO | WO 2011/048125 | 4/2011 |
| WO | WO 2011/055880 | 5/2011 |
| WO | WO 2011/079261 | 6/2011 |
| WO | WO 2011/079263 | 6/2011 |
| WO | WO 2011/082409 | 7/2011 |
| WO | WO 2011/084455 | 7/2011 |

(56) References Cited

FOREIGN PATENT DOCUMENTS

| | | |
|---|---|---|
| WO | WO 2011/085066 | 7/2011 |
| WO | WO 2011/085347 | 7/2011 |
| WO | WO 2011/090740 | 7/2011 |
| WO | WO 2011/090741 | 7/2011 |
| WO | WO 2011/091390 | 7/2011 |
| WO | WO 2011/097388 | 8/2011 |
| WO | WO 2011/097582 | 8/2011 |
| WO | WO 2011/097641 | 8/2011 |
| WO | WO 2011/103528 | 8/2011 |
| WO | WO 2011/123745 | 10/2011 |
| WO | WO 2011/127337 | 10/2011 |
| WO | WO 2011/139387 | 11/2011 |
| WO | WO 2011/143640 | 11/2011 |
| WO | WO 2011/146674 | 11/2011 |
| WO | WO 2011/146675 | 11/2011 |
| WO | WO 2011/150005 | 12/2011 |
| WO | WO 2011/150007 | 12/2011 |
| WO | WO 2011/159836 | 12/2011 |
| WO | WO 2011/163499 | 12/2011 |
| WO | WO 2012/009347 | 1/2012 |
| WO | WO 2012/009402 | 1/2012 |
| WO | WO 2012/012467 | 1/2012 |
| WO | WO 2012/018881 | 2/2012 |
| WO | WO 2012/024478 | 2/2012 |
| WO | WO 2012/027033 | 3/2012 |
| WO | WO 2012/036433 | 3/2012 |
| WO | WO 2012/047956 | 4/2012 |
| WO | WO 2012/054723 | 4/2012 |
| WO | WO 2012/058268 | 5/2012 |
| WO | WO 2012/065143 | 5/2012 |
| WO | WO 2012/068340 | 5/2012 |
| WO | WO 2012/069059 | 5/2012 |
| WO | WO 2012/071238 | 5/2012 |
| WO | WO 2012/087983 | 6/2012 |
| WO | WO 2012/109476 | 8/2012 |
| WO | WO 2012/138487 | 10/2012 |
| WO | WO 2012/144220 | 10/2012 |
| WO | WO 2012/170771 | 12/2012 |
| WO | WO 2012/178122 | 12/2012 |
| WO | WO 2013/006619 | 1/2013 |
| WO | WO 2013/036403 | 3/2013 |
| WO | WO 2013/138374 | 9/2013 |
| WO | WO 2013/041385 | 11/2013 |
| WO | WO 2013/173598 | 11/2013 |
| WO | WO 2013/173599 | 11/2013 |
| WO | WO 2013/173601 | 11/2013 |
| WO | WO 2013/173605 | 11/2013 |
| WO | WO 2013/173608 | 11/2013 |
| WO | WO 2013/173635 | 11/2013 |
| WO | WO 2013/173637 | 11/2013 |
| WO | WO 2013/173638 | 11/2013 |
| WO | WO 2013/173645 | 11/2013 |
| WO | WO 2013/173647 | 11/2013 |
| WO | WO 2013/173652 | 11/2013 |
| WO | 2014/025887 | 2/2014 |
| WO | WO 2017/075030 | 5/2017 |

OTHER PUBLICATIONS

Clynes et al., "The chromatin remodeler ATRX: a repeat offender in human disease," Trends in Biomedical Sciences 38(9): 461-466 (2013).

Sarma et al., "ATRX directs binding of PRC2 to Xist RNA and Polycomb targets," Cell 6 159(4): 869-883 (2014).

GenBank AC092371.3 Homo sapiens chromosome 16 clone RP11-525J10, complete sequence [online] Sep. 29, 2001 [retrieved Jan. 21, 2016]. Available on the internet: <http://www.ncbi.nlm nih gov/nuccore/AC092371>.

GenBank AC239669.1 Homo sapiens chromosome 18 clone COR2A-DD0002SOMNU_J21, Working Draft Sequence, 2 unordered pieces [online] Jan. 22, 2010 [retrieved Jan. 21, 2016]. Available on the internet: <http://www.ncbi.nlm nih gov/nuccore/AC239669>.

U.S. Appl. No. 61/365,775, Bennett, filed Jul. 19, 2010.

Aartsma-Rus et al., "Comparative analysis of antisense oligonucleotide analogs for targeted DMD exon 46 skipping in muscle cells," Gene Therapy, 2004, 11: 1391-1398.

Agrelo and Wutz, "ConteXt of change-X inactivation and disease," EMBO Molecular Medicine, 2009, 2: 6-15.

Bhatnagar et al., Genetic and pharmacological reactivation of the mammalian inactive X chromosome, PNAS, Aug. 2014, 111: 12591-12598.

Braasch and Corey, "Locked nucleic acid (LNA): fine-tuning the recognition of DNA and RNA," Chemistry & Biology, 2001, 8: 1-7.

Chu et al., "Systematic Discovery of Xist RNA Binding Proteins," Cell, Apr. 2015, 161: 404-416.

European Search Report in Application No. 15854720.8, dated Jul. 5, 2018, 15 pages.

Hoffman et al., "Restoring Dystrophin Expression in Duchenne Muscular Dystrophy Muscle," The American Journal of Pathology, Jul. 2011, 179: 12-22.

Hung and Chung, "Long coding RNA in genome regulation," RNA Biology, Oct. 2010, 7: 582-585.

Knauert et al., "Triplex forming oligonucleotides: sequence-specific tools for gene targeting," Human Molecular Genetics, Oct. 2001, 10: 2243-2251.

McHugh et al., "The Xi st lncRNA interacts directly with SHARP to silence transcription through HDAC3," Nature, Apr. 2015, 521: 232-236.

Notice of European Opposition to the European patent in European Application No. 11840099.3, dated Feb. 28, 2018.

Office Action in Canadian Application No. 2,822,462, dated Nov. 14, 2017, 3 pages.

Office Action in Israeli Application No. 252267, dated Jan. 2, 2018, 12 pages.

Office Action in U.S. Appl. No. 15/050,273, dated May 11, 2018, 10 pages.

Office Action in U.S. Appl. No. 15/171,706, dated May 4, 2017, 13 pages.

Office Action in U.S. Appl. No. 15/171,883, dated Apr. 12, 2018, 9 pages.

Office Action in U.S. Appl. No. 15/265,104, dated Apr. 3, 2018, 19 pages.

Office Action in U.S. Appl. No. 15/265,104, dated Nov. 28, 2016, 33 pages.

Opposition to EP-B-2638163 by Roche Innovation Center Copenhagen A/S, Feb. 13, 2018, 55 pages.

Partial European Search Report in Application No. 15854720.8, dated Mar. 28, 2018, 18 pages.

Summerton, "Morpholino antisense oligomers: the case for an RNase H-independent structural type," Biochinnica et Biophysica Acta, 1999, 1489: 141-158.

Swayze and Bhat, Antisense Drug Technology, Chapter 6: The medicinal chemistry of oligonucleotides, Second Edition, 2008, 143-182.

Talebizadeh, "Brief Report: Non-Random X Chromosome Inactivation in Females with Autism," Journal of Autism and Developmental Disorders, Oct. 2005, 35: 675-681.

Torres et al.,"Potent and sustained cellular inhibition of miR-122 by lysine-derivatized peptide nucleic acids (PNA) and phosphorothioate locked nucleic acid (LNA)/2'-0-methyl (OMe) mixmer antimiRs in the absence of transfection agents," Artificial DNA: PNA & XNA, Sep. 2011, 2: 71-78.

Tu et al., "The PRC2-binding long non-coding RNAs in human and mouse genomes are associated with predictive sequence features," Sci Rep, 2017, 7:41669.

Wang et al , "Cyclohexene Nucleic Acids (CeNA): Serum Stable Oligonucleotides that Activate RNase H and Increase Duplex Stability with Complementary RNA," J. Am. Chem. Soc., 2000, 122: 8595-8602.

Wolff et al., "Molecular determination of X inactivation pattern correlates with phenotype in women with a structurally abnormal X chromosome," Genetics in Medicine, Mar./Apr. 2000, 2: 136-141.

Written Submission in European Application No. 11840099.3, dated Jul. 11, 2016, 11 pages.

(56) References Cited

OTHER PUBLICATIONS

Wutz and Jaenisch, A Shift Reversible to Irreversible X Inactivation is Triggered during ES Cell Differentiation, Molecular Cell, 5: 695-705.
www.exiqon.com [online]. "Antisense LNA TM GapmeRs," dated Apr. 11, 2013 [Retrieved on Feb. 1, 2018]. Retrieved from the Internet: www.exiqon.com/gapmers. 1 page.
www.exiqon.com [online]. "LNA™ Oligo Tools and Design Guidelines," dated Aug. 2011 [retrieved on Feb. 1, 2018], retrieved from the Internet: <http://www.exiqon.com :80/oligo-tools>. 1 page.
www.exiqon.com [online]. "Order Custom LNATM Oligonucleotides," dated Nov. 2011 [retrieved on Feb. 1, 2018], retrieved from the Internet: http://www.exiqon.com :80/order-lna-oligos. 1 page.
Cerritelli and Crouch, "Ribonuclease H: the enzymes in eukaryotes," 2009, FEBS J., 276(6): 1494-1505.
Crooke et al., "Kinetic characteristics of *Escherichia coli* RNase Hi: cleavage of various antisense oligonucleotideRNA duplexes," Biochem J, 1995, 312:599-608.
Kung et al., "Locus-Specific Targeting to the X Chromosome Revealed by the RNA Interactome of CTCF," Molecular Cell, Jan. 2015, 57: 361-375.
Kung et al., "Supplemental Information: Locus-Specific Targeting to the X Chromosome Revealed by the RNA Interactome of CTCF," Molecular Cell, Jan. 2015, 32 pages.
Lebedeva and Stein, "Phosphothioate oligodeoxynucleotides as inhibitors of gene expression: antisense and non-antisense effects," Applications of Antisense Therapies to Restenosis, 1999, p. 101.
Mitev et al., "Inhibition of Intracellular Growth of *Salmonella enterica* Serovar Typhimurium in Tissue Culture by Antisense Peptide-Phosphorodiamidate Morpholino Oligomer," Antimicrobial Agents and Chemotherapy, 2009 53(9):3700-3704.
Office Action in Canadian Application No. 2,817,256, dated Sep. 26, 2018, 5 pages.
Office Action in Canadian Application No. 2,822,462, dated Nov. 9, 2018, 13 pages.
Office Action in European Application No. 15854720.8, dated Mar. 22, 2019, 5 pages.
Office Action in European Application No. 17000579.7, dated Sep. 27, 2018, 5 pages.
Parital Supplementary Search Report in Application No. 16765719.6, dated Oct. 25, 2018, 14 pages.
Popescu, "Antisense- and RNA interference-based therapeutic strategies in allergy," J. Cell. Mol. Med, 2005, 9(4):840-853.
Summerton, "Morpholino, siRNA, and S-DNA Compared: Impact of Structure and Mechanism of Action on Off-Target Effects and Sequence Specificity," Current Topics in Medicinal Chemistry, 2007, 7:651-660.
Turner and Bracken, "A "Complex" Issue: Deciphering the Role of Variant PRC1 in ESCs," Cell Stem Cell, Feb. 2013, 12(2): 145-146.
Wan et al., "Long non-coding RNA ANRIL (CDKN2B-AS) is induced by the ATM-E2F1 signaling pathway," Cellelar Signalling, May 2013, 25: 1086-1095.
www.biosyn.com' [online] "What are Oligomimetics or oligonucleotide mimetics?," Jun. 20, 2016 [retrieved on Oct. 3, 2018]. Retrieved from the Internet: URL <https://www.biosyn.com/faq/what-are-oligomimetics-or-oligo-nucleotide-mimetics.aspx>. 1 page.
Obad et al, "Silencing of microRNA families by seed targeting tiny LNAs," Nature Genetics, 43(4):371-380.
U.S. Appl. No. 15/558,974, filed Sep. 15, 2017, Jeannie T. Lee.
U.S. Appl. No. 13/884,670, filed Feb. 3, 2014, Jeannie T. Lee.
U.S. Appl. No. 15/050,273, filed Feb. 22, 2016, Jeannie T. Lee.
U.S. Appl. No. 15/171,860, filed Jun. 2, 2016, Jeannie T. Lee.
U.S. Appl. No. 15/171,706, filed Jun. 2, 2016, Jeannie T. Lee.
U.S. Appl. No. 15/171,883, filed Jun. 2, 2016, Jeannie T. Lee.
U.S. Appl. No. 15/265,104, filed Sep. 14, 2016, Jeannie T. Lee.
U.S. Appl. No. 13/921,738, filed Jun. 19, 2013, Jeannie T. Lee.
Ahn and Lee, "Retinoic acid accelerates downregulation of the Xist repressor, Oct4, and increases the likelihood of Xist activation when Tsix is deficient," BMC Develop Biol., 2010, 10:90, 14 pages.
Faghihi et al., "Expression of a noncoding RNA is elevated in Alzheimer's disease and drives rapid fee-forward regulation of [beta]-secretase," Nature Medicine, 14(7):723-730 (Jul. 2008).
Astuti et al., "Epigenetic alteration at the DLK1-GTL2 imprinted domain in human neoplasia: analysis of neuroblastoma, phaeochromocytoma and Wilms' tumour," British Journal of Cancer, 92(8):1574-1580 (2005).
Axelson, "The Notch signaling cascade in neuroblastoma: role of the basic helix-loop-helix proteins HASH-1 and HES-1," Cancer Lett., 2004, 204:171-178.
Bauman et al., "Therapeutic potential of splice-switching oligonucleotides," Oligonucleotides, Mar. 2009, 19(1):1-13.
Baumann and De La Fuente, "ATRX marks the inactive X chromosome (Xi) in somatic cells and during imprinted X chromosome inactivation in trophoblast stem cells," Chromosoma, Apr. 2009, 118: 209-222.
Behlke et al, "Designing Antisense Oligonucleotides," Integrated DNA Technologies, 2005, pp. 1-17.
Beletskii et al., "PNA interference mapping demonstrates functional domains in the noncoding RNA Xist," Proc Natl Acad Sci U S A, 2001, 98(16):9215-9220.
Beltran et al, "The interaction of PRC2 with RNA or chromatin is mutually antagonistic," Genome. Research, 2016, 26: 896-907.
Bernardi and Pandolfi, "Structure, dynamics and functions of promyelocytic leukaemia nuclear bodies," Nat Rev Mol Cell Biol., 2007, 8:1006-1016.
Bernstein and Allis, "RNA meets chromatin," Genes Dev., 2005, 19:1635-1655.
Bernstein et al., "A bivalent chromatin structure marks key developmental genes in embryonic stem cells," Cell, 2006, 125:315-326.
Bernstein et al., "Mouse polycomb proteins bind differentially to methylated histone H3 and RNA 15 and are enriched in facultative heterochromatin," Mol Cell Biol., 2006, 26:2560-2569.
Boyer et al., "Polycomb complexes repress developmental regulators in murine embryonic stem cells," Nature, 2006, 441:349-353.
Brockdorff et al., "The product of the mouse Xist gene is a 15 kb inactive X-specific transcript containing no conserved ORF and located in the nucleus," Cell, 1992, 71(3):515-526.
Brown et al., "The human XIST gene: analysis of a 17 kb inactive X-specific RNA that contains conserved repeats and is highly localized within the nucleus," Cell, 1992, 71(3):527-542.
Brown et al., "A gene from the region of the human X inactivation centre is expressed exclusively from the inactive X chromosome," Jan. 1991, Nature, 349:38-44.
Cardoso et al., "Specific interaction between the XNP/ATR-X gene product and the Set domain of the human EZH2 protein," Human Molecular Genetics, 1998, 7: 679-684.
Carninci, et al., "The transcriptional landscape of the mammalian genome," Science, Sep. 2005, 309(5740):1559-1563.
Carthew and Sontheimer, "Origins and Mechanisms of miRNAs and siRNAs. Cell," Feb. 2009, 136(4):642-55.
Catalogue of Parent of Origin Effects, Imprinted Genes and Related Effects, Parental Origins of de novo Mutations, downloaded at http://igc.otago.ac.nz/home.html on May 22, 2015, 2 pgs.
Chadwick and Willard, "Multiple spatially distinct types of facultative heterochromatin on the human inactive X chromosome," PNAS, 2004, 101: 17450-17455.
Chahrour et al., "MeCP2, a key contributor to neurological disease, activates and represses transcription," Science, May 30, 2008, 320(5880):1224-9 (Author Manuscript).
Cifuentes-Rojas et al., "Regulatory Interactions between RNA and Polycomb Repressive Complex 2," Molecular Cell, Jul. 2014, 55: 171-185.
Clark et al., "The Reality of Pervasive Transcription," Plos Bio., Jul. 2011, 9(7):e1000625. 6 pages.
Clemson et al., "XIST RNA paints the inactive X chromosome at interphase: evidence for a novel RNA involved in nuclear/chromosome structure," J Cell Biol., 1996, 132(3):259-275.
Cloonan et al., "Stem cell transcriptome profiling via massive-scale mRNA sequencing," Nat Methods, 2008, 5:613-619.
Coombes et al., "Epigenetic properties and identification of an imprint mark in the Nesp-Gnasxl domain of the mouse Gnas imprinted locus," Mol Cell Biol., 2003, 23:5475-5488.

(56) References Cited

OTHER PUBLICATIONS

Core et al., "Nascent RNA sequencing reveals widespread pausing and divergent initiation at human promoters," Science, 2008, 322:1845-1848 (Author Manuscript).
Costa et al., "Non-coding RNAs: New players in eukaryotic biology," Gene, 357(2):83-94 (2005).
Costanzi and Pehrson, "Histone macroH2A1 is concentrated in the inactive X chromosome of female mammals," Nature, 1998, 393: 599-601.
Curran, et al., "Computer aided manual validation of mass spectrometry-based proteomic data," Methods, 2013, 61: 219-226.
Cushman et al, "Synthesis of the Covalent Hydrate of the Incorrectly Assumed Structure of Aurintricarboxylic Acid (ATA)," Tetrahedron, 1990, 46: 1491-1498.
Da Rocha et al., "Jarid2 Is Implicated in the Initial Xist-Induced Targeting of PRC2 to the Inactive X Chromosome," Molecular Cell, 2014, 53: 301-316.
Darnell, "HITS-CLIP: panoramic views of protein-RNA regulation in living cells," Wiley Interdiscip Rev RNA, Sep.-Oct. 2010, 1(2): 266-286.
Davidovich et al, "Toward a Consensus on the Binding Specificity and Promiscuity of PRC2 for RNA," Molecular Cell, Jan. 2015, 57: 552-558.
Davidovich, "The recruitment of chromatin modifiers by long noncoding RNAs: lessons from PRC2," RNA, 2015, 21: 2007-2022.
Davidovich, et al., "Promiscuous RNA binding by Polycomb repressive complex 2," Nature Structural & Molecular Biology, Nov. 2013, 20: 1250-1257.
Davidson et al., "Singles engage the RNA interference pathway," Cell, Aug. 2012, 150(5):873-5.
Denisenko et al., "Point mutations in the WD40 domain of Eed block its interaction with Ezh2," Mol Cell Biol., 1998, 18:5634-5642.
Dhayalan et al., "The ATRX-ADD domain binds to H3 tail peptides and reads the combined methylation state of K4 and K9," Human Molecular Genetics, 2011, 20: 2195-2203.
Di Certo et al., "The artificial gene Jazz, a transcriptional regulator of utrophin, corrects the dystrophic pathology in mdx mice," Hum Mol Genet., Mar. 2010, 19(5):752-60.
Dinger et al., "NRED: a database of long noncoding RNA expression," Nucleic Acids Res., 2009, 37(suppl 1):D122-D126.
Dominski and Kole, "Identification and characterization by antisense oligonucleotides of exon and intron sequences required for splicing," Mol Cell Biol., Nov. 1994, 14(11):7445-7454.
Dominski and Kole, "Restoration of correct splicing in thalassemic pre-mRNA by antisense oligonucleotides," PNAS, Sep. 1993, 90(18):8673-7.
Du and Gatti, "Progress toward therapy with antisense-mediated splicing modulation," Curr Opin Mol Ther, Apr. 2009, 11(2):116-23 (Author Manuscript).
Dupont and Gribnau. "Different flavors of X-chromosome inactivation in mammals," Current Opinion in Cell Biology, 2013, 25, 314-321.
Duszczyk et al, "The Xist RNA A-repeat comprises a novel AUCG tetraloop fold and a platform for multimerization," RNA, 2011, 17: 1973-1982.
Duthie et al., "Xist RNA exhibits a banded localization on the inactive X chromosome and is excluded from autosomal material in cis," Hum Mol Genet., 1999, 8(2):195-204.
Edwards and Ferguson-Smith, "Mechanisms regulating imprinted genes in clusters," Curr Opin Cell. Biol., 2007, 19:281-289.
Edwards et al., "The evolution of the DLK1-DIO3 imprinted domain in mammals," PLoS Biol., 2008, 6:e135, 14 pages.
Engstrom et al., "Complex Loci in Human and Mouse Genomes," PLoS Genet., 2006, 2:e47, 14 pages.
European Search Report issued in EP11852141.8 dated Jan. 7, 2015, 7 pages.
Eustermann et al, "Combinatorial readout of histone H3 modifications specifies localization of ATRX to heterochromatin," Nature Structural & Molecular Biology, 2011, 18: 777-782.

Extended European Search Report in Application No. 17000579.7, dated Oct. 2, 2017, 9 pages.
Extended European Search Report issued in EP11840099.3 dated Oct. 7, 2014, 7 pages.
Francis et al., "Reconstitution of a functional core polycomb repressive complex," Mol Cell, 2001, 8:545-556.
Frieden et al., "Expanding the design horizon of antisense oligonucleotides with alpha-L-LNA," Nucleic Acids Res., Nov. 2003, 31(21):6365-72.
Froberg et al., "Guided by RNAs: X-inactivation as a model for lncRNA function," J Mol Biol, Oct. 2013, 425(19):3698-706.
Garrick et al., "Loss of Atrx affects trophoblast development and the pattern of X-inactivation in extraembryonic tissues," PLoS Genetics, 2006, 2: e58.
Genbank Submission; NIH/NCBI, Accession No. AA106140. Marra et al., Feb 4, 1997. 1 page.
Genbank Submission; NIH/NCBI, Accession No. AL137002. Holt, Dec. 13, 2012. 29 pages.
Genbank Submission; NIH/NCBI, Accession No. BX383579. Li et al., Dec. 23, 2010. 1 page.
Genbank Submission; NIH/NCBI, Accession No. NM_001079668. Young et al., Jan. 18, 2014. 4 pages.
Genbank Submission; NIH/NCBI, Accession No. NM_003317. Young et al., Jan. 18, 2014. 4 pages.
Genbank Submission; NIH/NCBI, Accession No. NM_028475. Diez-Roux et al., Feb. 3, 2014. 6 pages.
Geneimprint: About Geneimprint, downloaded from the internet at http://www.geneimprint.com/site/about-this-site on May 22, 2015.
Gibbons et al., "Mutations in the chromatin-associated protein ATRX," Human Mutation, 2008, 29: 796-802.
Gogliotti et al., "The DcpS inhibitor RG3039 improves survival, function and motor unit pathologies in two SMA mouse models," Hum Mol Genet., Jun. 2013, 55 pages.
Goldberg et al., "Distinct factors control histone variant H3.3 localization at specific genomic regions," Cell, 2010, 140, 678-691.
Gontan et al., "Long Noncoding RNAs and X Chromosome Inactivation," Prog Mol Subcell Biol, 2011, 51:43-64.
Guo et al., "High resolution genome wide binding event finding and motif discovery reveals transcription factor spatial binding constraints," PLoS Comput Biol., 2012, 8(8):e1002638.
Gupta et al., "Long non-coding RNA Hotair reprograms chromatin state to promote cancer metastasis," Nature, Apr. 15, 2010, 464(7291):1071-6 (Author Manuscript).
Guttman and Rinn, "Modular regulatory principles of large non-coding RNAs," Nature, Feb. 2012, 482(7385):339-46.
Guttman et al., "Chromatin signature reveals over a thousand highly conserved large non-coding RNAs in mammals," Nature, Mar. 2009, 458(7235):223-7 (Author Manuscript).
Helin and Dhanak, "Chromatin proteins and modifications as drug targets," Nature, 2013, 502: 480-488.
Hernandez et al., "Determinants for association and guide RNA-directed endonuclease cleavage by purified RNA editing complexes from Trypanosoma brucei," 2008, Journal of Molecular Biology, 2008, 381: 35-48.
Hoki et al., "A proximal conserved repeat in the Xist gene is essential as a genomic element for X-inactivation in mouse," Development, 2009, 136: 139-146.
Hua et al., "Antisense Masking of an hnRNP A1/A2 Intronic Splicing Silencer Corrects SMN2 Splicing in Transgenic Mice," Am J Hum Genet., Apr. 2008, 82(4):834-48.
Hua et al., "Antisense correction of SMN2 splicing in the CNS rescues necrosis in a type III SMA mouse model," Genes Dev., Aug. 2010, 24(15):1634-44.
Hua et al., "Enhancement of SMN2 Exon 7 Inclusion by Antisense Oligonucleotides Targeting the Exon," PLoS Biol., Apr. 2007, 5(4):e73.
Hua et al., "Peripheral SMN restoration is essential for long-term rescue of a severe spinal muscular atrophy mouse model," Nature, Oct. 2011, 478(7367):123-6 (Author Manuscript).
Huppertz et al., "iCLIP: protein-RNA interactions at nucleotide resolution," Methods, Feb. 2014, 65(3): 274-287.

(56) References Cited

OTHER PUBLICATIONS

Ilik et al., "Tandem stem-loops in roX RNAs act together to mediate X chromosome dosage compensation in *Drosophila*," Molecular Cell, 2013, 51: 156-173.

Imprinted Gene, Mosby's Dictionary of Medicine, Nursing & Health Professions, 8th Edition, 2009, p. 949.

Inesi et al., "Studies of Ca2+ ATPase (SERCA) inhibition," J Bioenerg Biomembr., Dec. 2005, 37(6):365-8.

Inouye, "Antisense RNA: its functions and applications in gene regulation—a review," Gene, Dec. 1988, 72(1-2):25-34.

International Preliminary Report on Patentability in International Application No. PCT/US2011/060493, dated May 14, 2013, 10 pages.

International Preliminary Report on Patentability in International Application No. PCT/US2011/065939, dated Jun. 25, 2013, 11 pages.

International Preliminary Report on Patentability in International Application No. PCT/US2015/058338, dated May 2, 2017, 7 pages.

International Search Report and Written Opinion for Application No. PCT/US2011/060493 dated Apr. 18, 2012, 17 pages.

International Search Report and Written Opinion for Application No. PCT/US2013/041440 dated Jul. 29, 2013, 17 pages.

International Search Report and Written Opinion for Application No. PCT/US2013/041452 dated Jul. 29, 2013, 15 pages.

International Search Report and Written Opinion for Application No. PCT/US2013/041381 dated Jul. 29, 2013, 18 pages.

International Search Report and Written Opinion for Application No. PCT/US2013/041455 dated Aug. 29, 2013, 14 pages.

International Search Report and Written Opinion for Application No. PCT/US2013/041389 dated Jul. 29, 2013, 14 pages.

International Search Report and Written Opinion for Application No. PCT/US2013/041385 dated Aug. 21, 2013, 12 pages.

International Search Report and Written Opinion for Application No. PCT/US2013/041394 dated Aug. 21, 2013, 13 pages.

International Search Report and Written Opinion for Application No. PCT/US2011/065939 dated Apr. 20, 2012, 16 pages.

Iwase et al., "ATRX ADD domain links an atypical histone methylation recognition mechanism to human mental-retardation syndrome," Nature Structural & Molecular Biology, 2011, 18: 769-776.

Jeon and Lee, "YY1 tethers Xist RNA to the inactive X nucleation center," Cell, Jul. 8, 2011, 146(1):119-33.

Jepsen et al., "Locked nucleic acid: a potent nucleic acid analog in therapeutics and biotechnology," Oligonucleotides, 2004, 14, 130-146.

Jia et al., "Genome-wide computational identification and manual annotation of human long noncoding RNA genes," RNA, 2010, 16(8):1478-1487.

Johansson et al., "Target-specific arrest of mRNA translation by antisense 2'-O-alkyloligoribonucleotides," Nucleic Acids Res., Nov. 1994, 22(22):4591-8.

Johnson et al., "Molecular characterization of EGFR and EGFRvIII signaling networks in human glioblastoma tumor xenografts," Molecular & Cellular Proteomics, 2012, 11: 1724-1740.

Johnson, "Long non-coding RNAs in Huntington's disease neurodegeneration," Neurobiol Dis., 2012, 46:245-54.

Kaneko et al., "Interactions between JARID2 and noncoding RNAs regulate PRC2 recruitment to chromatin," Molecular Cell, 2014, 53: 290-300.

Kanhere et al., "Short RNAs Are Transcribed from Repressed Polycomb Target Genes and Interact with Polycomb Repressive Complex-2," Molecular Cell, 2010, 38: 675-688.

Kapranov et al., "Genome-wide transcription and the implications for genomic organization," Nat Rev Genet., 2007, 8(6):413-423.

Kapranov et al., "RNA maps reveal new RNA classes and a possible function for pervasive transcription," Science, 2007, 316:1484-1488.

Kent et al., "Evolution's cauldron: duplication, deletion, and rearrangement in the mouse and human genomes," PNAS, Sep. 2003, 100(20) 11484-11489.

Khalil et al., "Many human large intergenic noncoding RNAs associate with chromatin-modifying complexes and affect gene expression," Proc Natl Acad Sci U S A, Jul. 14, 2009, 106(28):11667-72.

Kharchenko et al., "Design and analysis of ChIP-seq experiments for DNA-binding proteins," Nature Biotechnology, 2008, 26: 1351-1359.

Kim et al., "Widespread transcription at neuronal activity-regulated enhancers," Nature, 2010, 465(7295):182-187 (Author Manuscript).

Klein et al., "Homeostatic regulation of MeCP2 expression by a CREB-induced microRNA," Nat Neurosci., Dec. 2007, 10(12):1513-4.

Krutzfeldt et al., "Silencing of microRNAs in vivo with 'antagomirs'," Nature, 2005, 438(7068):685-689.

Ku et al., "Genomewide analysis of PRC1 and PRC2 occupancy identifies two classes of bivalent domains," PLoS Genet., 2008, 4:e1000242, 14 pages.

Law et al., "ATR-X syndrome protein targets tandem repeats and influences allele-specific expression in a size-dependent manner," Cell, 2010, 143: 367-378.

Lee and Bartolomei, X-inactivation, imprinting, and long noncoding RNAs in health and disease, Cell, Mar. 2013, 152: 1308-1323.

Lee and Lu, "Targeted mutagenesis of Tsix leads to nonrandom X inactivation," Cell, 1999, 99:47-57.

Lee et al., "Control of developmental regulators by Polycomb in human embryonic stem cells," Cell, 2006, 125:301-313.

Lee et al., "Genetic analysis of the mouse X inactivation center defines an 80-kb multifunction domain," Proc. Natl. Acad. Sci., Mar. 1999, 96: 3836-3841.

Lee et al., "Tsix, a gene antisense to Xist at the X-inactivation centre," Nature Genetics, 1999, 21: 400-404.

Lee, "Epigenetic regulation by long noncoding RNAs," Science, Dec. 14, 2012, 338(6113):1435-9.

Lee, "Lessons from X-chromosome inactivation: long ncRNA as guides and tethers to the epigenome," Genes Dev., 2009, 23:1831-1842.

Lee, "The X as model for RNA's niche in epigenomic regulation," Cold Spring Harb Perspect Biol., 2010, 2:a003749, 12 pages.

Lewis et al., "Daxx is an H3.3-specific histone chaperone and cooperates with ATRX in replication-independent chromatin assembly at telomeres," PNAS, 2010, 107: 14075-14080.

Li et al., "Jarid2 and PRC2, partners in regulating gene expression," Genes Dev., 2010, 24:368-380.

Lim and Hertel, "Modulation of survival motor neuron pre-mRNA splicing by inhibition of alternative 3' splice site pairing," J Biol Chem., Nov. 30, 2001, 276(48):45476-83.

Lima et al., "Single-stranded siRNAs activate RNAi in animals," Cell, Aug. 31, 2012, 150(5):883-94.

Lin et al., "An in-depth map of polyadenylation sites in cancer," Nucleic Acids Res., Sep. 1, 2012, 40(17):8460-71.

Lin et al., "Asymmetric regulation of imprinting on the maternal and paternal chromosomes at the Dlk1-Gt12 imprinted cluster on mouse chromosome 12," Nat Genet., 2003, 35:97-102.

Lipovich et al., "MacroRNA underdogs in a microRNA world: Evolutionary, regulatory, and biomedical significance of mammalian long non-protein-coding RNA" Biochimica et Biophysica Acta, Sep. 2010, 1799(9):597-615.

Maenner et al., "2-D structure of the a region of Xist RNA and its implication for PRC2 association," PLoS Biology, 2010, 8: e1000276.

Maenner et al., "ATP-dependent roX RNA remodeling by the helicase maleless enables specific association of MSL proteins," Molecular Cell, 2013, 51: 174-184.

Margueron and Reinberg, "The Polycomb complex PRC2 and its mark in life," Nature, Jan. 20, 2011, 469(7330):343-9 (Author Manuscript).

Mariner et al., "Human Alu RNA Is a Modular Transacting Repressor of mRNA Transcription during Heat Shock," Feb. 2008, 29: 499-509.

Mercer et al., "Long non-coding RNAs: insights into functions," Nat Rev Genet., Mar. 2009, 10(3):155-9.

Mercer et al., "Structure and function of long noncoding RNAs in epigenetic regulation," Mar. 5, 2013, 20:300-7.

(56) References Cited

OTHER PUBLICATIONS

Merienne and Trottier, "SCA8 CAG/CTG expansions, a tale of two TOXICities: a unique or common case?" PLoS Genet., Aug. 2009, 5(8):e1000593.
Mikkelsen et al., "Genome-wide maps of chromatin state in pluripotent and lineage-committed cells," Nature, 2007, 448:553-560 (Author Manuscript).
Miremadi et al., "Cancer genetics of epigenetic genes," Hum Mol Genet., 2007, 16(Spec No. 1):R28-49.
Mitson et al., "Functional significance of mutations in the Snf2 domain of ATRX," Human Molecular Genetics, 2011, 20: 2603-2610.
Miura and Jasmin, "Utrophin upregulation for treating Duchenne or Becker muscular dystrophy: how close are we?" Trends Mol Med., Mar. 2006, 12(3):122-9.
Miyajima et al., "Identification of a cis-acting element for the regulation of SMN exon 7 splicing," J Biol Chem., Jun. 28, 2002, 277(26):23271-7.
Miyaso et al., "An intronic splicing enhancer element in survival motor neuron (SMN) pre-mRNA," J Biol Chem., May 2, 2003, 278(18):15825-31.
Modarresi et al., "Inhibition of natural antisense transcripts in vivo results in gene-specific transcriptional upregulation," Nat Biotechnol, 30(5):453-9 (Mar. 25, 2012) doi: 10.1038/nbt.2158. 21 pages.
Montgomery et al., "The murine polycomb group protein Eed is required for global histone H3 lysine-27 methylation," Curr Biol., 2005, 15:942-947.
Morris et al., "Small interfering RNA-induced transcriptional gene silencing in human cells," Science, Aug. 27, 2004, 305(5688):1289-92.
Morris, "RNA-mediated transcriptional gene silencing in human cells," Curr Top Microbiol Immunol., 2008, 320:211-224.
Mortazavi et al. "Mapping and quantifying mammalian transcriptomes by RNA-Seq," Nat Methods, 2008, 5:621-628.
Muller and Verrijzer, "Biochemical mechanisms of gene regulation by polycomb group protein complexes," Current Opinion in Genetics & Development, 2009, 19: 150-158.
Munroe et al., "Antisense RNA inhibits splicing of pre-mRNA in vitro," EMBO J., Aug. 1988, 7(8):2523-2532.
Nagano et al., "The Air noncoding RNA epigenetically silences transcription by targeting G9a to chromatin," Science, Dec. 12, 2008, 322(5908):1717-20.
Nie et al., "Long non-coding RNAs: versatile master regulators of gene expression and crucial players in cancer," Am J Transl Res., 2012, 4(2):127-50.
Numata et al., "Comparative analysis of cis-encoded antisense RNAs in eukaryotes," Gene, 2007, 392(1-2):134-141.
Numata et al., "Identification of novel endogenous antisense transcripts by DNA microarray analysis targeting complementary strand of annotated genes," BMC Genomics, 2009, 10:392, 12 pages.
Nusinow et al., "Poly(Adp-ribose) polymerase 1 is inhibited by a histone H2A variant, MacroH2A, and contributes to silencing of the inactive X chromosome," The Journal of Biological Chemistry, 2007, 282: 12851-12859.
Office Action in Canadian Application No. 2761633, dated Sep. 26, 2017, 3 pages.
Office Action in EP 11852141.8, dated Mar. 28, 2017, 7 pages.
Office Action in Israeli Application No. 252267, dated Oct. 3, 2017, 7 pages.
Office Action in Japanese Application No. 2013-538959, dated Sep. 6, 2017, 13 pages (with English translation).
Office Action in Japanese Application No. 2013-538959, dated Oct. 19, 2016, 15 pages (with English translation).
Office Action in U.S. Appl. No. 13/921,738, dated Apr. 12, 2017, 37 pages.
Office Action in U.S. Appl. No. 15/050,273, dated Aug. 16, 2017, 17 pages.
Office Action in U.S. Appl. No. 15/050,273, dated Feb. 8, 2017, 40 pages.
Office Action in U.S. Appl. No. 15/171,860, dated Apr. 12, 2017, 38 pages.
Office Action in U.S. Appl. No. 15/171,883, dated May 23, 2017, 34 pages.
Office Action in U.S. Appl. No. 15/265,104, dated Apr. 26, 2017, 15 pages.
Office Action issued in AU2011325956 dated May 27, 2016, 4 pages.
Office Action issued in AU2011325956 dated Sep. 23, 2014, 3 pages.
Office Action issued in AU2011349464 dated Sep. 23, 2014, 3 pages.
Office Action issued in EP 11852141.8 dated Apr. 18, 2016, 17 pages.
Office Action issued in EP11840099.3 dated Oct. 5, 2015, 7 pages.
Office Action issued in IL226302 dated Jun. 14, 2016, 14 pages.
Office Action issued in JP 2013538959 dated Nov. 5, 2015, 7 pages.
Office Action issued in U.S. Appl. No. 15/171,706 dated Dec. 9, 2016, 38 pages.
Ogawa et al., "Intersection of the RNA interference and X-inactivation pathways," Science, Jun. 2008, 320: 1336-1341.
Okada et al., "Comparative expression analysis uncovers novel features of endogenous antisense transcription," Hum Mol Genet., 2008, 17(11):1631-40.
Orom et al., "LNA-modified oligonucleotides mediate specific inhibition of microRNA function," Gene, 2006, 372:137-141.
Ozsolak et al., "Comprehensive polyadenylation site maps in yeast and human reveal pervasive alternative polyadenylation," Cell, Dec. 10, 2010, 143(6):1018-29.
Pandey et al., "Kcnq1ot1 antisense noncoding RNA mediates lineage-specific transcriptional silencing through chromatinlevel regulation," Mol Cell, Oct. 24, 2008, 32(2):232-46.
Paro and Lee, "Extending the frontiers of epigenetic regulation," Curr Opin Genet Dev., Apr. 2010, 20(2):107-9.
Pasini et al., "Suz12 is essential for mouse development and for EZH2 histone methyltransferase activity," EMBO J., 2004, 23:4061-4071.
Pasmant et al., "Characterization of a germ-line deletion, including the entire INK4/ARF locus, in a melanoma-neural system tumor family: identification of ANRIL, an antisense noncoding RNA whose expression coclusters with ARF," Cancer Res, Apr. 2007, 67: 3963-3969.
Pedersen et al., "Identification and classification of conserved RNA secondary structures in the human genome," PLoS Comput Biol., Apr. 2006, 2(4):e33.
Peng et al., "Jarid2/Jumonji Coordinates Control of PRC2 Enzymatic Activity and Target Gene Occupancy in Pluripotent Cells," Cell, 2009, 139:1290-1302.
Penny et al., "Requirement for Xist in X chromosome inactivation," Nature, 1996, 379(6561):131-137.
Pereira et al., "Ezh2, the histone methyltransferase of PRC2, regulates the balance between self-renewal and differentiation in the cerebral cortex," Proc Natl Acad Sci U S A., Sep. 7, 2010, 107(36):15957-62.
Petersen and Wengel, "LNA: a versatile tool for therapeutics and genomics," Trends Biotechnol., 2003, 21(2):74-81.
Pietersen and van Lohuizen, "Stem cell regulation by polycomb repressors: postponing commitment," Curr Opin Cell Biol., 2008, 20:201-207.
Pinter et al., "Spreading of X chromosome inactivation via a hierarchy of defined Polycomb stations," Genome Research, 2012, 22: 1864-1876.
Ponting et al., "Evolution and functions of long noncoding RNAs," Cell, 2009, 136(4):629-641.
Prasnath et al., "Regulating Gene Expression through RNA Nuclear Retention," Cell, Oct. 2005, 123: 249-263.
Qi et al., "Repurposing CRISPR as an RNA-guided platform for sequence-specific control of gene expression," Cell, Feb. 28, 2013, 152(5):1173-83.
Rajasekhar and Begemann, "Concise review: roles of polycomb group proteins in development and disease: a stem cell perspective," Stem Cells, 2007, 25:2498-2510.

(56) References Cited

OTHER PUBLICATIONS

Ratnakumar and Bernstein, "ATRX: the case of a peculiar chromatin remodeler," Epigenetics, 2013, 8: 3-9.
Rigo et al., "Antisense-based therapy for the treatment of spinal muscular atrophy," J Cell Biol., Oct. 1, 2012, 199(1):21-5.
Ringrose and Paro, "Epigenetic regulation of cellular memory by the Polycomb and Trithorax group proteins," Annu Rev Genet., 2004, 38:413-443.
Rinn and Chang, "Genome Regulation by Long Noncoding RNAs," Annu Rev Biochem., 2012, 81:145-66 (Author Manuscript).
Rinn et al., "Functional demarcation of active and silent chromatin domains in human HOX loci by noncoding RNAs," Cell, 2007, 129:1311-1323.
Røsok and Sioud, "Systematic identification of sense-antisense transcripts in mammalian cells," Nat Biotechnol., 2004, 22(1):104-8.
Sarma et al., "Locked nucleic acids (LNAs) reveal sequence requirements and kinetics of Xist RNA localization to the X chromosome," Proc Natl Acad Sci U S A, Dec. 21, 2010, 107(51):22196-22201.
Saxena et al., "Long non-coding RNA modifies chromatin," Bioessays, 2011, 33:830-9.
Schoeftner et al., "Recruitment of PRC1 function at the initiation of X inactivation independent of PRC2 and silencing," Embo J., 2006, 25:3110-3122.
Schuettengruber et al., "Genome regulation by polycomb and trithorax proteins," Cell, 2007, 128:735-745.
Schultz et al., "Enhancers compete with a long non-coding RNA for regulation of the Kcnq1 domain," Nucleic Acids Research, 2015, vol. 43, No. 2 745-759 (2014).
Schwartz and Pirrotta, "Polycomb complexes and epigenetic states," Curr Opin Cell Biol., 2008, 20:266-273.
Schwartz et al., "Genome-wide analysis of Polycomb targets in *Drosophila melanogaster*," Nat Genet., 2006, 38:700-705.
Sciabola et al., "Improved nucleic acid descriptors for siRNA efficacy prediction," Nucleic Acids Research, 2012, 1-12.
Seila et al., "Divergent transcription from active promoters," Science, Dec. 19, 2008, 322(5909):1849-51 (Author Manuscript).
Seong et al., "Huntingtin facilitates polycomb repressive complex 2," Hum Mol Genet., Feb. 15, 2010, 19(4):573-83.
Shamovsky et al., "RNA-mediated response to heat shock in mammalian cells," Mar. 2006, 440: 556-60.
Shaver et al., "Origin of the polycomb repressive complex 2 and gene silencing by an E(z) homolog in the unicellular alga Chlamydomonas," Epigenetics, May 16, 2010, 5(4):301-12.
Shen et al., "EZH1 mediates methylation on histone H3 lysine 27 and complements EZH2 in maintaining stem cell identity and executing pluripotency," Mol Cell, 2008, 32:491-502.
Shen et al., "Jumonji Modulates Polycomb Activity and Self-Renewal versus Differentiation of Stem Cells," Cell, 2009, 139:1303-1314.
Shore et al., "Pregnancy-induced noncoding RNA (PINC) associates with polycomb repressive complex 2 and regulates mammary epithelial differentiation," PLoS Genet., 2012, 8(7):e1002840.
Simon and Kingston, "Occupying chromatin: Polycomb mechanisms for getting to genomic targets, stopping transcriptional traffic, and staying put," Molecular Cell, Mar. 2013, 49: 808-824.
Simon and Lange, "Roles of the EZH2 histone methyltransferase in cancer epigenetics," Mutat Res., 2008, 647:21-29.
Simon et al., "High-resolution Xist binding maps reveal two-step spreading during X-chromosome inactivation," Nature, 504(7480):465-9 (Dec. 19, 2013) doi: 10.1038/nature12719. Epub Oct. 27, 2013.
Sing et al., "A vertebrate Polycomb response element governs segmentation of the posterior hindbrain," Cell, 2009, 138:885-897.
Singh et al., "Splicing of a Critical Exon Unique Silencer Element Located in the of Human Survival Motor Neuron Is Regulated by a Last Intron," Mol Cell Biol., Feb. 2006, 26(4):1333-46.
Singh et al., "The regulation and regulatory activities of alternative splicing of the SMN gene," Crit Rev Eukaryot Gene Expr., 2004, 14(4):271-85.
Slides for Discussion During Examiner Interview, U.S. Appl. No. 13/884,670, filed Nov. 4, 2014.
Sparmann and van Lohuizen, "Polycomb silencers control cell fate, development and cancer," Nat Rev Cancer, 2006, 6:846-856.
Stanley T. Crooke, Antisense Drug Technology, Second Edition, 2007, 120-123.
Starmer and Magnuson, "A new model for random X chromosome inactivation," Development, Jan. 2009, 136: 1-10.
Sunwoo et al., "Distal-less homeobox transcription factors regulate development and maturation of natural killer cells," PNAS, Aug. 2008, 105: 10877-82.
Taft et al., "Non-coding RNAs: regulators of disease," The Journal of Pathology, 220(2):126-139 (2009).
Taft et al., "Tiny RNAs associated with transcription start sites in animals," Nat Genet., 2009, 41:572-578.
Takagi et al., "Role of Sp1 in transcription of human ATPZAZ gene in keratinocytes," J Invest Dermatol., Jan. 2008, 128(1):96-103.
Takahashi et al., "Deletion of Gtl2, imprinted non-coding RNA, with its differentially methylated region induces lethal parent-origin-dependent defects in mice," Hum Mol Genet., 2009, 18:1879-1888.
Tang et al., "A novel transcription regulatory complex containing death domain-associated protein and the ATR-X syndrome protein," The Journal of Biological Chemistry, 2004, 279: 20369-20377.
Tano et al., "MALAT-1 enhances cell motility of lung adenocarcinoma cells by influencing the expression of motility-related genes," FEBS Letters, 584(22):4575-4580 (2010).
Thorvaldsen and Bartolomei, "SnapShot: imprinted gene clusters," Cell, 2007, 130:958.
Tian et al., "The long noncoding RNA, Jpx, is a molecular switch for X chromosome inactivation," Cell, 143(3):390-403 (Oct. 29, 2010) doi: 10.1016/j.cell.2010.09.049. 21 pages.
Torarinsson et al., "Thousands of corresponding human and mouse genomic regions unalignable in primary sequence contain common RNA structure," Genome Res., 2006, 16:885-889.
Tsai et al., "Higher order chromatin structure at the X-inactivation center via looping DNA," Dev Biol, 319(2):416-25 (Jul. 15, 2008) doi: 10.1016/j.ydbio.2008.04.010. Epub Apr. 18, 2008. 22 pages.
Tsai et al., "Long noncoding RNA as modular scaffold of histone modification complexes," Science, Aug. 6, 2010, 329(5992):689-93(Author Manuscript).
Ule et al., "CLIP: a method for identifying protein-RNA interaction sites in living cells," Methods, 2005, 37:376-386.
Vickers et al., "Fully modified 2' MOE oligonucleotides redirect polyadenylation," Nucleic Acids Res., Mar. 15, 2001, 29(6):1293-9.
Wahlestedt, "Natural antisense and noncoding RNA transcripts as potential drug targets," Drug Discov Today, Jun. 2006, 11(11-12):503-8.
Wahlestedt, "Targeting long non-coding RNA to therapeutically upregulate gene expression," Nature Rev Drug Disc., Jun. 2013, 12:433-46.
Wan and Bartolomei, "Regulation of imprinting in clusters: noncoding RNAs versus insulators," Adv Genet., 2008, 61:207-223.
Wang and Change, "Molecular mechanisms of long noncoding RNAs," Cell Press, Sep. 16, 2011, 43(6):904-14.
Wang et al., "Long non-coding RNA UCA1a(CUDR) promotes proliferation and tumorigenesis of bladder cancer," Int J Oncol., Jul. 2012, 41(1):276-84.
Washietl et al., "Fast and reliable prediction of noncoding RNAs," Proc. Natl. Acad. Sci., 2005, 102:2454-2459.
Wilker et al., "14-3-3sigma controls mitotic translation to facilitate cytokinesis," Nature, 2007, 446, 329-332.
Williams et al., "Oligonucleotide-mediated survival of motor neuron protein expression in CNS improves phenotype in a mouse model of spinal muscular atrophy," J Neurosci., Jun. 17, 2009, 29(24):7633-8.
Williamson et al., "Identification of an imprinting control region affecting the expression of all transcripts in 10 the Gnas cluster," Nat Genet., 2006, 38:350-355.
Wilusz et al., "A triple helix stabilizes the 3' ends of long noncoding RNAs that lack poly(A) tails," Genes Dev., Nov. 1, 2012, 26(21):2392-407.

(56) References Cited

OTHER PUBLICATIONS

Woo et al., "Gene activation of SMN by selective disruption of lncRNA-mediated recruitment of PRC2 for the treatment of spinal muscular atrophy," PNAS, Feb. 2017, E1509-E1518.
Woo et al., "A region of the human HOXD cluster that confers Polycomb-group responsiveness," Cell, 2010, 140:99-110.
Wutz et al., "Chromosomal silencing and localization are mediated by different domains of Xist RNA," Nat Genet., 2002, 30(2):167-174.
Wutz, "Gene silencing in X-chromosome inactivation: advances in understanding facultative heterochromatin formation," Nat Rev Genet, 2011, 12: 542-553.
Xue et al., "The ATRX syndrome protein forms a chromatin-remodeling complex with Daxx and localizes in promyelocytic leukemia nuclear bodies," PNAS, 2003, 100: 10635-10640.
Yakali et al, Supramolecular chirality-sensing DNA-mimicry of a norbornane derivative decorated with isoxazoline and methylpyrolidine-2,5-dione ring, 2013, Journal of Molecular Structure, 1041: 1 64-1 74.
Yang et al., "Global survey of escape from X inactivation by RNA-sequencing in mouse," Genome Research, 2010, 20: 614-622.
Yang et al., "Long noncoding RNAs: fresh perspectives into the RNA world," Trends Biochem Sci.,39(1):35-43 (Jan. 2014) doi: 10.1016/j.tibs.2013.10.002. Epub Nov. 27, 2013. Review.
Yap et al., "Molecular interplay of the noncoding RNA ANRIL and methylated histone H3 lysine 27 by polycomb CBX7 in transcriptional silencing of INK4a," Mol Cell, 2010, 38:662-674.
Yu et al., "Single-stranded RNAs use RNAi to potently and allele-selectively inhibit mutant huntingtin expression," Cell, Aug. 31, 2012, 150(5):895-908 (Author Manuscript).
Zhang et al., "NATsDB: Natural Antisense Transcripts DataBase ," Nucl. Acids Res., 2006, 35(suppl 1): D156-D161.
Zhao et al., "Genome-wide identification of polycomb-associated RNAs by RIP-seq," Mol Cell., Dec. 22, 2010, 40(6):939-53.
Zhao et al., "Polycomb proteins targeted by a short repeat RNA to the mouse X-chromosome," Science, 2008, 322(5902):750-756 (Author Manuscript).
Agrelo et al., "SATB1 defines the developmental context for gene silencing by Xist in lymphoma and embryonic cells," Apr. 2009, 16(4):507-516.
Alahari et al., "Inhibition of expression of the multidrug resistance-associated P-glycoprotein of by phosphorothioate and 5' cholesterol-conjugated phosphorothioate antisense oligonucleotides," Mol. Pharmacol., Oct. 1996, 50(4):808-819.

Arun et al., "Differentiation of mammary tumors and reduction in metastasis upon Malat1 lncRNA loss," Genes & Development, Jan. 2016, 30(1):34-51.
Dravidovich & Cech., "The recruitment of chromatin modifiers by long noncoding RNAs: lessons from PRC2," RNA, Dec. 2015, 21(12):2007-2022.
EP Decision of Technical Board of Appeal 3.3.2, dated Sep. 30, 1996, in Case No. T 958/94, 10 pages.
EP Decision Revoking the European Patent in European Appln. 11840099.3, dated Nov. 11, 2019, 51 pages.
EP Office Action in European Appln. 16765719, dated Apr. 7, 2020, 4 pages.
Faghihi & Wahlestedt., "Regulatory roles of natural antisense transcripts," Nat. Rev. Mol. Cell. Biol., Sep. 2009, 10(9):637-643.
Freier and Watt., Basic Principles of Antisense Drug Discovery, Chapter 5, pp. 120-122 of Antisense Drug Technology: Principles, Strategies, and Applications, Second Edition, Jul. 25, 2007 by CRC Press.
Gutschner et al., "The noncoding RNA MALAT1 is a critical regulator of the metastasis phenotype of lung cancer cells," Cancer Research, Feb. 2013, 73(3):1180-1189.
Ishida and Gudrun., "The role of imprinted genes in humans," Molecular Aspects of Medicine, Jul. 2013, 34(4):826-840.
Matveeva et al., "Thermodynamic criteria for high hit rate antisense oligonucleotide design," Nucleic Acids Res., Sep. 2003, 31(17):4989-4994.
Migeon, Barbara R., Females Are Mosaics, New York: Oxford University Press, 2007. Print. Glossary: pp. 233 & 236.
Miraglia et al., "Inhibition of interleukin-1 type I receptor expression in human cell-lines by an antisense phosphorothioate oligodeoxynucleotide," International journal of immunopharmacology, Apr. 1996, 18(4):227-240.
Nagano & Fraser., "Emerging similarities in epigenetic gene silencing by long noncoding RNAs," Mamm Genome, Sep.-Oct. 2009, (9-10):557-562.
Osato et al., "Transcriptional interferences in cis natural antisense transcripts of humans and mice," Genetics, Jun. 2007, 176(2):1299-1306.
Sirchia et al., "Misbehaviour of XIST RNA in breast cancer cells," PloS one, May 2009, 4(5):e5559, 13 pages.
Tano et al., "Identification of minimal p53 promoter region regulated by MALAT1 in human lung adenocarcinoma cells," Frontiers in Genetics, Mar. 2018, 8:208, 10 pages.
Weksberg et al., "Beckwith-Wiedemann syndrome," American Journal of Medical Genetics Part C (Semin. Med.Genet.), 137C(1):12-23.

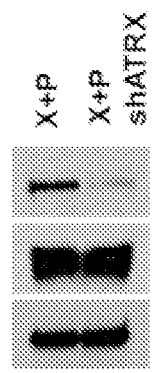 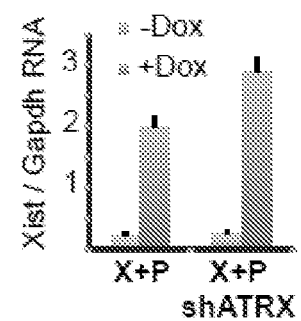
FIG. 2H  FIG. 2I
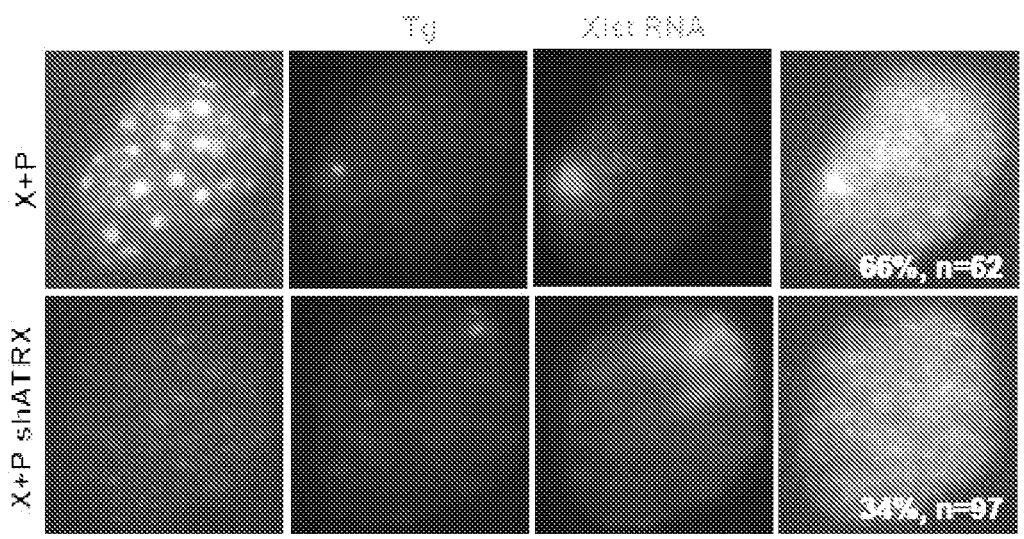
FIG. 2J

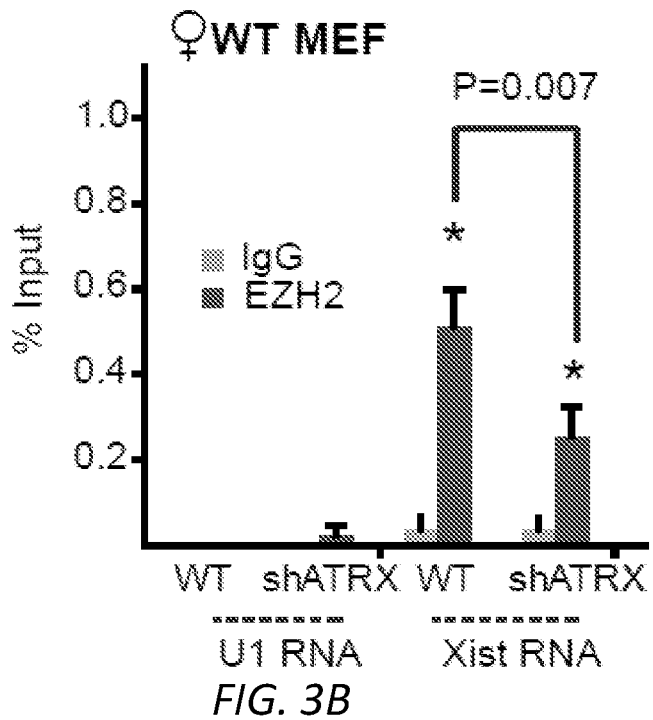
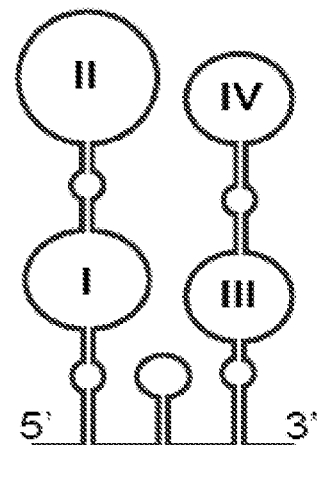
FIG. 3B
FIG. 3C
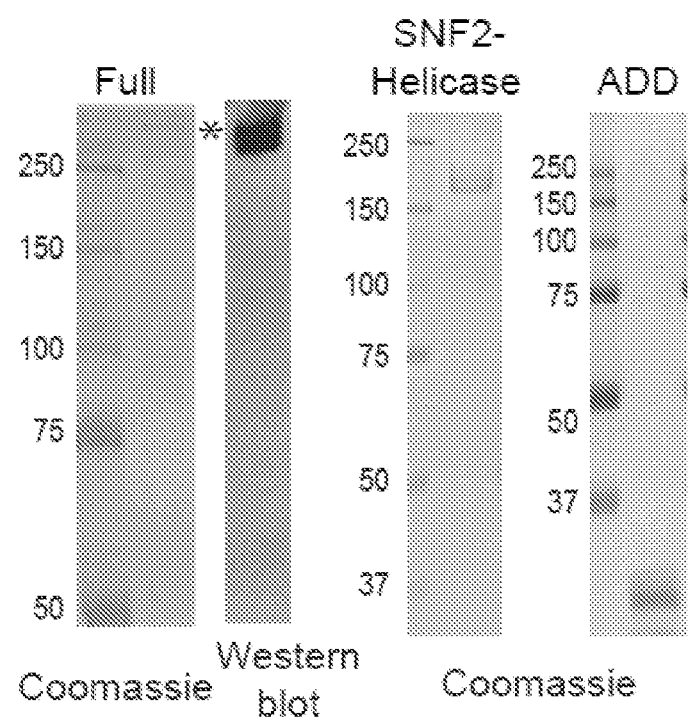
FIG. 3D

| ATRX coverage | Quartile | EZH2 targets |
|---|---|---|
| Highest (8.482) | Q1 | 788 |
| Mid-High (2.578) | Q2 | 747 |
| Mid-Low (0.011) | Q3 | 574 |
| Lowest (-3.685) | Q4 | 306 |

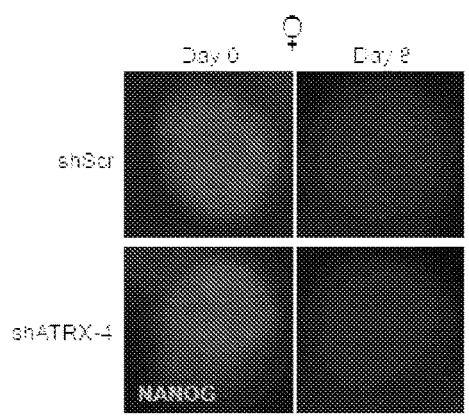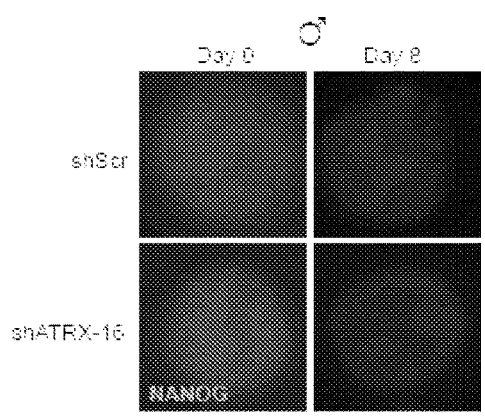
FIG. 9A   FIG. 9B
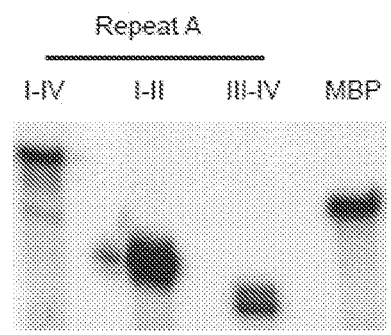
FIG. 10A

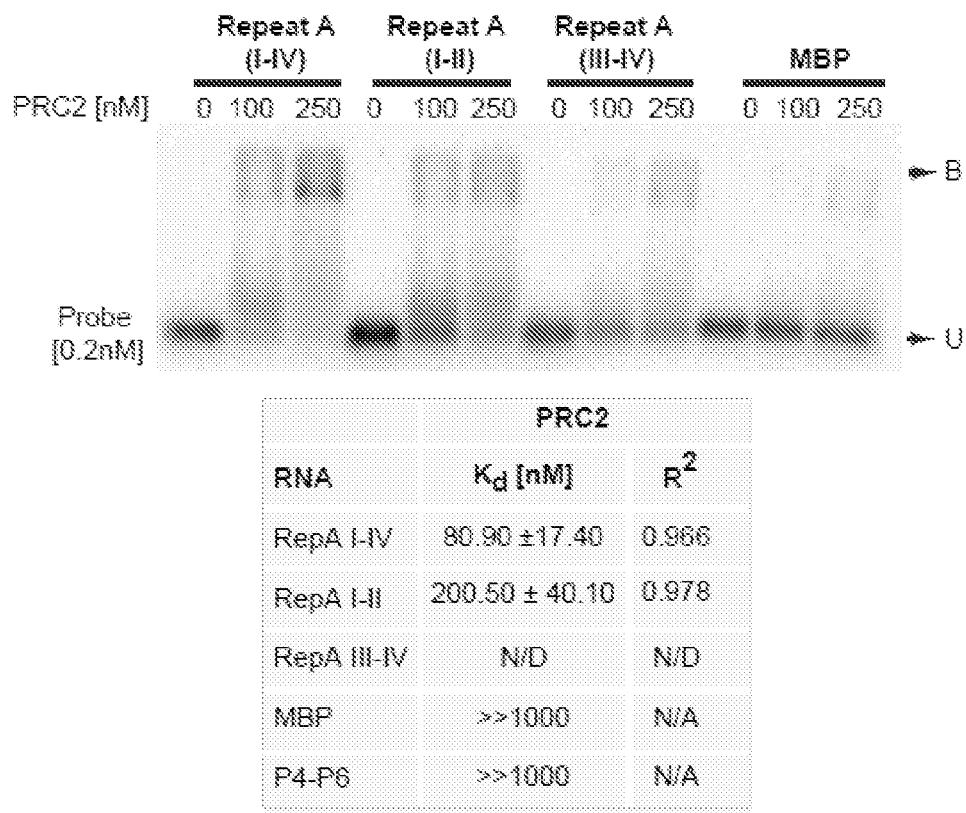
FIG. 10B
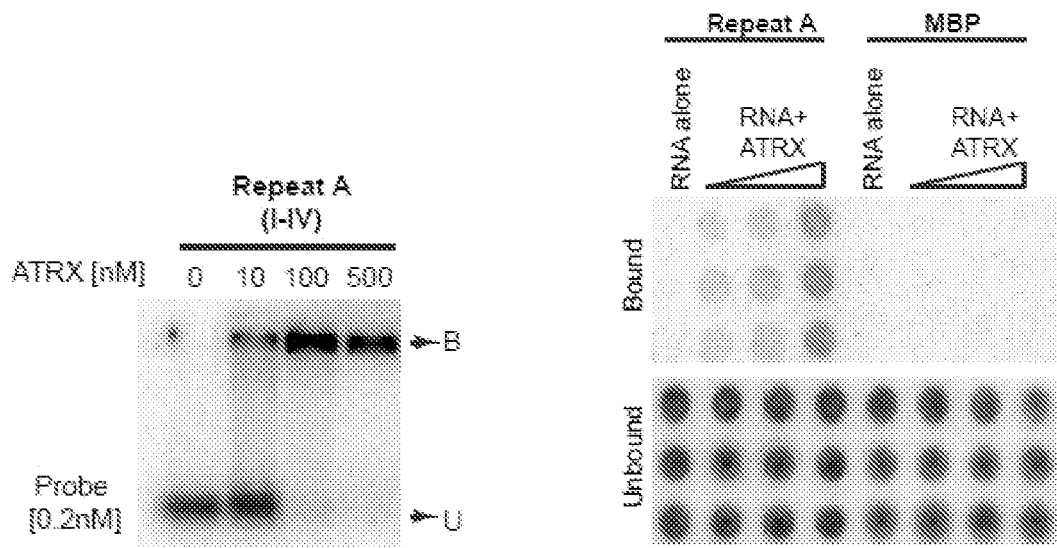
FIG. 10C
FIG. 10D

METHODS FOR MODULATING ATRX-DEPENDENT GENE REPRESSION

CLAIM OF PRIORITY

This application is a § 371 National Stage Application of PCT/US2015/058338, filed Oct. 30, 2015, which claims the benefit of U.S. Provisional Patent Application Ser. No. 62/072,962, filed on Oct. 30, 2014. The entire contents of the foregoing are hereby incorporated by reference.

FEDERALLY SPONSORED RESEARCH OR DEVELOPMENT

This invention was made with Government support under Grant No. RO1-GM090278 awarded by the National Institutes of Health. The Government has certain rights in the invention.

TECHNICAL FIELD

This invention relates to methods for modulation of the activity of alpha thalassemia/mental retardation syndrome X-linked (ATRX), e.g., modulation of DNA-ATRX or RNA-ATRX interactions, and methods for identifying and using compounds that modulate DNA-ATRX or RNA-ATRX interactions, as well as the compounds themselves.

BACKGROUND

Transcriptome analyses have suggested that, although only 1-2% of the mammalian genome is protein-coding, 70-90% is transcriptionally active (Carninci et al., Science 309, 1559-1563, 2005; Kapranov et al., Science 316, 1484-148, 2007; Mercer et al., Nat Rev Genet 10, 155-159, 2009). Ranging from 100 nt to >100 kb, these transcripts are largely unknown in function, may originate within or between genes, and may be conserved and developmentally regulated (Kapranov et al., 2007, supra; Guttman et al., 2009). Methods for targeting these transcripts allow for modulation of gene expression.

SUMMARY

The present invention is based, at least in part, on the discovery that ATRX protein is a required specificity determinant for locus-specific PRC2 targeting and effects on gene expression. Thus, methods and compounds targeting the ATRX-RNA interaction can be used to modulate gene expression.

In one aspect, the invention provides methods for increasing expression of a selected gene listed in Tables 1 or 2 or 3 or 4 or 5, in a cell, the method comprising contacting the cell with a nucleic acid triplex-forming oligonucleotide (TFO) that binds specifically to an ATRX localization sequence or binding site associated with the selected gene. In some embodiments, the selected gene is DMD, and the TFO targets a sequence within SEQ ID NOs.7867-7900. In some embodiments, the selected gene is XIST, and the TFO targets a sequence within SEQ ID NOs.7957, 7959, 7961, or 7962.

In another aspect, the invention provides methods for treating a subject who has Duchenne muscular dystrophy. The methods include administering to the subject a therapeutically effective amount of a TFO that targets a sequence within SEQ ID NOs. 7867-7900.

In a further aspect, the invention provides methods for treating a subject who has Rett Syndrome. The methods include administering to the subject a therapeutically effective amount of a TFO that targets a sequence within SEQ ID NOs. 7957, 7959, 7961, or 7962.

In some embodiments of the methods described herein, the TFO comprises one or more of DNA, RNA, PNA, HNA, MNA, ANA, LNA, CAN, INA, CeNA, TNA, (2'-NH)-TNA, (3'-NH)-TNA, alpha-L-Ribo-LNA, alpha-L-Xylo-LNA, beta-D-Ribo-LNA, beta-D-Xylo-LNA, [3.2.1]-LNA, Bicyclo-DNA, 6-Amino-Bicyclo-DNA, 5-epi-Bicyclo-DNA, alpha-Bicyclo-DNA, Tricyclo-DNA, Bicyclo[4.3.0]-DNA, Bicyclo[3.2.1]-DNA, Bicyclo[4.3.0]amide-DNA, beta-D-Ribopyranosyl-NA, alpha-L-Lyxopyranosyl-NA, 2'-R-RNA, 2'-OR-RNA, 2'-AE-RNA, alpha-L-RNA, and beta-D-RNA.

In some embodiments of the methods described herein, the TFO includes one or more modifications described herein.

In another aspect, the invention provides methods for preparing a library of nuclear ribonucleic acids (nRNAs) that specifically bind ATRX. Preferably, the methods include (a) contacting a sample containing nRNAs, e.g. at least $10^4$, $10^5$, or $10^6$ different nRNAs, with (i) ATRX protein and (ii) a ATRX binding agent, under conditions sufficient to form complexes between the nRNA, ATRX protein and the ATRX binding agent, and
(b) isolating the complexes.

In some embodiments, the methods further include (c) synthesizing cDNA complementary to the nRNA, and (d) selecting cDNAs that (i) have RPKM above a desired threshold or (ii) are enriched compared to a control library, or both (i) and (ii).

In a further aspect, the invention provides methods for preparing a plurality of cDNAs complementary to a pool of nuclear ribonucleic acids (nRNAs). Preferably, the methods include providing a sample comprising nuclear ribonucleic acids, e.g., a sample comprising nuclear lysate, e.g., comprising nRNAs bound to nuclear proteins; contacting the sample with an agent, e.g., an antibody, that binds specifically to ATRX protein, under conditions sufficient to form complexes between the agent and ATRX proteins, e.g., such that the nRNAs remain bound to the ATRX proteins; isolating the complexes; synthesizing DNA complementary to the nRNAs to provide an initial population of cDNAs; optionally PCR-amplifying the cDNAs using strand-specific primers; purifying the initial population of cDNAs to obtain a purified population of cDNAs that are at least about 20 nucleotides (nt) in length, e.g., at least 25, 50, 100, 150 or 200 nt in length; sequencing at least part of substantially all of the purified population of cDNAs; comparing the high-confidence sequences to a reference genome, and selecting those sequences that have a high degree of identity to sequences in the reference genome, e.g., at least 95%, 98%, or 99% identity, or that have fewer than 10, 5, 2, or 1 mismatches; and selecting those cDNAs that have (i) reads per kilobase per million reads (RPKM) above a desired threshold, and (ii) are enriched as compared to a control library (e.g., a protein-null library or library made from an IgG pulldown done in parallel); thereby preparing the library of cDNAs.

In some embodiments, the methods further include a step of crosslinking the nRNAs bound to nuclear proteins, e.g., using methods known in the art, including chemical or other crosslinkers, e.g., ultraviolet irradiation.

In some embodiments of the methods described herein, the agent is an antibody and isolating the complexes comprises immunoprecipitating the complexes.

In some embodiments of the methods described herein, the cDNAs are synthesized using strand-specific adaptors.

In some embodiments, the methods described herein include sequencing substantially all of the cDNAs.

In a further aspect, the invention provides libraries of cDNAs complementary to a pool of nuclear ribonucleic acids (nRNAs) prepared by a method described herein. In some embodiments, each of the cDNAs is linked to an individually addressable bead or area on a substrate.

In a further aspect, the invention provides methods for identifying compounds that disrupts binding of one or more nuclear RNAs (nRNAs), e.g., long non-coding RNAs (lncRNAs) or coding mRNAs, to ATRX protein. Preferably, the methods include providing a sample comprising an nRNA and ATRX, wherein the nRNA can bind to the ATRX and form nRNA-ATRX complexes; contacting the sample with a test compound; and detecting the formation of nRNA-ATRX complexes in the presence and the absence of the test compound, wherein a decrease in formation of nRNA-ATRX complexes in the presence of the test compound as compared to formation of nRNA-ATRX complexes in the absence of the test compound indicates that the test compound disrupts binding of the lncRNA to ATRX. In some embodiments, the interacting RNA is and lncRNA; in some embodiments, the nRNA is a coding origin (mRNA). Herein, nRNA includes nuclear lncRNA and mRNA.

In some embodiments of the methods described herein, the sample is a cell-free sample. In some embodiments, the sample comprises a cell expressing the nRNA and ATRX. In some embodiments, the sample is from a mammalian cell, e.g., a human cell or a non-human animal cell, e.g., a non-human primate, cow, pig, sheep, horse, cat, dog, or other domestic or agricultural animal.

In some embodiments of the methods described herein, the ATRX, the nRNA, or both, is labeled.

In some embodiments, the test compound is a nucleic acid, e.g., an antagomir, mixmer, or gapmer of LNA.

In some embodiments, the methods described herein further include isolating nRNA-ATRX complexes from the sample, and optionally isolating unbound ATRX from the sample, e.g., by contacting the sample with an anti-ATRX antibody, and isolating nRNA-ATRX-antibody complexes and unbound ATRX.

In some embodiments, the methods further include selecting a compound that disrupts binding of the nRNA to ATRX; contacting a tumor cell with the compound; measuring proliferation, survival, or invasiveness of the tumor cell in the presence and absence of the compound; and identifying as a candidate therapeutic compound a compound that inhibits proliferation, affects survival, e.g., induces or promotes cell death, or reduces or delays metastasis, of the tumor cell.

In some embodiments, the methods further include administering the candidate compound to an animal model of cancer, and detecting an effect of the compound on cancer in the animal model, e.g., an effect on tumor size or metastasis.

In a further aspect, the invention provides methods for identifying an RNA target for the treatment of cancer, the method comprising: (a) comparing (i) a library of nRNAs that specifically bind ATRX prepared from a normal cell with (ii) a library of nRNAs that specifically bind ATRX prepared from a cancerous cell, wherein the to normal cell and cancerous cell are of the same tissue type; and (b) identifying an nRNA that is differentially expressed between the libraries of (a)(i) and (a)(ii) as an RNA target for treatment of cancer.

In a further aspect, the invention provides methods for identifying a therapeutic target for the treatment of cancer, the method comprising: providing a population of nRNAs from a first cell type, by:
(1) providing a sample comprising nuclear ribonucleic acids, e.g., a sample comprising nuclear lysate, e.g., comprising nRNAs bound to nuclear proteins, from the first cell type;
contacting the sample with an agent, e.g., an antibody, that binds specifically to ATRX protein, under conditions sufficient to form complexes between the agent and ATRX proteins, e.g., such that the nRNAs remain bound to the ATRX proteins;
isolating the complexes; and
thereby providing a population of nRNAs from the first cell type;
(b) providing a population of nRNAs from a second cell type, by:
(1) providing a sample comprising nuclear ribonucleic acids, e.g., a sample comprising nuclear lysate, e.g., comprising nRNAs bound to nuclear proteins, from the second cell type;
contacting the sample with an agent, e.g., an antibody, that binds specifically to ATRX protein, under conditions sufficient to form complexes between the agent and ATRX proteins, e.g., such that the nRNAs remain bound to the ATRX proteins;
isolating the complexes;
synthesizing DNA complementary to the nRNAs to provide an initial population of cDNAs;
(2) thereby providing a population of cDNAs from the second cell type;
(c) wherein the first and second cell types are from the same type of tissue, and the first or second cell type is a tumor cell;
(d) contacting the population of nRNAs from the first cell type with the cDNAs from the second cell type, under conditions sufficient for the nRNAs to bind to complementary cDNAs; and
(e) identifying an nRNA that is differentially expressed in the first or second cell type as a therapeutic target for the treatment of cancer.

As used herein, "ATRX" refers to transcriptional repressor protein ATRX, the human homolog of which has an mRNA sequence as set forth in the GenBank database at Accession No. NM_000489.4, and a protein sequence as set forth at Accession No. NP_000480.3.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

Figure 1A:
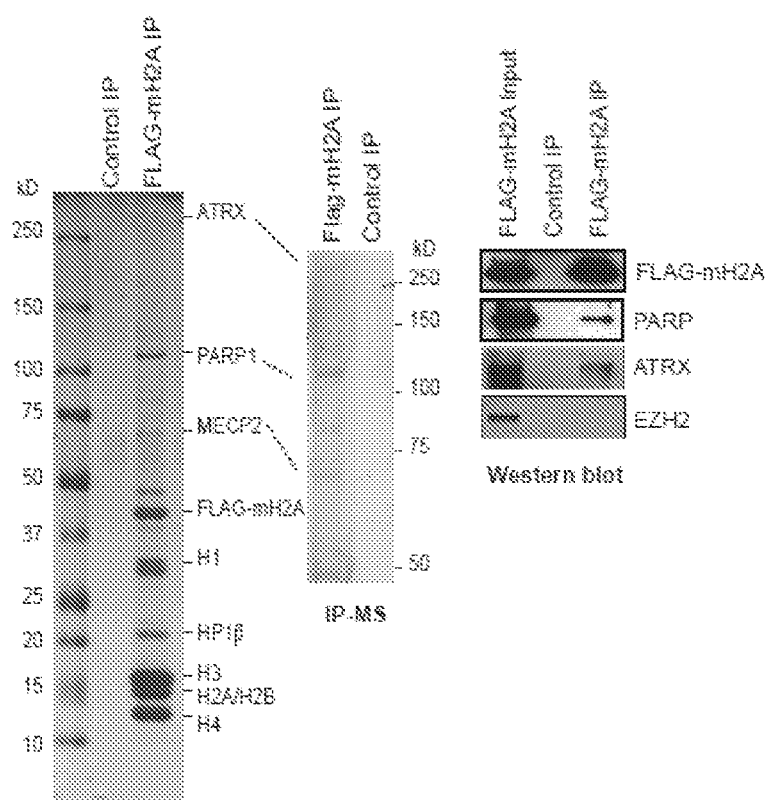
FIGS. 1A-D. A proteomics screen identifies ATRX as a candidate XCI regulator.

(A) IP-MS: Colloidal blue staining of FLAG IP from control (293F) and FLAG-mH2A-expressing 293 run on a 4-20% (left) and a 6% (right) SDS gradient gel. FLAG IP was validated by Western blot.

(B) Left: Immunostaining of ATRX, EZH2, and H3K27me3 in WT and two independent stable ATRX-KD MEF lines (shATRX-1,-2). Sample size (n) and % EZH2 association with Xi are shown.

Middle: Western blot showing ATRX depletion but constant EZH2 levels in shATRX-1 and shATRTX-2 female MEFs.

Right: Patterns of H3K27me3 observed. n=100-150 per experiment.

(C) Left: Xist RNA FISH in indicated fibroblast lines. Right: qRT-PCR analyses of Xist RNA levels. Standard error (S.E.) bars from 3 independent experiments are shown with student t test P values.

(D) Left Immunostaining of ATRX and EZH2 in MEFs transiently transfected with scrambled shRNA (shScr) and two shATRX constructs (shATRX-1, shATRX-2).

Right: H3K27me3 staining and Xist RNA FISH show no change in the intensity or foci number after transient ATRX KD.

FIGS. 2A-K. ATRX is required for initiation of XCI during ES cell differentiation.
(A) Western blot of ATRX and EZH2 after stable ATRX KD.
(B) ATRX immunostaining after stable ATRX-KD.
(C) Representative phase contrast images of embryoid bodies during a differentiation time course.
(D) qRT-PCR analysis of Tsix and Xist RNA, normalized to tubulin RNA, during a differentiation time course. S.E. from 3 independent experiments shown.
(E) Immunostaining of EZH2 and ATRX at day 8 of differentiation. (n) and % with EZH2 Xi foci are indicated.
(F) Immunostaining of ATRX and H3K27me3 and Xist RNA FISH at day 10 of differentiation. (n) and % positive are shown.
(G) Left: Western blot of indicated histone marks in day 8 ESCs. Graphs: Time course of Xist upregulation and acquisition of H3K27me3 foci. n=80-120 per time point.
(H) Western blot for ATRX, EZH2, and CTCF (control) in transgene (X+P) cells and in the same cell line expressing shATRX (X+P shATRX).
(I) qRT-PCR of Xist RNA before and after doxycycline induction in transgenic cells. S.E. from 3 independent experiments shown.
(J,K) Immunostaining of ATRX, EZH2 (J), and H3K27me3 (K), and Xist RNA/DNA FISH in indicated cells lines after 24 h dox induction. % with shown pattern and sample size (n) are indicated.

FIGS. 3A-I: ATRX binds RNA and stimulates RNA binding to PRC2.
(A,B) RIP+UV crosslinking in X+P transgenic MEFs after dox-induction for 24 h (A) or WT MEF (B) Primers spanning Xist exons 1-3 and U1 snRNAs were used for qPCR. 1% input was processed in parallel. S.E. from 3 independent experiments. P values calculated using Student t-test.
(C) One possible structure of Repeat A (Maenner et al., 2010).
(D) Coomassie stain of purified full-length FLAG-ATRX-HA (left), C-terminal SNF2/helicase (middle), and N-terminal ADD (right) domains.

(E) RNA EMSA with ATRX at indicated concentrations and 0.2 nM of each probe. B, bound; U, unbound probe.
(F) Left: Binding Isotherms of ATRX for indicated RNAs. S.E. from 3 independent experiments shown. Right: Table summarizing $K_d$'s and $R^2$ values. >>200 nM indicates $K_d$'s out of the assay range. N/A, not applicable.
(G) EMSA of ATRX with different RNA, dsDNA, or ssDNA probes.
(H) Left: Binding Isotherms of ATRX for indicated DNAs. S.E. for 3 independent experiments shown for each point. Right: Table summarizing $K_d$'s and $R^2$ values. >>200 nM indicates $K_d$'s out of the assay range. N/A, not applicable.
(I) RNA and DNA EMSAs using ATRX truncation mutants, with summary of results.

FIGS. 4A-F: A ternary complex of ATRX, PRC2, and RNA, with stimulation of PRC2 binding in an ATP-dependent manner.
(A) FLAG-ATRX-HA binding to PRC2±ATP in the absence of RNA. HA-immunoprecipitated material was probed with α-EZH2 antibodies for Western.
(B) Tandem IP to detect ternary complex formation between ATRX, Repeat A RNA, and PRC2.
(C) Binding reaction to test for simultaneous association of ATRX with RNA and DNA. RNA and DNA can be discerned by their different electrophoretic mobilities.
(D) Top: Inverted image of RNA gel showing Repeat A RNA recovered after EZH2 IP±ATRX and ±ATP. Bottom: Western blot showing protein levels in input and recovered after IP. Representative results from 3 independent experiments shown.
(E) Photo crosslinking of PRC2 and Repeat A RNA in the presence of ATRX with ATP or AMP-PNP. Representative results from 5 biological replicates shown.
(F) Filter binding of ATRX binding to Repeat A RNA (left) or DNA (right)±ATP and +AMP-PNP. ATRX concentrations are indicated and S.E. from 3 independent experiments shown. *, p<0.05.

FIGS. 5A-L: An ATRX hotspot at the Xist locus requires function of Repeat A.
(A) Chromosome-wide profiles of ATRX coverage on Xi and Chr13 show input-normalized ATRX density over 10 Kb bins, gene (TSS) density, and the density of transcriptionally active genes based on previous data (Yang et al., 2010).
(B) Allele-specific analysis: Normalized densities (10-kb bins, smoothened) of Xist RNA, EZH2, H3K27me3 (Pinter et al., 2012; Simon et al., 2013), and ATRX in female MEFs along X.
(C) ATRX peak distribution in MEFs across promoter (TSS+/−3 kb), genic, and intergenic regions.
(D) ATRX densities at 50-kb resolution across 50 Mb of the Xic, centered on Xist.
(E) Allele-specific ATRX ChIP-seq tracks showing *M. musculus* (mus), *M. castaneus* (cas), and composite (comp) reads across the Xist locus in day 0 and 7 ESC and MEFs. Comp track includes all aligned reads, both allelic and non-allelic. Positions of peaks/enriched segments (grey bars) are shown under comp tracks. Representative autosomal tracks (Chr13) shown in FIG. 11C.
(F) ATRX genic densities for all genes in MEFs (y-axis) and ESC (x-axis).
(G) ATRX coverages on gene bodies of *mus* alleles for ChrX and Chr13 in female MEFs. KS test, P=1.

(H) Log 2 ATRX coverage densities for Xi genes classified as "expressed on Xa" (FPKM≥1) or "silent on Xa" (FPKM<1). KS test, P=0.80
(I) ATRX coverage on XCI escapees (purple) on *Mus* or cas alleles. Grey, all other ChrX genes. P value was computed between *Mus* and cas escapees using KS test.
(J) Map of Xist alleles in WT, Xa$^{WT}$ X$^{2lox}$ (III.8), and the conditional Xist deletion Xa' Xi (III.20) MEF lines, with ChIP-qPCR amplicon positions and ChIP-qPCR results (graphs) for ATRX. Averages of 3 independent ATRX ChIP expressed as % of input, with S.E. shown. *, P<0.05. **, P<0.005 (Student t-test).
(K) RNA/DNA FISH for Xist RNA and transgenic DNA in the transgenic X+P and X-RA male MEF lines after 24 h dox-induction. Map of transgenes shown on top. Bottom graph: ChIP-pPCR of corresponding WT and transgenic MEF lines 24 h after dox-induction of Xist. Averages of 3 independent ChIP-qPCR experiments shown with S.E. *, P<0.05. **, P<0.005 (Student t-test).
(L) Model: RepA/Xist RNAs co-transcriptionally recruit ATRX. ATRX may be "poised" to bind RNA via Repeat A dsDNA. ATRX remodels Repeat A RNA motif and enhances binding of PRC2. The Xist locus becomes an ATRX hotspot. Spreading depends on the ATRX-RNA-PRC2 interactions.

FIGS. 6A-G: Global roles of ATRX in regulating PRC2 localization and function
(A) RefSeq genes (21,677) divided into equal quartiles (Q1-Q4) based on ATRX coverage. Average ATRX coverages and number of EZH2 target genes (peaks) in each quartile are shown.
(B) Dot plots showing Log 2 densities of EZH2 and H3K27me3 in ATRX+vs. ATRX KD MEFs for each quartile. ****, P<<0.0001, as calculated by the Student t test.
(C) Scatterplot of EZH2 and H3K27me3 densities in Log 2 scale over all genes (grey dots) and Q1 PRC2 target genes (purple dots) in ATRX+ or ATRX KD MEFs. The difference between ATRX+ and ATRX KD cells of Q1 PRC2 target genes is highly significant (P<2.2e-16, Student t test) for both epitopes.
(D) Probability density function for EZH2 and H3K27me3 based on coverages over the Q1-PRC2 target genes in the indicated MEF samples.
(E) Metagene profiles of EZH2 (top) and H3K27me3 (bottom) coverage. The metagenes are scaled 0 to 1 from genic start (TSS, x=0) to end (TTS, x=1).
(F) Distribution of EZH2 and H3K27me3 peaks in indicated MEF samples.
Peaks are categorized as TSS (+/−3 Kb), genic, or intergenic. Total number of peaks called for each dataset is indicated next to each chart.
(G) ChIP-seq tracks showing EZH2 and H3K27me3 densities in ATRX+ and ATRX-KD MEFs. Black bars, significantly enriched segments. H3K4me3 (pink) and RNA Seq (blue) tracks are as published (Yang et al., 2010; Yildirim et al., 2012).

FIGS. 7A-E: Loss of EZH2 from target genes as a result of ATRX knockdown results in activation of these genes.
(A, B) Left panel: ChIP-seq tracks of the Hoxd cluster (A) or individual genes (B) showing EZH2 and H3K27me3 patterns in ATRX+ and ATRX-KD MEFs. Black bars, statistically significant enriched segments. Replicates are labeled Rep1 and Rep2. H3K4me3 (pink) and RNA Seq (blue) tracks were previously published (Yang et al., 2010; Yildirim et al., 2012).
(C) qRT-PCR analysis of expression levels before and after ATRX KD. Averages and S.E. of 3 independent experiments shown with Student t-test P values.
(D) EZH2 and H3K27me3 coverages over TSS before and after ATRX KD.
(E) Model: ATRX-dependent targeting of PRC2 on a genome-wide scale. ATRX mediates targeting either by directly binding DNA, or via regulatory RNAs such as those in the PRC2 interactome.

Figure 8A:
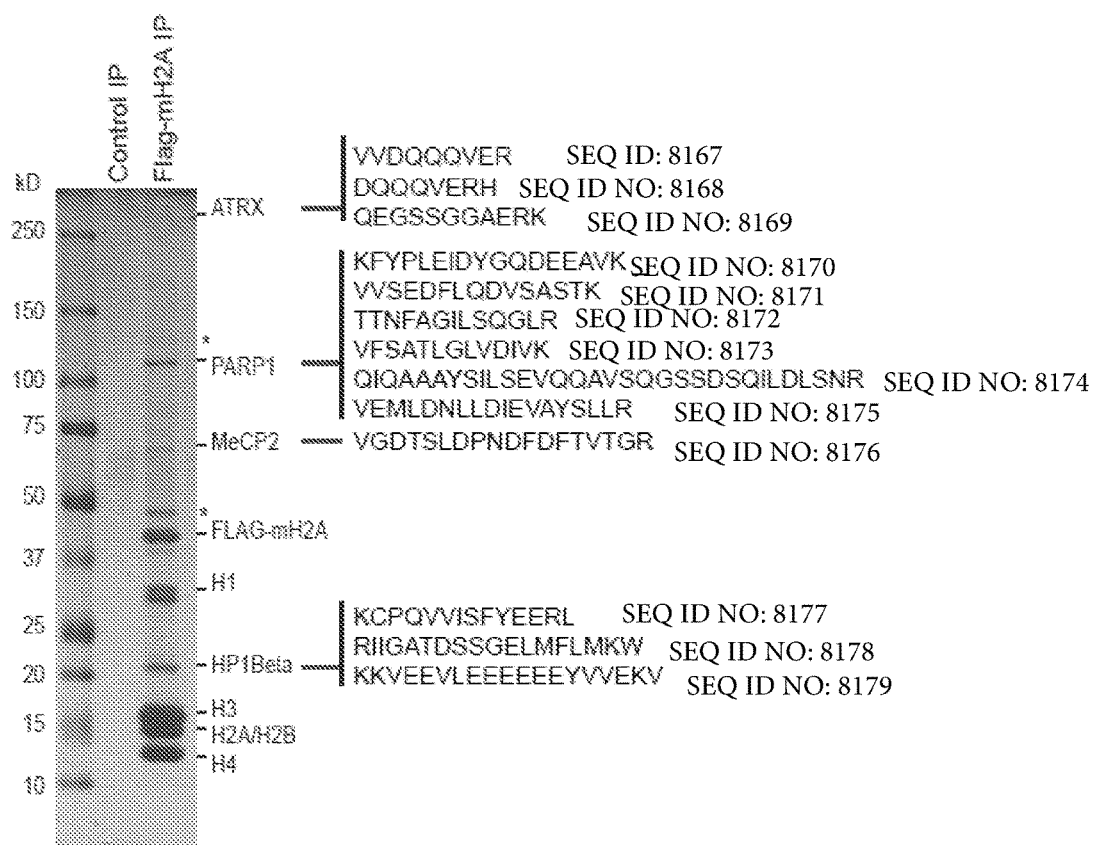
Figure 8B:
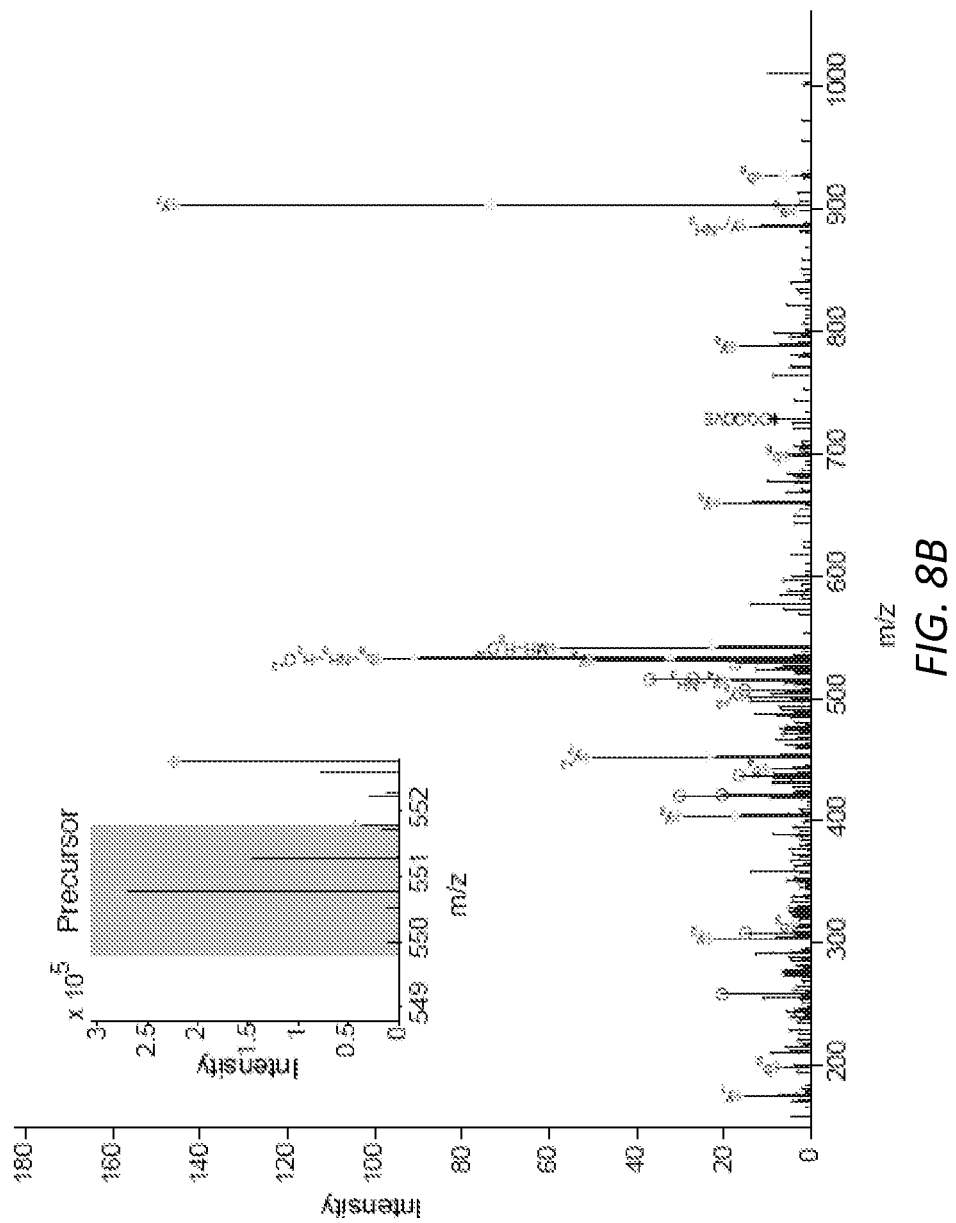
Figure 10E:
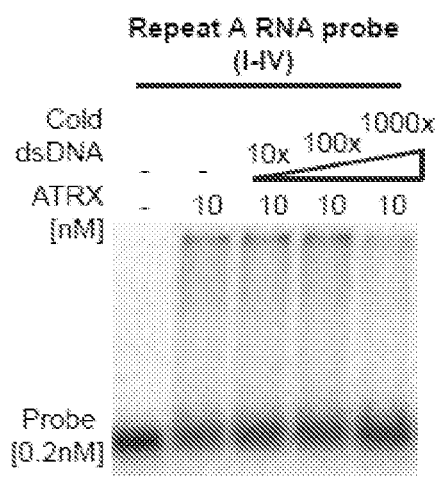
Figure 10F:
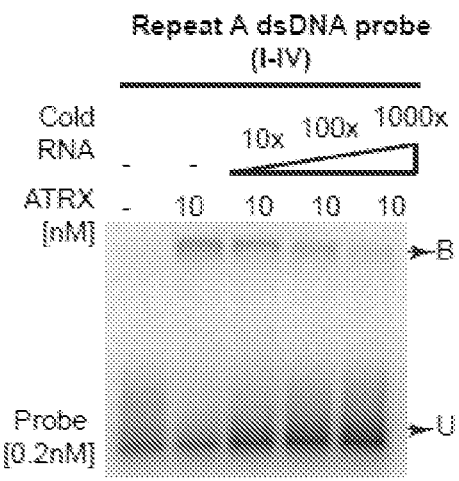

FIGS. 8A-B: FLAG-macroH2A pulldown and mass spectrometry of 293 cells identifiy interacting proteins. FIG. 8 relates to FIG. 1.
(A) Colloidal blue staining of FLAG immunoprecipitates from a control (293F) and 293F FLAG macroH2A expressing cell line run on a 4-20% SDS gradient gel (top). Samples are indicated on top of the panels. Peptides recovered and validated as high confidence hits for each protein are shown to the right. Histone peptides were too numerous to be labeled. Bands labeled with asterisks correspond to the following: Black asterisk, one ATRX peptide at a lower than expected molecular weight and red asterisk, macroH2A peptides.
(B) The validated spectra for ATRX is shown at the bottom.

FIGS. 9A-B: NANOG staining indicates proper ES cell differentiation. FIGS. 9A-B relate to FIG. 2.
(A) NANOG staining (red) in female shScr and shATRX-4 cells at day 0 and day 8 of differentiation.
(B) NANOG staining (red) in male shScr and shATRX-16 cells at day 0 and day 8 of differentiation.

FIGS. 10A-F: Biochemical analysis of ATRX-RNA and PRC2-RNA interactions. FIGS. 10A-F relates to FIG. 3.
(A) In vitro transcribed Repeat A and MBP RNAs were run on a polyacrylamide UREA gel and gel purified to obtain the full length RNA for gel shift assays.
(B) Left: RNA EMSA PRC2 at indicated concentrations and 0.2 nM probe of species indicated. Locations of bound (B) and unbound (U) RNA probe are marked. Right: Table summarizing $K_d$'s and $R^2$ values of PRC2 bound to different RNA species. >>1000 for PRC2 indicate $K_d$'s that were out of the assay range. N/D, not determined. N/A, not applicable.
(C) RNA EMSA with ATRX at indicated concentrations and 0.2 nM probe of species indicated. Locations of bound (B) and unbound (U) RNA probe are marked.
(D) Double filter binding assay using increasing concentrations of ATRX (0, 2.5, 5 and 10 nM) with either Repeat A RNA or MBP RNA. Upper panel represents RNA bound to ATRX and the lower panel free or unbound RNA. Experiment was done in triplicate to show reproducibility across wells.
(E) ATRX binding to $^{32}$P-labeled Repeat A (I-IV) RNA in the presence of increasing concentrations of Repeat A DNA competitor.
(F) ATRX binding to $^{32}$P-labeled Repeat A (I-IV) dsDNA in the presence of increasing concentrations of Repeat A (I-IV) RNA competitor.

FIGS. 11A-D: ATRX densities across the X chromosome and chromosome 13 in WT and ATRX KD MEFs. FIGS. 11A-D relate to FIG. 5.
(A) ATRX densities with 50-kb bin sizes across the entire X chromosome. The highest density of ATRX on the X chromosome is observed around the X inactivation center (Xic) that is marked in red.
(B) ATRX densities with 50-kb bin sizes across 50 kb of the Xic, centered on Xist. The genomic co-ordinates are indicated on the x axis.

(C) ATRX ChIP-seq tracks showing *M. musculus* (mus), *M. castaneus* (cas), and composite (comp; sum of both allelic and non-alleleically aligned reads) across a Chr13 locus in day 0 and 7 mESC and MEFs. Positions of peaks/enriched segments (grey) are shown under comp tracks.

(D) ChIP-seq tracks showing *Mus musculus* (MUS, red), *Mus castaneus* (CAS, red) and total allelic and non-allelically assigned (COMP, black) ATRX reads across the Xist locus in WT (top) and ATRX KD (bottom) MEFs. The ATRX-KD samples show significant depletion of signal along the Xist gene.

Figure 12A:
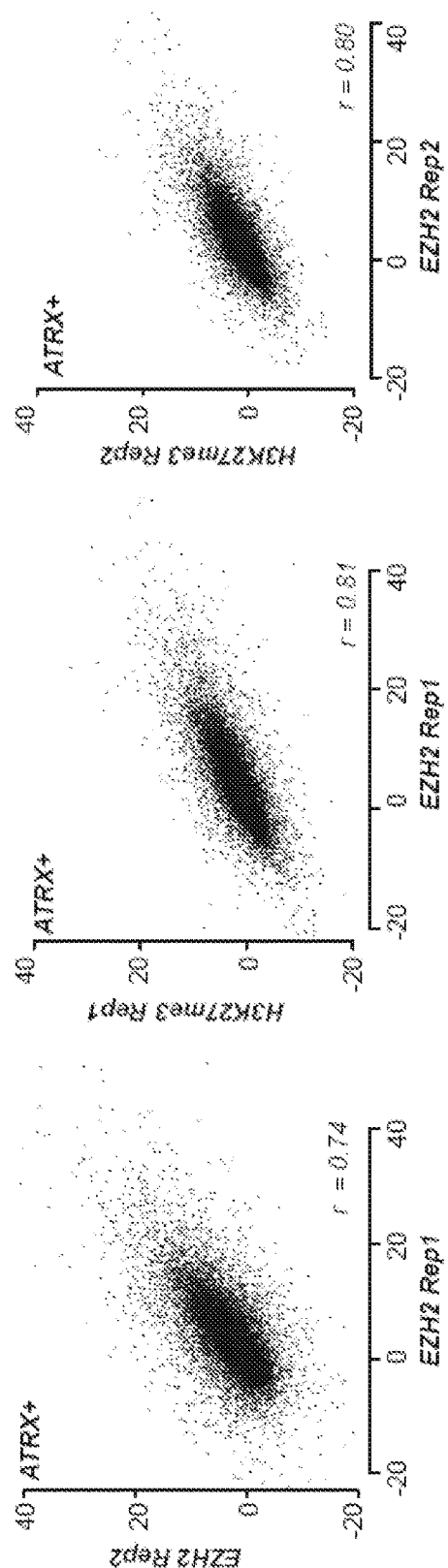
Figure 12B:
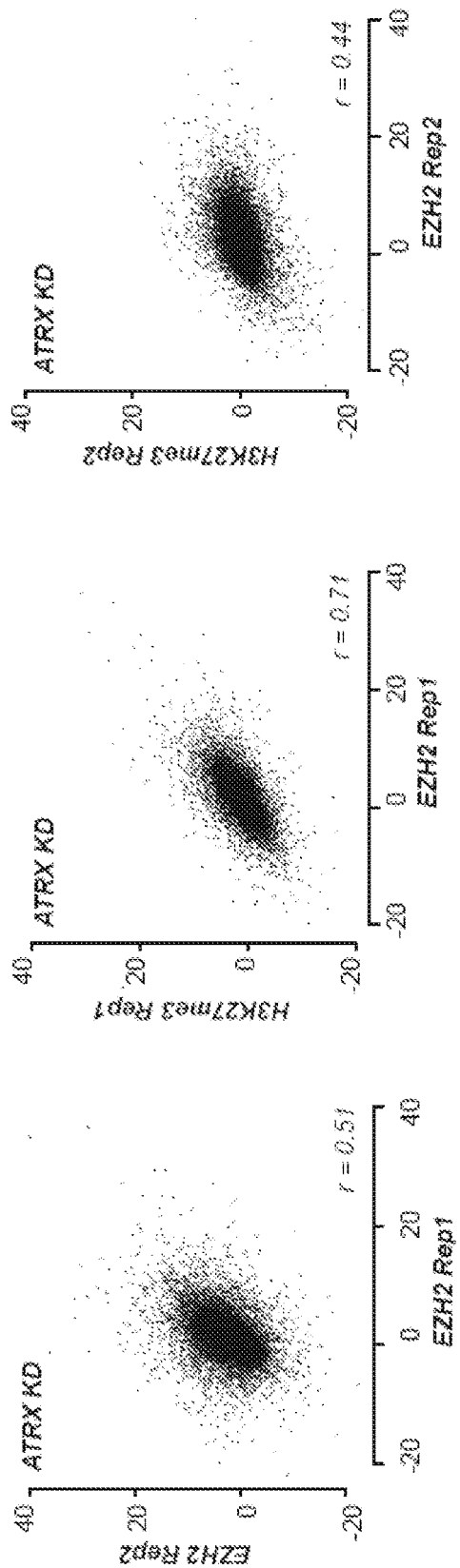

FIGS. 12A-B: Correlation between EZH2 and H3K27me3 coverages. FIGS. 12A-B relates to FIG. 6.

(A) In ATRX+ cells, correlation between two EZH2 ChIP-seq replicates and between EZH2 and H3K27me3 ChIP-seq profiles. Pearson's correlation coefficient (r) is shown.

(B) In ATRX-deficient cells, correlation between two EZH2 ChIP-seq replicates and between EZH2 and H3K27me3 ChIP-seq profiles. Pearson's correlation coefficient (r) is shown.

FIGS. 13A-D: EZH2 and H3K27me3 distributions in ChIP-seq replicate experiments and their effect on genic loci upon ATRX KD. FIGS. 13A-D relate to FIG. 7.

(A,B) ChIP-seq tracks of the Hoxd cluster (Replicate 2) or Hoxc cluster (replicates 1 and 2) showing EZH2 and H3K27me3 patterns in ATRX+ and ATRX-KD MEFs. Statistically significant enriched segments are shown below each track as black bars. Replicates are labeled Rep1 and Rep2. H3K4me3 (pink) and RNA-seq (blue) tracks were previously published (Yang et al., 2010; Yildirim et al., 2012).

(C) qRT-PCR analysis of expression levels before and after ATRX KD. Expression levels were consistently higher upon ATRX knockdown, though the differences were modest (~2-fold) and bordered statistical significance for Hox genes, with P-values ranging from 0.01-0.1, possibly because Hox genes are tissue-specific and are repressed by multiple mechanisms (i.e., ATRX and PRC2 are not the only regulator). Averages and S.E. of 3 independent experiments with Student t-test P values are shown.

(D) EZH2 and K27me3 TSS coverage tables for individual genes in ChIP-seq Rep2.

Figure 14:
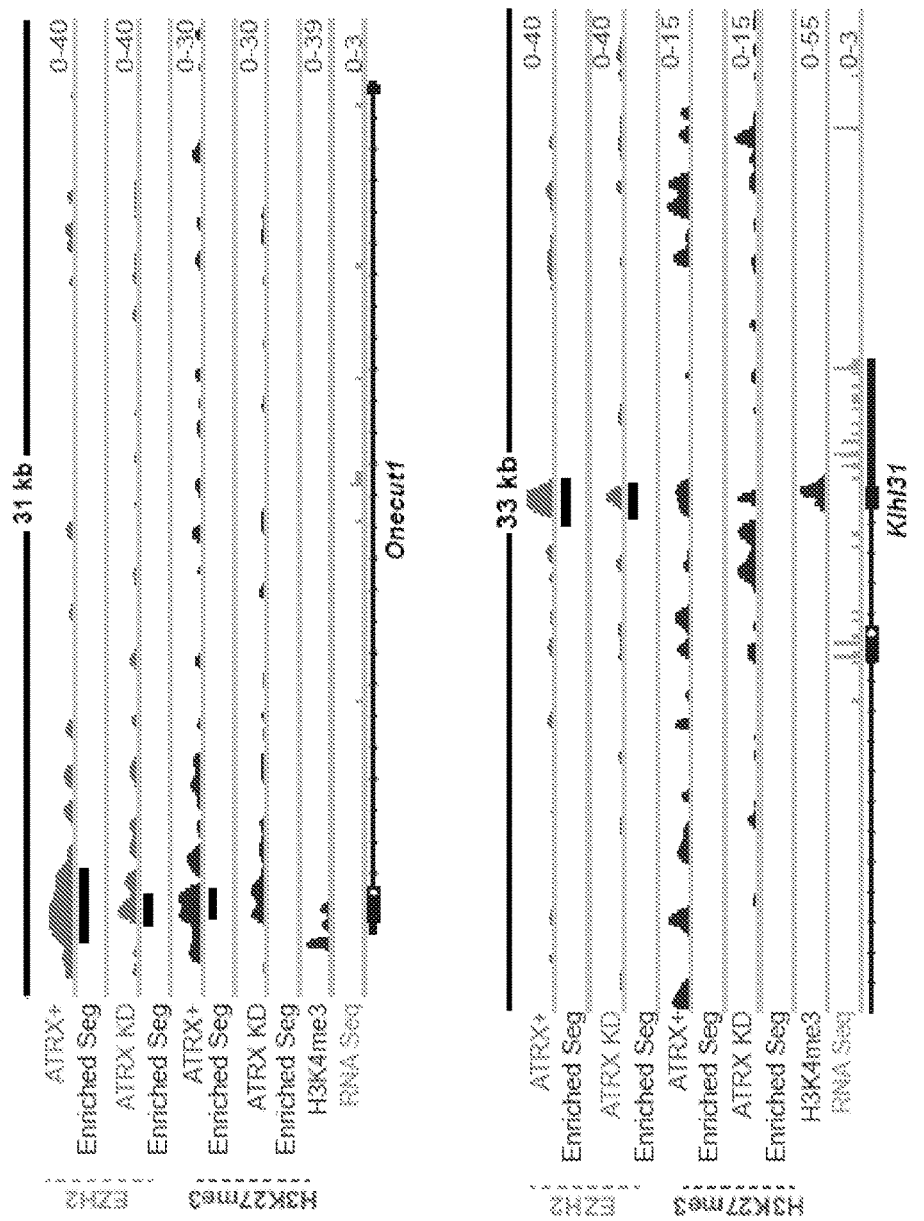

FIG. 14: Behavior of Polycomb target genes without ATRX coverage (Q4 quartile). FIG. 14 relates to FIGS. 6 and 7.

ChIP-seq track of two Polycomb target genes, Onecut1 and Klh131, without ATRX coverage (Q4 quartile). ATRX-deficiency minimally affected EZH2 localization. Statistically significant enriched segments are shown below each track as black bars. H3K4me3 (pink) and RNA-seq (blue) tracks were previously published (Yang et al., 2010; Yildirim et al., 2012).

Table 1: ATRX binding sites (ChIP-Seq peaks) from *Mus musculus* mouse embryonic fibroblasts. The columns correspond to c1: Chromosome number. c2: Read start position of ATRX binding site. c3: read end position of binding site. c4: coding strand of the nearest gene. c5: nearest gene name. 'int' signifies an intergenic binding site, or a binding site not located within any annotated gene. All coordinates in mm9

Table 2: Conserved human genomic regions that correspond to ATRX ChIP-Seq peaks from *Mus musculus* embryonic fibroblasts. Coordinates of ATRX Chip seq peaks that are aligned to the mouse mm9 genome are converted or 'lifted over' to the human Hg19 genome. The columns correspond to c1: Chromosome number. c2: Read start position of ATRX binding site. c3: read end position of binding site. c4: coding strand of the nearest gene. c5: nearest gene name. 'int' signifies an intergenic binding site, or a binding site not located within any annotated gene.

Table 4: PRC2 target genes in the Q1 quartile.

Table 5: List of 100 genes with highest ATRX coverage in MEFs, with coverage values shown.

Table 6: Primer sequences and Antibodies used in Examples 1-6.

DETAILED DESCRIPTION

Polycomb repressive complex 2 (PRC2) (Dupont and Gribnau, 2013; Lee, 2012; Lee and Bartolomei, 2013; Starmer and Magnuson, 2009; Wutz, 2011) is a histone methyltransferase complex that trimethylates histone H3 at lysine 27 (H3K27me3) and establishes repressive chromatin (Muller and Verrijzer, 2009; Simon and Kingston, 2013). Because PRC2 controls both normal development and the pathogenesis of disease, PRC2 has become a high-priority drug target (Helie and Dhanak, 2013). Apart from the Xi, PRC2 binds thousands of specific sites in the mammalian genome. Still not fully understood is how PRC2 is targeted when the core subunits are not sequence-specific DNA binding proteins. PRC2 preferentially occupies CpG-rich regions and is aided in recruitment by substoichiometric association with the Jumonji protein, JARID2, and the Zinc-finger protein, AEPB2 (Cifuentes-Rojas et al., 2014; da Rocha et al., 2014; Kaneko et al., 2014; Simon and Kingston, 2013). However, other specificity determinants must exist in vivo, given that JARID2 and AEPB2 are nonspecific DNA-binding proteins and cannot by themselves impart specificity to PRC2 localization.

The example of RepA/Xist RNA demonstrates that cis-regulatory RNAs can serve as locus-specific recruiting factors (Zhao et al., 2008). Because such transcripts are unique in the genome, their cis-action enables targeting of chromatin complexes to a singular location (Lee, 2012). During XCI, PRC2 is first targeted to the Xic by RepA via the Repeat A motif Xist RNA then co-transcriptionally binds PRC2 via Repeat A and loads in cis onto a nucleation center before spreading outwardly to envelop the Xi (Jeon and Lee, 2011). PRC2 is now known to have a large RNA interactome, with membership exceeding 9,000 transcripts (Kaneko et al., 2013; Kanhere et al., 2010; Khalil et al., 2009; Zhao et al., 2010). In vitro, PRC2 can bind RNA with a range of affinities (Cifuentes-Rojas et al., 2014; Davidovich et al., 2013). The large RNA interactome raises the question of how PRC2 discriminates between RNA species in the physiological context. Here, we investigate this question by carrying out an unbiased screen for novel specificity determinants. We identify the chromatin remodeler, ATRX.

Figure 5A:
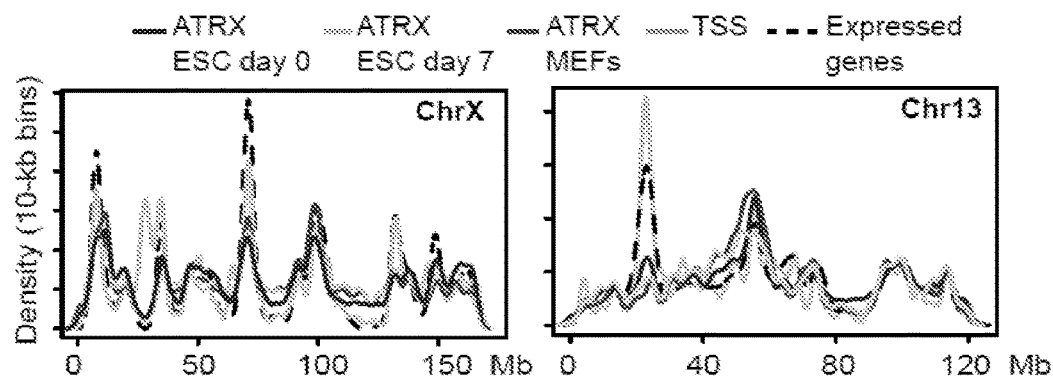
Figure 5B:
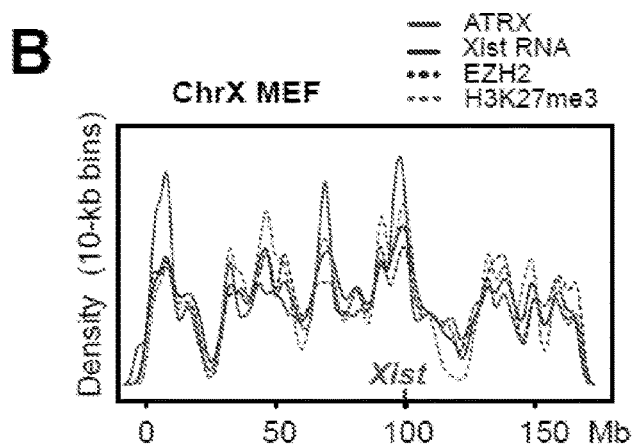
Figure 5C:
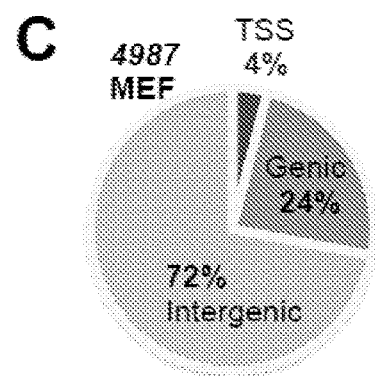
Figure 5D:
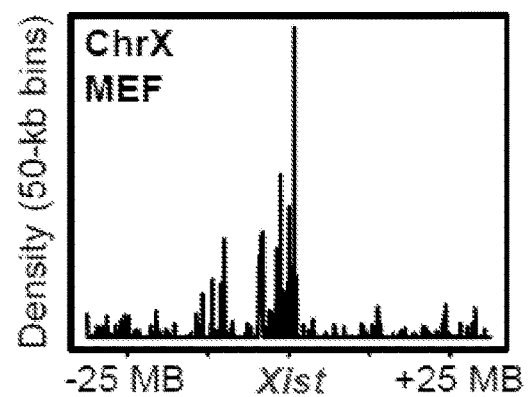
Figure 5E:
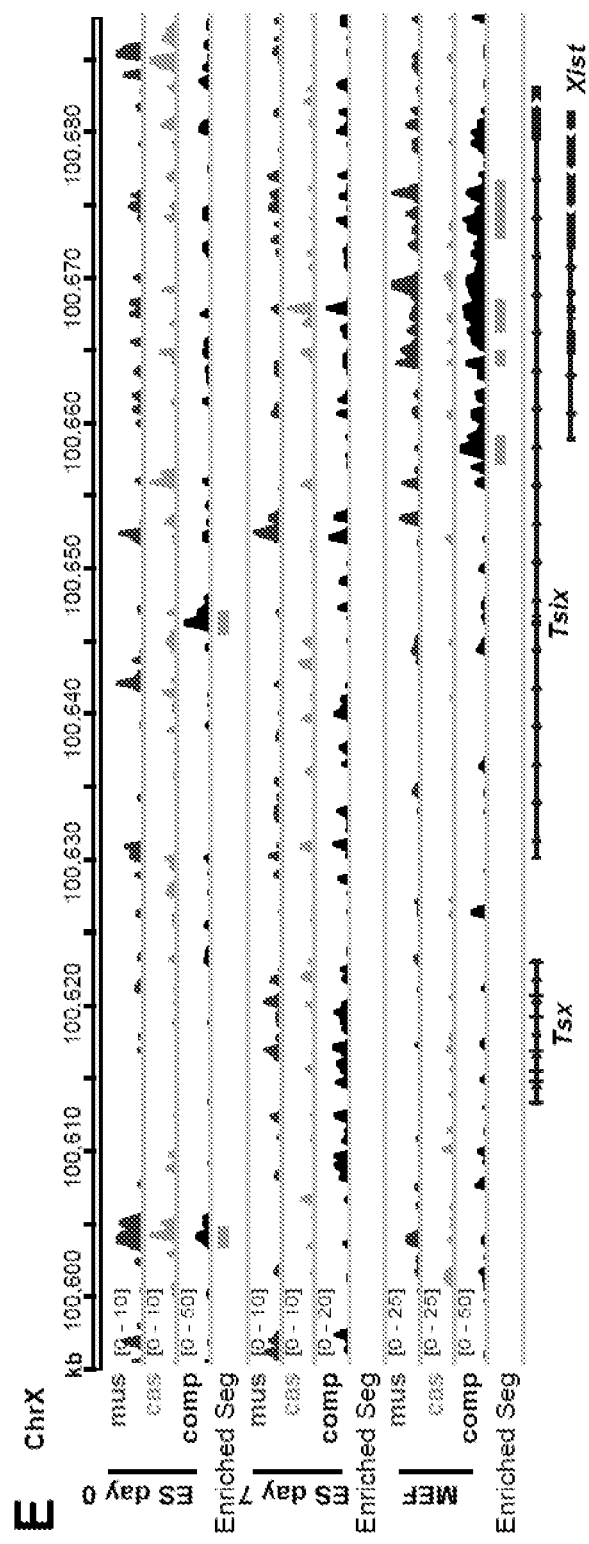
Figure 5F:
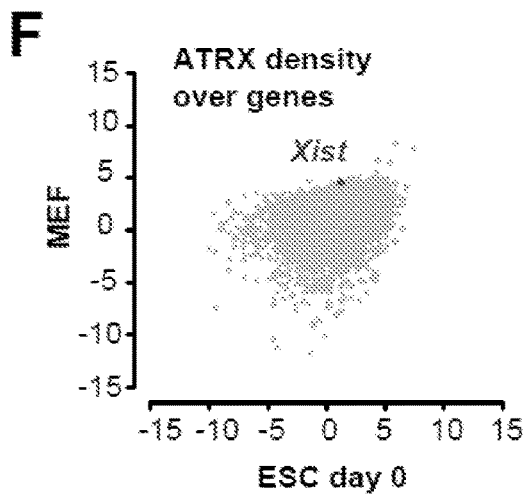
Figure 5G:
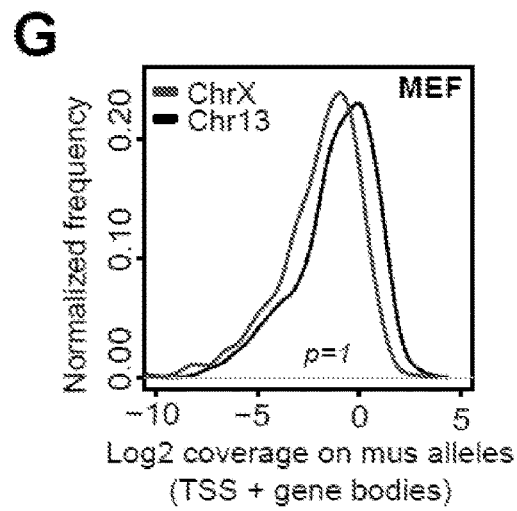
Figure 5H:
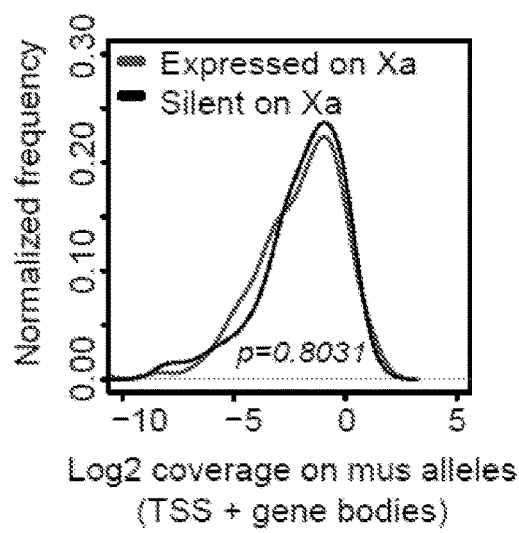
Figure 5I:
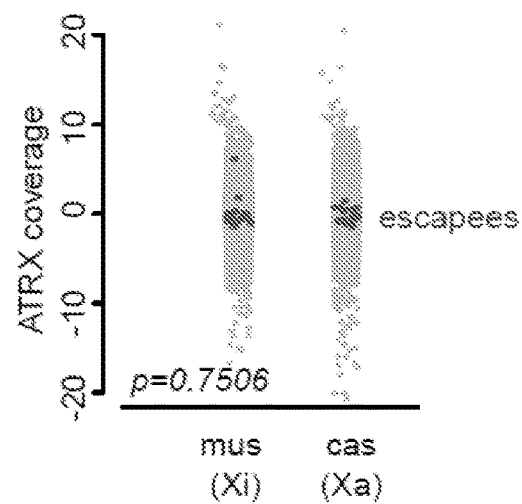

Although in vitro analysis shows that PRC2 is intrinsically capable of distinguishing between cognate and nonspecific transcripts (Cifuentes-Rojas et al., 2014), the thousands of possible RNA partners in vivo (Zhao et al., 2010) argue that additional specificity determinants must exist in the physiological context in order for PRC2 to be targeted in a locus-specific manner. Our proteomics screen has identified ATRX as an essential discrimination factor for PRC2 localization and function on a global scale. During XCI, ATRX interacts with RepA/Xist RNA and promotes loading of PRC2 (FIG. 5L). ATRX is an avid but also specific RNA-binding protein, with an impressive $K_d$ of ~5 nM for Repeat A RNA. ATRX is also an avid DNA-binding protein (Kd ~15 nM). ATRX's interaction with Repeat A DNA leaves it poised, enabling ATRX to bind RepA/Xist RNAs in a co-transcriptional manner. Augmentation of ATRX's effect on Repeat A-PRC2 interactions by ATP suggests a role, potentially as an RNA helicase, to remodel Repeat A RNA to a permissive structure. This activity may parallel that of the MLE helicase for the MSL-roX dosage compensation complex of the fruitfly (Ilik et al., 2013; Maenner et al., 2013). In the case of XCI, absence of ATRX action at both Repeat A RNA and DNA precludes PRC2 targeting and spread along the Xi in cis.

ATRX's specificity function extends beyond XCI. Without ATRX, PRC2 cannot discriminate true targets from nonspecific sequences. Loss of ATRX causes global shifts in PRC2 localization and function, with PRC2 redistributing en masse to ectopic sites in intergenic space and to non-canonical sites within coding genes. At ectopic loci, PRC2 seems to lack proper context and cofactors to carry out H3K27 methylation in a specific manner. While fewer enriched H3K27me3 peaks are observed, overall H3K27me3 levels are unchanged. Loss of ATRX-dependent PRC2 function results in upregulation of Polycomb target genes (FIG. 7, 13A-D). We do not know whether ATRX action at autosomal genes depends on noncoding transcripts, such as RepA/Xist in the case of XCI. Because ATRX can bind DNA directly (FIG. 3H), ATRX-dependent targeting of PRC2 at autosomal loci may be mediated by either RNA or DNA (FIG. 7E). The large RNA interactome of PRC2 may also play a role. Finally the presence of EZH2 peaks in Q3 and Q4 genes (FIG. 6A) suggests the presence of an ATRX-independent mechanism for PRC2 recruitment as well: For example, at the Q4 Polycomb targets, Onecut1 and Klh131, loss of ATRX did not affect EZH2 targeting (FIG. 14).

ATRX's role in PRC2 targeting and function may help elucidate the pathogenesis of the X-linked alpha-thalassemia mental retardation (ATR-X) syndrome (Gibbons et al., 2008), a disease associated with aberrant chromatin at telomeres and pericentric heterochromatin (Clynes et al., 2013). Mutations in ATRX and its interacting partner, DAXX, are also frequently mutated in tumors that rely on homologous recombination instead of telomerase activation to circumvent telomere shortening. Our present study suggests that, in addition to abnormalities in constitutive heterochromatin caused by abnormal H3K9 methylation, ATRX-associated diseases may also be ascribed to dysregulated PRC2 function in facultative heterochromatin. ATRX-mediated targeting of PRC2 thus provides a new framework for understanding Polycomb biology and human disease.

Methods of Producing ATRX-Binding Nuclear RNAs

Described herein are methods for producing libraries of nRNAs, e.g., nuclear lncRNAs and coding mRNAs, that bind to ATRX. In some embodiments, the methods include the of RIP-SEQ, e.g., as shown in FIG. 1A of WO2012/065143, with ATRX substituted for a-EZH2; one of skill in the art will appreciate that other techniques can be substituted for those shown, including the use of PAR-CLIP or HITS-CLIP, e.g., as described in Konig et al., Nature Reviews Genetics 13:77-83 (2012).

In some embodiments, the methods include providing a sample comprising nuclear ribonucleic acids (nRNAs) bound to ATRX; and contacting the sample with an agent, e.g., an antibody, that binds specifically to ATRX, under conditions and for a time sufficient to form complexes between the agent and the protein; isolating the complexes; synthesizing DNA complementary to the nRNAs to provide an initial population of cDNAs; PCR-amplifying, if necessary, using strand-specific primers; purifying the initial population of cDNAs to obtain a purified population of cDNAs that are at least 20 nucleotides (nt) in length; high-throughput sequencing the purified population of cDNAs. Homopolymer reads are filtered, and reads matching the mitochondrial genome and ribosomal RNAs are excluded from all subsequent analyses. Reads that align to a reference genome with ≤1 mismatch are retained, excluding homopolymers, reads that align to the mitochondrial genome, and ribosomal RNAs. High probability ATRX-interacting transcripts are then called based on two criteria: (1) that the candidate transcript has a minimum read density in RPKM terms (number of reads per kilobase per million reads); (2) that the candidate transcript is enriched in the wildtype library versus a suitable control library (such as a protein-null library, a library made from an IgG pulldown done in parallel, or a minus-crosslink (-UV) control library done in parallel).

In general, to construct native RIP-seq libraries, cell nuclei are prepared, treated with DNAse, and incubated with antibodies directed against a chromatin-associated factor of interest, along with a control IgG reaction in parallel. RNA-protein complexes are then immunoprecipitated with agarose beads, magnetic beads, or any other platform in solution or on a solid matrix (e.g., columns, microfluidic devices). RNAs are extracted using standard techniques. To capture all RNAs (not just polyA RNAs) and to preserve strand information, asymmetric primers are used to generate cDNA from the RNA template, in which the first adaptor (adaptor 1) to make the first strand cDNA contains a random multimer sequence (such as random hexamers) at the 3' end. A reverse transcriptase is used to create the first strand. A distinct second adaptor (adaptor2) is used to create the second strand. One example is as follows: If Superscript II is used, it will add non-template CCC 3' overhangs, which can then be used to hybridize to a second adaptor containing GGG at the 3' end, which anneal to the non-template CCC overhangs. Other methods of creating second strands may be substituted. PCR using adaptor1- and adaptor2-specific primer pairs is then the performed to amplify the cDNAs and the products sequenced via standard methods of high throughput sequencing. Prior to sequencing, a size-selection step can be incorporated (if desired) in which RNAs or cDNAs of desired sizes are excised after separation by gel electrophoresis (e.g., on a Nu-Sieve agarose gel or in an acrylamide gel) or other methods of purification, such as in a microfluidic device or in standard biochemical columns.

To construct libraries from UV-crosslinked samples, a number of techniques are currently available, including CLIP, iCLIP, PAR-CLIP, and HITS-CLIP (e.g., as described in Konig et al., Nature Reviews Genetics 13:77-83 (2012)), with appropriate modifications made based on the epitope of interest. As one example of a crosslinking protocol, cells are trypsinized and resuspended in PBS. Cells for +UV experiments are crosslinked with 256 nm UV (or 365 nm for PAR-CLIP) in a 15-cm dish at 250 mJ/cm$^2$ using the Stratalinker 1800 (Stratagene). ±UV cell pellets are resuspended in 1-2 mL Buffer A (10 mM HEPES pH 7.9, 1.5 mM MgCl$_2$, 10 mM KCl, 0.5 mM PMSF) and incubated on ice for 30 min with frequent vortexing. Nuclei are pelleted at 2500×g for 15 min, washed in PBS, resuspended in 500 mL Buffer C (20 mM HEPES pH 7.5, 420 mM NaCl, 15% glycerol, 1.5 mM MgCl$_2$, 0.5 mM PMSF, protease and RNase inhibitors) and incubated at 4° C. for 30 min with rotation. Nuclear lysates are diluted with one volume of 20 mM HEPES pH 7.5 and treated with 40 U TURBO DNase at 37° C. for 30 min to liberate chromatin-associated CTCF-RNA complexes. After quenching the DNase with 10 mM EDTA, 5% is removed and saved for RNA-seq, while the remainder is added with sarkosyl to 0.5% and the RNA fragmented by sonication with Diagenode Bioruptor XL twice for 20 min each (with 30 s on, 30 s off cycles). Cell debris is pelleted at 16,000×g for 10 min, the lysate is diluted again with 1 volume of 20 mM HEPES and divided into three aliquots. 15 uL of Anti-FLAG M2 Magnetic Beads (Sigma-Aldrich A2220) is added to each aliquot and incubated at 4° C. overnight with rotation. Beads from all aliquots is recombined, washed 3× with high salt Wash Buffer I (20 mM HEPES pH 7.5, 250 mM NaCl, 0.1% SDS, 0.5% sodium deoxycholate, 0.5% Nonident-P40, protease and RNase inhibitors), once with 1× TURBO DNase buffer, then treated with 100 U/mL TURBO DNase at 37° C. for 30 min. Beads are further washed 2× with Wash Buffer I supplemented with 10 mM EDTA, then 2× with low salt Wash Buffer II (50 mM Tris-HCl pH 7.5, 1% NP40, 0.5% sodium deoxycholate, 50 mM NaCl, 10 mM EDTA), and 1× with PNK buffer (50 mM Tris-HCl pH 7.5, 10 mM $MgCl_2$, 0.5% NP40, 5 mM DTT). CLIP-tags on beads are radiolabelled with [$\gamma$-$^{32}$P]ATP using T4 polynucleotide kinase (New England Biolabs) for 20 min at 37° C., and washed 4× with PNK buffer. Beads are resuspended in SDS-PAGE loading buffer at heated for 5 min at 70° C., run on 8% Bis-Tris SDS-PAGE in MOPS buffer (50 mM MOPS, 50 mM Tris, 0.1% SDS, 1 mM EDTA) at 120 V, transferred to nitrocellulose membrane, and exposed to film for autoradiography or used for immunoblot with 1:3000 αFLAG antibodies (Sigma-Aldrich F1804).

Membrane fragments containing CLIP signal, as confirmed by immunoblot, and corresponding positions on control lanes are excised, and RNA is eluted by incubation in prewarmed proteinase K buffer (100 mM Tris-HCl pH 7.5, 50 mM NaCl, 10 mM EDTA, 0.5% SDS, 4 mg/mL proteinase K) for 20 min at 37° C., then incubation for an additional 20 min in proteinase K buffer supplemented with 7 M urea, followed by TRIzol extraction and ethanol precipitation. RNA size and quality are verified using RNA 6000 Pico chips on the Agilent Bioanalyzer. CLIP-seq library is then constructed from CLIP RNA using the NEBNext Small RNA Library Prep set (New England Biolabs E7330), size-selected and cleaned up of primer/adaptor-dimers using Agencourt AMPure XP beads (Beckman Coulter A63880), verified with DNA High Sensitivity chips on the Agilent Bioanalyzer, quantitated using KAPA Biosystems library quantification kit (KK4844), and sequenced with the Illumina HiSeq 2000 system with 50 cycles paired end reads.

ATRX-Binding nRNAs and nRNA Libraries

The present invention includes libraries of nRNAs produced by methods described herein. In some embodiments, the libraries are in solution, or are lyophilized. In some embodiments, the libraries are bound to a substrate, e.g., wherein each member of the library is bound to an individually addressable member, e.g., an individual area on an array (e.g., a microarray), or a bead.

nRNAs may be functionally conserved without being highly conserved at the level of overall nucleotide identity. For example, mouse Xist shows only 76% overall nucleotide identity with human XIST using sliding 21-bp windows, or an overall sequence identity of only 60%. However, within specific functional domains, such as Repeat A, the degree of conservation can be >70% between different mammalian species. The crucial motif in Repeat A is the secondary structures formed by the repeat. For ATRX-Xist interactions, the crucial motif appears to be Repeat A. Other nRNAs interacting with ATRX may therefore be similarly low in overall conservation but still have conservation in secondary structure within specific domains of the RNA, and thereby demonstrate functional conservation with respect to recruitment of ATRX.

Calculations of homology or sequence identity between sequences (the terms are used interchangeably herein) are performed as follows.

To determine the percent identity of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes is at least 80% of the length of the reference sequence, and in some embodiments is at least 90% or 100%. The nucleotides at corresponding amino acid positions or nucleotide positions are then compared. When a position in the first sequence is occupied by the same nucleotide as the corresponding position in the second sequence, then the molecules are identical at that position (as used herein nucleic acid "identity" is equivalent to nucleic acid "homology"). The percent identity between the two sequences is a function of the number of identical positions shared by the sequences, taking into account the number of gaps, and the length of each gap, which need to be introduced for optimal alignment of the two sequences.

For purposes of the present invention, the comparison of sequences and determination of percent identity between two sequences can be accomplished using a Blossum 62 scoring matrix with a gap penalty of 12, a gap extend penalty of 4, and a frameshift gap penalty of 5.

There are several potential uses for the nRNAs described herein in the ATRX transcriptome: The RNAs themselves, or antagomirs and small molecules designed against them, can be utilized to modulate expression (either up or down) of ATRX target genes. In addition, the nRNAs can be used in methods of detecting or identifying cancerous cells, as described herein.

Modulating ATRX Binding to Genomic DNA

As described herein, ATRX localizes to genomic DNA in a sequence-specific manner. To inhibit this localization, and thus disrupt the ATRX-dependent loading of PRC2 and increase expression of nearby genes, oligonucleotides are used that bind to genomic DNA at or near (e.g., within 100, 50, or 25) nucleotides of an ATRX localization site, identified as an ATRX ChIP-Seq peak in Tables 1 and 2. Table 1 lists genes corresponding to the ATRX ChIP-Seq peaks from *Mus musculus* mouse embryonic fibroblasts, and Table 2 provides the Human genomic regions determined by Lift-Over analysis to correspond to the ATRX ChIP-Seq peaks from *Mus musculus* mouse embryonic fibroblasts. Each table provides the SEQ ID NO: of the peak(s) (i.e., the ATRX localization site(s)) that correspond to each of the listed genes.

In some embodiments, the oligonucleotides are triplex-forming oligonucleotides (TFOs). TFOs are defined as triplex-forming oligonucleotides which bind as third strands to duplex DNA in a sequence specific manner. Triplex-forming oligonucleotides may be comprised of any possible combination of nucleotides and modified nucleotides. Modified nucleotides may contain chemical modifications of the heterocyclic base, sugar moiety or phosphate moiety. TFOs, and methods of making them, are known in the art; see, e.g., Frank-Kamenetskii and Mirkin, Annual Review of Biochemistry, 64:65-95 (1995); Vasquez and Glazer, Quarterly Reviews of Biophysics, 35(01):89-107 (2002); US PGPub Nos. 20070219122; US20110130557; and US20090216003.

In general, the TFO is a single-stranded nucleic acid molecule between 5 and 100 nucleotides in length, preferably between 7 and 40 nucleotides in length, e.g., 10 to 20 or 20 to 30 nucleotides in length. In some embodiments, the base composition is homopurine or homopyrimidine, polypurine or polypyrimidine. The oligonucleotides can be generated using known DNA synthesis procedures.

The nucleotide sequence of the oligonucleotides is selected based on a target sequence of an ATRX localization sequence as provided herein; in addition, the sequence can be determined based on physical constraints imposed by the need to achieve binding of the oligonucleotide within the major groove of the target region, and preferably have a low dissociation constant (Kd) for the oligonucleotide/target sequence. The oligonucleotides should have a base composition that is conducive to triple-helix formation and can be generated based on known structural motifs for third strand binding. The most stable complexes are formed on polypurine:polypyrimidine elements, which are relatively abundant in mammalian genomes. Triplex formation by TFOs can occur with the third strand oriented either parallel or anti-parallel to the purine strand of the duplex. In the anti-parallel, purine motif, the triplets are G.G:C and A.A:T, whereas in the parallel pyrimidine motif, the canonical triplets are C$^+$.G:C and T.A:T. The triplex structures are stabilized by two Hoogsteen hydrogen bonds between the bases in the TFO strand and the purine strand in the duplex. See U.S. Pat. No. 5,422,251 for additional information on base compositions for third strand binding oligonucleotides.

The TFOs can include one or more modifications, e.g., backbone modifications such as incorporation of the flexible basestacking monomers (Bulge insertions of (R)-1-O-[4-(1-pyrenylethynyl)phenylmethyl]glycerol into the middle of homopyrimidine oligodeoxynucleotides (twisted intercalating nucleic acids, TINA)) as described in US PGPub No 20090216003; intercalating nucleic acid monomers as described in WO2006125447A2; intercalator (R)-1-O-[4-(1-pyrenylethynyl)benzyl]-glycerol (see, e.g., Filichev et al., J. Am. Chem. Soc. 127:14849 (2005); Filichev et al., Eur. J. Org. Chem. 17:3960-3968 (2006); Globisch et al., Helv. Chim. Acta, 91:805 (2008)); 2-phenyl or 2-naphth-1-yl-phenanthroimidazole intercalators as described in US20110130557.

In addition or in alternative, modifications can be made to the nucleobases (see, e.g., Roig and Asseline, J. Am. Chem. Soc. 2003, 125, 4416; Hildbrand et al., J. Am. Chem. Soc. 1997, 119, 5499; and Xodo et al., Nucleic Acids Res. 1991, 19, 5625); to the sugar (sugar moiety modifications include, but are not limited to, 2'-O-aminoetoxy, 2'-O-amonioethyl (2'-OAE), 2'-O-methoxy, 2'-O-methyl, 2-guanidoethyl (2'-OGE), 2'-O,4'-C-methylene (LNA), 2'-O-(methoxyethyl) (2'-OME) and 2'-O—(N-(methyl)acetamido) (2'-OMA). 2'-O-aminoethyl sugar moiety substitutions are especially preferred; see, e.g., Carlomagno et al., J. Am. Chem. Soc. 2001, 123, 7364; Cuenoud et al., Angew. Chem. Int. Ed. 1998, 37, 1288; Wengel, Acc. Chem. Res. 1999, 32, 301; Obika et al., Tetrahedron Let. 2000, 41, 8923; Sun et al., Biochemistry, 2004, 43, 4160; Basye et al., Nucleic Acids Res. 2001, 29, 4873); and/or to the phosphate backbone (see, e.g., Michel, et al., Chem Bio Chem. 2005, 6, 1254; Ehrenmann et al., Nucl. Nucl. Nucleic Acids. 2001, 20, 797; Michel et al., J. Biomol. Struct. Dyn. 2003, 21, 435; Tereshko et al., J. Am. Chem. Soc. 1998, 120, 269; Escude et al., Proc. Natl. Acad. Sci. U.S.A. 1996, 93, 4365; Gryaznov et al., Proc. Natl. Acad. Sci. U.S.A. 1995, 92, 5798; Gryaznov and Chen, J. Am. Chem. Soc. 1994, 116, 3143; and Chur et al., Nucleic Acids Res. 1993, 21, 5179).

Chemical modifications of heterocyclic bases or heterocyclic base analogs can be used to increase the binding affinity of a nucleotide or its stability in a triplex. Chemically-modified heterocyclic bases include, but are not limited to, inosine, 5-(1-propynyl) uracil (pU), 5-(1-propynyl) cytosine (pC), 5-methylcytosine, 8-oxo-adenine, pseudocytosine, pseudoisocytosine, 5 and 2-amino-5-(2'-deoxy-beta-D-ribo-furanosyl)pyridine (2-aminopyridine), and various pyrrolo- and pyrazolopyrimidine derivatives. Substitution of 5-methylcytosine or pseudoisocytosine for cytosine in triplex-forming molecules such as TFOs and PNAs helps to stabilize triplex formation at neutral and/or physiological pH, especially in triplex-forming molecules with isolated cytosines. See, e.g., US20110268810.

For example, each nucleotide monomer can be selected from the group consisting of DNA, RNA, HNA, MNA, ANA, LNA, CAN, INA, CeNA, TNA, (2'-NH)-TNA, (3'-NH)-TNA, alpha-L-Ribo-LNA, alpha-L-Xylo-LNA, beta-D-Ribo-LNA, beta-D-Xylo-LNA, [3.2.1]-LNA, Bicyclo-DNA, 6-Amino-Bicyclo-DNA, 5-epi-Bicyclo-DNA, alpha-Bicyclo-DNA, Tricyclo-DNA, Bicyclo[4.3.0]-DNA, Bicyclo[3.2.1]-DNA, Bicyclo[4.3.0]amide-DNA, beta-D-Ribopyranosyl-NA, alpha-L-Lyxopyranosyl-NA, 2'-R-RNA, 2'-OR-RNA, 2'-AE-RNA, alpha-L-RNA, and beta-D-RNA, and combinations and modifications thereof; in some embodiments, some or all of the TFO is a peptide nucleic acid (PNA), in which the phosphate backbone of oligonucleotides is replaced in part or in its entirety by repeating N-(2-aminoethyl)-glycine units, and the phosphodiester bonds are replaced by peptide bonds. In addition, the TFO can include one or more of the modifications described in WO2012/065143.

In some embodiments, the TFO includes a "tail" or "tail clamp" added to the Watson-Crick binding portion that binds to target strand outside the triple helix and reduces the requirement for a polypurine:polypyrimidine stretch, increasing the number of potential target sites. Tail clamps added to PNAs (referred to as tcPNAs) have been described by Kaihatsu, et al., Biochemistry, 42(47):13996-4003 (2003); Bentin, et al., Biochemistry, 42(47):13987-95 (2003) Rogers, et al., Proc. Natl. Acad. Sci. USA., 99(26): 16695-700 (2002)), and are known to bind to DNA more efficiently due to low dissociation constants. The addition of the tail also increases binding specificity and binding stringency of the triplex-forming molecules to the target duplex.

In some embodiments, the TFOs are modified with, or administered with, amidoanthraquinones as described in Fox et al., Proc. Natl. Acad. Sci. USA 92:7887-7891 (1995).

Methods of Treatment

Oligos, e.g., TFOs that target the sequences of ATRX binding sites associated with disease-related genes can also be used to treat subjects. For example, the DMD gene is a causal factor in Duchenne muscular dystrophy; administration of an oligo, e.g., a TFO that targets an ATRX localization site associated with the DMD gene can be used to treat subjects who have Duchenne muscular dystrophy. In addition, administration of an oligo, e.g., a TFO, that targets an ATRX localization site associated with the XIST gene can be used to treat subjects who have Rett Syndrome. One of skill in the art would be able to identify other disease-related genes from among those listed in Tables 1, 2, 3, 4, or 5. In particular, an oligo, e.g., a TFO, that targets an ATRX localization site associated with a human disease-related gene as set forth in Table 2 or 3 can be used to treat a human having the disease to which the gene is related; in some embodiments, the oligos, e.g., TFOs, are used to reactivate a normal gene in a heterozygous individual, i.e., an individual with one normal copy and one affected copy of the gene. The oligo, e.g., TFO, can be administered in a pharmaceutical composition or formulation as known in the art, e.g., as described herein. Subjects having a genetic disease, e.g., a disease related to a gene listed in Table 2 or 3, can be identified using methods known in the art. Table 3 includes additional examples of diseases and the ATRX localization sites associated with the disease-related gene from Table 2. Disease identifications follow OMIM nomenclature.

TABLE 3

| Disease | Gene | ATRX localization site SEQ ID NOs. |
| --- | --- | --- |
| Duchenne Muscular Dystrophy | DMD | 7867-7900 |
| Rett Syndrome | XIST | 7957, 7959, 7961, or 7962 |
| Dihyropyrimidine dehydrogenase deficiency | DPYD | 5310-5314 |
| Phosphoglycerate dehydrogenase deficiency | PHGDH | 5343 |
| Complement factor H deficiency | CFH | 5395-5400 |
| Schizophrenia/Schizoaffective Disorder | TSNAX-DISC1 | 5457-5460 |
| Myoglobinuria | LPIN1 | 5513-5515 |
| Schizophrenia 17 | NRXN1 | 5531-5534 |
| Chromosome 2p16.1-P15 Deletion syndrome | VRK2 | 5546-5547 |
| Amyotrophic lateral sclerosis 19 | ERBB4 | 5721-5722 |
| Three M syndrome 2 | OBSL1 | 5739-5740 |

Pharmaceutical Compositions

The methods described herein can include the administration of pharmaceutical compositions and formulations comprising oligonucleotides (e.g., TFOs) designed to target an ATRX localization site sequence.

In some embodiments, the compositions are formulated with a pharmaceutically acceptable carrier. The pharmaceutical compositions and formulations can be administered parenterally, topically, orally or by local administration, such as by aerosol or transdermally. The pharmaceutical compositions can be formulated in any way and can be administered in a variety of unit dosage forms depending upon the condition or disease and the degree of illness, the general medical condition of each patient, the resulting preferred method of administration and the like. Details on techniques for formulation and administration of pharmaceuticals are well described in the scientific and patent literature, see, e.g., Remington: *The Science and Practice of Pharmacy*, 21st ed., 2005.

The nucleic acids can be administered alone or as a component of a pharmaceutical formulation (composition). The compounds may be formulated for administration, in any convenient way for use in human or veterinary medicine. Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Formulations of the compositions of the invention include those suitable for intradermal, inhalation, oral/nasal, topical, parenteral, rectal, and/or intravaginal administration. The formulations may conveniently be presented in unit dosage form and may be prepared by any methods well known in the art of pharmacy. The amount of active ingredient (e.g., nucleic acid sequences of this invention) which can be combined with a carrier material to produce a single dosage form will vary depending upon the host being treated, the particular mode of administration, e.g., intradermal or inhalation. The amount of active ingredient which can be combined with a carrier material to produce a single dosage form will generally be that amount of the compound which produces a therapeutic effect, e.g., an antigen specific T cell or humoral response.

Pharmaceutical formulations of this invention can be prepared according to any method known to the art for the manufacture of pharmaceuticals. Such drugs can contain sweetening agents, flavoring agents, coloring agents and preserving agents. A formulation can be admixtured with nontoxic pharmaceutically acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

Pharmaceutical formulations for oral administration can be formulated using pharmaceutically acceptable carriers well known in the art in appropriate and suitable dosages. Such carriers enable the pharmaceuticals to be formulated in unit dosage forms as tablets, pills, powder, dragees, capsules, liquids, lozenges, gels, syrups, slurries, suspensions, etc., suitable for ingestion by the patient. Pharmaceutical preparations for oral use can be formulated as a solid excipient, optionally grinding a resulting mixture, and processing the mixture of granules, after adding suitable additional compounds, if desired, to obtain tablets or dragee cores. Suitable solid excipients are carbohydrate or protein fillers include, e.g., sugars, including lactose, sucrose, mannitol, or sorbitol; starch from corn, wheat, rice, potato, or other plants; cellulose such as methyl cellulose, hydroxypropylmethyl-cellulose, or sodium carboxy-methylcellulose; and gums including arabic and tragacanth; and proteins, e.g., gelatin and collagen. Disintegrating or solubilizing agents may be added, such as the cross-linked polyvinyl pyrrolidone, agar, alginic acid, or a salt thereof, such as sodium alginate. Push-fit capsules can contain active agents mixed with a filler or binders such as lactose or starches, lubricants such as talc or magnesium stearate, and, optionally, stabilizers. In soft capsules, the active agents can be dissolved or suspended in suitable liquids, such as fatty oils, liquid paraffin, or liquid polyethylene glycol with or without stabilizers.

Aqueous suspensions can contain an active agent (e.g., nucleic acid sequences of the invention) in admixture with excipients suitable for the manufacture of aqueous suspensions, e.g., for aqueous intradermal injections. Such excipients include a suspending agent, such as sodium carboxymethylcellulose, methylcellulose, hydroxypropylmethylcellulose, sodium alginate, polyvinylpyrrolidone, gum tragacanth and gum acacia, and dispersing or wetting agents such as a naturally occurring phosphatide (e.g., lecithin), a condensation product of an alkylene oxide with a fatty acid (e.g., polyoxyethylene stearate), a condensation product of ethylene oxide with a long chain aliphatic alcohol (e.g., heptadecaethylene oxycetanol), a condensation product of ethylene oxide with a partial ester derived from a fatty acid and a hexitol (e.g., polyoxyethylene sorbitol mono-oleate), or a condensation product of ethylene oxide with a partial ester derived from fatty acid and a hexitol anhydride (e.g., polyoxyethylene sorbitan mono-oleate). The aqueous suspension can also contain one or more preservatives such as ethyl or n-propyl p-hydroxybenzoate, one or more coloring agents, one or more flavoring agents and one or more sweetening agents, such as sucrose, aspartame or saccharin. Formulations can be adjusted for osmolarity.

In some embodiments, oil-based pharmaceuticals are used for administration of nucleic acid sequences of the invention. Oil-based suspensions can be formulated by suspending an active agent in a vegetable oil, such as arachis oil, olive oil, sesame oil or coconut oil, or in a mineral oil such as liquid paraffin; or a mixture of these. See e.g., U.S. Pat. No. 5,716,928 describing using essential oils or essential oil components for increasing bioavailability and reducing inter- and intra-individual variability of orally administered hydrophobic pharmaceutical compounds (see also U.S. Pat. No. 5,858,401). The oil suspensions can contain a thickening agent, such as beeswax, hard paraffin or cetyl alcohol. Sweetening agents can be added to provide a palatable oral preparation, such as glycerol, sorbitol or sucrose. These formulations can be preserved by the addition of an antioxidant such as ascorbic acid. As an example of an injectable oil vehicle, see Minto (1997) J. Pharmacol. Exp. Ther. 281:93-102.

Pharmaceutical formulations can also be in the form of oil-in-water emulsions. The oily phase can be a vegetable oil or a mineral oil, described above, or a mixture of these. Suitable emulsifying agents include naturally-occurring gums, such as gum acacia and gum tragacanth, naturally occurring phosphatides, such as soybean lecithin, esters or partial esters derived from fatty acids and hexitol anhydrides, such as sorbitan mono-oleate, and condensation products of these partial esters with ethylene oxide, such as polyoxyethylene sorbitan mono-oleate. The emulsion can also contain sweetening agents and flavoring agents, as in the formulation of syrups and elixirs. Such formulations can also contain a demulcent, a preservative, or a coloring agent. In alternative embodiments, these injectable oil-in-water emulsions of the invention comprise a paraffin oil, a sorbitan monooleate, an ethoxylated sorbitan monooleate and/or an ethoxylated sorbitan trioleate.

The pharmaceutical compounds can also be administered by in intranasal, intraocular and intravaginal routes including suppositories, insufflation, powders and aerosol formulations (for examples of steroid inhalants, see e.g., Rohatagi (1995) J. Clin. Pharmacol. 35:1187-1193; Tjwa (1995) Ann. Allergy Asthma Immunol. 75:107-111). Suppositories formulations can be prepared by mixing the drug with a suitable non-irritating excipient which is solid at ordinary temperatures but liquid at body temperatures and will therefore melt in the body to release the drug. Such materials are cocoa butter and polyethylene glycols.

In some embodiments, the pharmaceutical compounds can be delivered transdermally, by a topical route, formulated as applicator sticks, solutions, suspensions, emulsions, gels, creams, ointments, pastes, jellies, paints, powders, and aerosols.

In some embodiments, the pharmaceutical compounds can also be delivered as microspheres for slow release in the body. For example, microspheres can be administered via intradermal injection of drug which slowly release subcutaneously; see Rao (1995) J. Biomater Sci. Polym. Ed. 7:623-645; as biodegradable and injectable gel formulations, see, e.g., Gao (1995) Pharm. Res. 12:857-863 (1995); or, as microspheres for oral administration, see, e.g., Eyles (1997) J. Pharm. Pharmacol. 49:669-674.

In some embodiments, the pharmaceutical compounds can be parenterally administered, such as by intravenous (IV) administration or administration into a body cavity or lumen of an organ. These formulations can comprise a solution of active agent dissolved in a pharmaceutically acceptable carrier. Acceptable vehicles and solvents that can be employed are water and Ringer's solution, an isotonic sodium chloride. In addition, sterile fixed oils can be employed as a solvent or suspending medium. For this purpose any bland fixed oil can be employed including synthetic mono- or diglycerides. In addition, fatty acids such as oleic acid can likewise be used in the preparation of injectables. These solutions are sterile and generally free of undesirable matter. These formulations may be sterilized by conventional, well known sterilization techniques. The formulations may contain pharmaceutically acceptable auxiliary substances as required to approximate physiological conditions such as pH adjusting and buffering agents, toxicity adjusting agents, e.g., sodium acetate, sodium chloride, potassium chloride, calcium chloride, sodium lactate and the like. The concentration of active agent in these formulations can vary widely, and will be selected primarily based on fluid volumes, viscosities, body weight, and the like, in accordance with the particular mode of administration selected and the patient's needs. For IV administration, the formulation can be a sterile injectable preparation, such as a sterile injectable aqueous or oleaginous suspension. This suspension can be formulated using those suitable dispersing or wetting agents and suspending agents. The sterile injectable preparation can also be a suspension in a nontoxic parenterally-acceptable diluent or solvent, such as a solution of 1,3-butanediol. The administration can be by bolus or continuous infusion (e.g., substantially uninterrupted introduction into a blood vessel for a specified period of time).

In some embodiments, the pharmaceutical compounds and formulations can be lyophilized. Stable lyophilized formulations comprising a nucleic acid can be made by lyophilizing a solution comprising a pharmaceutical of the invention and a bulking agent, e.g., mannitol, trehalose, raffinose, and sucrose or mixtures thereof. A process for preparing a stable lyophilized formulation can include lyophilizing a solution about 2.5 mg/mL protein, about 15 mg/mL sucrose, about 19 mg/mL NaCl, and a sodium citrate buffer having a pH greater than 5.5 but less than 6.5. See, e.g., U.S. 20040028670.

The compositions and formulations can be delivered by the use of liposomes. By using liposomes, particularly where the liposome surface carries ligands specific for target cells, or are otherwise preferentially directed to a specific organ, one can focus the delivery of the active agent into target cells in vivo. See, e.g., U.S. Pat. Nos. 6,063,400; 6,007,839; Al-Muhammed (1996) J. Microencapsul. 13:293-306; Chonn (1995) Curr. Opin. Biotechnol. 6:698-708; Ostro (1989) Am. J. Hosp. Pharm. 46:1576-1587. As used in the present invention, the term "liposome" means a vesicle composed of amphiphilic lipids arranged in a bilayer or bilayers. Liposomes are unilamellar or multilamellar vesicles that have a membrane formed from a lipophilic material and an aqueous interior that contains the composition to be delivered. Cationic liposomes are positively charged liposomes that are believed to interact with negatively charged DNA molecules to form a stable complex. Liposomes that are pH-sensitive or negatively-charged are believed to entrap DNA rather than complex with it. Both cationic and noncationic liposomes have been used to deliver DNA to cells.

Liposomes can also include "sterically stabilized" liposomes, i.e., liposomes comprising one or more specialized lipids. When incorporated into liposomes, these specialized lipids result in liposomes with enhanced circulation lifetimes relative to liposomes lacking such specialized lipids. Examples of sterically stabilized liposomes are those in which part of the vesicle-forming lipid portion of the liposome comprises one or more glycolipids or is derivatized with one or more hydrophilic polymers, such as a polyethylene glycol (PEG) moiety. Liposomes and their uses are further described in U.S. Pat. No. 6,287,860.

The formulations of the invention can be administered for prophylactic and/or therapeutic treatments. In some embodiments, for therapeutic applications, compositions are administered to a subject who is need of reduced triglyceride levels, or who is at risk of or has a disorder described herein, in an amount sufficient to cure, alleviate or partially arrest the clinical manifestations of the disorder or its complications; this can be called a therapeutically effective amount. For example, in some embodiments, pharmaceutical compositions of the invention are administered in an amount sufficient to decrease serum levels of triglycerides in the subject.

The amount of pharmaceutical composition adequate to accomplish this is a therapeutically effective dose. The dosage schedule and amounts effective for this use, i.e., the dosing regimen, will depend upon a variety of factors, including the stage of the disease or condition, the severity of the disease or condition, the general state of the patient's health, the patient's physical status, age and the like, and can be determined using methods known in the art. In calculating the dosage regimen for a patient, the mode of administration also is taken into consideration.

The dosage regimen also takes into consideration pharmacokinetics parameters well known in the art, i.e., the active agents' rate of absorption, bioavailability, metabolism, clearance, and the like (see, e.g., Hidalgo-Aragones (1996) J. Steroid Biochem. Mol. Biol. 58:611-617; Groning (1996) Pharmazie 51:337-341; Fotherby (1996) Contraception 54:59-69; Johnson (1995) J. Pharm. Sci. 84:1144-1146; Rohatagi (1995) Pharmazie 50:610-613; Brophy (1983) Eur. J. Clin. Pharmacol. 24:103-108; Remington: The Science and Practice of Pharmacy, 21st ed., 2005). The state of the art allows the clinician to determine the dosage regimen for each individual patient, active agent and disease or condition treated. Guidelines provided for similar compositions used as pharmaceuticals can be used as guidance to determine the dosage regiment, i.e., dose schedule and dosage levels, administered practicing the methods of the invention are correct and appropriate.

Single or multiple administrations of formulations can be given depending on for example: the dosage and frequency as required and tolerated by the patient, the degree and amount of therapeutic effect generated after each administration (e.g., effect on tumor size or growth), and the like. The formulations should provide a sufficient quantity of active agent to effectively treat, prevent or ameliorate conditions, diseases or symptoms.

In alternative embodiments, pharmaceutical formulations for oral administration are in a daily amount of between about 1 to 100 or more mg per kilogram of body weight per day. Lower dosages can be used, in contrast to administration orally, into the blood stream, into a body cavity or into a lumen of an organ. Substantially higher dosages can be used in topical or oral administration or administering by powders, spray or inhalation. Actual methods for preparing parenterally or non-parenterally administrable formulations will be known or apparent to those skilled in the art and are described in more detail in such publications as Remington: The Science and Practice of Pharmacy, 21st ed., 2005.

Various studies have reported successful mammalian dosing using complementary nucleic acid sequences. For example, Esau C., et al., (2006) Cell Metabolism, 3(2):87-98 reported dosing of normal mice with intraperitoneal doses of miR-122 antisense oligonucleotide ranging from 12.5 to 75 mg/kg twice weekly for 4 weeks. The mice appeared healthy and normal at the end of treatment, with no loss of body weight or reduced food intake. Plasma transaminase levels were in the normal range (AST 3/4 45, ALT 3/4 35) for all doses with the exception of the 75 mg/kg dose of miR-122 ASO, which showed a very mild increase in ALT and AST levels. They concluded that 50 mg/kg was an effective, non-toxic dose. Another study by Kriitzfeldt J., et al., (2005) Nature 438, 685-689, injected anatgomirs to silence miR-122 in mice using a total dose of 80, 160 or 240 mg per kg body weight. The highest dose resulted in a complete loss of miR-122 signal. In yet another study, locked nucleic acid molecules ("LNA molecules") were successfully applied in primates to silence miR-122. Elmen J., et al., (2008) Nature 452, 896-899, report that efficient silencing of miR-122 was achieved in primates by three doses of 10 mg kg-1 LNA-antimiR, leading to a long-lasting and reversible decrease in total plasma cholesterol without any evidence for LNA-associated toxicities or histopathological changes in the study animals.

Methods of Screening

Included herein are methods for screening test compounds, e.g., polypeptides or peptides, polynucleotides or oligonucleotides, inorganic or organic large or small molecule test compounds, to identify agents useful in the treatment of cancer. As used herein, "small molecules" refers to small organic or inorganic molecules of molecular weight below about 3,000 Daltons. In general, small molecules useful for the invention have a molecular weight of less than 3,000 Daltons (Da). The small molecules can be, e.g., from at least about 100 Da to about 3,000 Da (e.g., between about 100 to about 3,000 Da, about 100 to about 2500 Da, about 100 to about 2,000 Da, about 100 to about 1,750 Da, about 100 to about 1,500 Da, about 100 to about 1,250 Da, about 100 to about 1,000 Da, about 100 to about 750 Da, about 100 to about 500 Da, about 200 to about 1500, about 500 to about 1000, about 300 to about 1000 Da, or about 100 to about 250 Da).

The test compounds can be, e.g., natural products or members of a combinatorial chemistry library. A set of diverse molecules should be used to cover a variety of functions such as charge, aromaticity, hydrogen bonding, flexibility, size, length of side chain, hydrophobicity, and rigidity. Combinatorial techniques suitable for synthesizing small molecules are known in the art, e.g., as exemplified by Obrecht and Villalgordo, *Solid-Supported Combinatorial and Parallel Synthesis of Small-Molecular-Weight Compound Libraries*, Pergamon-Elsevier Science Limited (1998), and include those such as the "split and pool" or "parallel" synthesis techniques, solid-phase and solution-phase techniques, and encoding techniques (see, for example, Czarnik, Curr. Opin. Chem. Bio. 1:60-6 (1997)). In addition, a number of small molecule libraries are commercially available. A number of suitable small molecule test compounds are listed in U.S. Pat. No. 6,503,713, incorporated herein by reference in its entirety.

In some embodiments, the test compounds are nucleic acids, e.g., one or more nucleic acids that have identity to all or a portion of the ATRX-binding RNA or DNA, or a set of randomly generated oligos. The oligos can be LNAs, and can be antagomirs, mixmers, or gapmers.

Libraries screened using the methods of the present invention can comprise a variety of types of test compounds. A given library can comprise a set of structurally related or unrelated test compounds. In some embodiments, the test compounds are peptide or peptidomimetic molecules. In some embodiments, the test compounds are nucleic acids.

In some embodiments, the test compounds and libraries thereof can be obtained by systematically altering the structure of a first test compound, e.g., a first test compound that is structurally similar to a known natural binding partner of the target polypeptide, or a first small molecule identified as capable of binding the target polypeptide, e.g., using methods known in the art or the methods described herein, and correlating that structure to a resulting biological activity, e.g., a structure-activity relationship study. As one of skill in the art will appreciate, there are a variety of standard methods for creating such a structure-activity relationship. Thus, in some instances, the work may be largely empirical, and in others, the three-dimensional structure of an endogenous polypeptide or portion thereof can be used as a starting point for the rational design of a small molecule compound or compounds. For example, in one embodiment, a general library of small molecules is screened, e.g., using the methods described herein.

In some embodiments, a test compound is applied to a test sample, e.g., a cancer cell, and one or more effects of the test compound is evaluated. In a cultured cancer cell for example, the ability of the test compound to inhibit proliferation or affect survival, e.g., to induce or promote cell death, is evaluated.

In some embodiments, the test sample is, or is derived from (e.g., a sample taken from) a tumor, e.g., a primary or cultured tumor cell.

Methods for evaluating each of these effects are known in the art. For example, assays of proliferation or cell survival/ viability are well known in the art.

A test compound that has been screened by a method described herein and determined to inhibit proliferation or affect survival, e.g., induce or promote cell death, can be considered a candidate compound. A candidate compound that has been screened, e.g., in an in vivo model of a disorder, e.g., a xenograft model, and determined to have a desirable effect on the disorder, e.g., on growth or metastasis of a tumor, can be considered a candidate therapeutic agent. Candidate therapeutic agents, once screened in a clinical setting, are therapeutic agents. Candidate compounds, candidate therapeutic agents, and therapeutic agents can be optionally optimized and/or derivatized, and formulated with physiologically acceptable excipients to form pharmaceutical compositions.

Thus, test compounds identified as "hits" (e.g., test compounds that inhibit proliferation or affect survival, e.g., induce or promote cell death) in a first screen can be selected and systematically altered, e.g., using rational design, to optimize binding affinity, avidity, specificity, or other parameter. Such optimization can also be screened for using the methods described herein. Thus, in one embodiment, the invention includes screening a first library of compounds using a method known in the art and/or described herein, identifying one or more hits in that library, subjecting those hits to systematic structural alteration to create a second library of compounds structurally related to the hit, and screening the second library using the methods described herein.

Test compounds identified as hits can be considered candidate therapeutic compounds, useful in treating cancer. A variety of techniques useful for determining the structures of "hits" can be used in the methods described herein, e.g., NMR, mass spectrometry, gas chromatography equipped with electron capture detectors, fluorescence and absorption spectroscopy. Thus, the invention also includes compounds identified as "hits" by the methods described herein, and methods for their administration and use in the treatment, prevention, or delay of development or progression of a disorder described herein.

Test compounds identified as candidate therapeutic compounds can be further screened by administration to an animal model of a tumor, e.g., a xenograft model, as known in the art. The animal can be monitored for a change in the disorder, e.g., for an improvement in a parameter of the disorder, e.g., a parameter related to clinical outcome. In some embodiments, the parameter is tumor size, and an improvement would be a reduction or stabilization of tumor size, or a reduction in growth rate; in some embodiments, the parameter is invasiveness, and an improvement would be a reduction or delay in metastasis.

EXAMPLES

The invention is further described in the following examples, which do not limit the scope of the invention described in the claims.

Experimental Procedures

The following materials and methods were used in Examples 1-6.

Cell Lines:

Clonal Xist knockout MEFs, $Tsix^{TST}/+$ ESC, and X+P and X-RA male MEF lines were described previously (Jeon and Lee, 2011; Ogawa et al., 2008; Zhang et al., 2007). Mouse embryonic fibroblasts (MEFs) were immortalized (SV40T) and selected for clonal cell lines with Xi of $mus$ origin. The $Tsix^{TST}$ allele ensures exclusive inactivation of the $mus$ X-chromosome in ESC.

RNA FISH, DNA FISH and Immunostaining:

RNA FISH, DNA FISH or sequential RNA-DNA FISH and immunostaining were described previously (Zhang et al., 2007).

Immunoprecipitation and Mass Spectrometry:

Nuclear extract from 293F FLAG macroH2A cell lines was prepared and dialyzed into BC100 buffer (20 mM Tris Cl pH 7.6, 2 mM EDTA, 100 mM KCl, 10% glycerol and 0.2 mM PMSF), incubated with M2 agarose beads and washed 3× with BC300. Flag peptide eluted complexes were run SDS-PAGE gels and colloidal blue stained. MacroH2A IP specific bands were sent for mass spectrometry. Proteins were digested and extracted peptides (Wilker et al., 2007) loaded on a precolumn and separated by reverse phase HPLC (Agilent) over a 75 min gradient before nanoelectrospray using Orbitrap XL mass spectrometer (Thermo). Raw mass spectral data files were processed as described (Johnson et al., 2012). Mascot peptide identifications were verified manually with the assistance of CAMV (Curran et al., 2013).

qRT-PCR, ChIP, and UV-RNA IP:

RNA isolation and RT-PCR were performed according to manufacturer's protocols (Invitrogen). ChIP and UV cross-linked RNA immunoprecipitation were performed as described previously (Jeon and Lee, 2011). Primers and antibodies are listed in Table 6.

Protein Expression and Purification:

Full length ATRX containing an N term FLAG tag and C term HA tag was cloned into a pfastbac vector (invitrogen). Sf9 cells were infected with virus for 60 h and protein was purified using Flag M2 agarose. The helicase domain of ATRX with an N term FLAG was cloned into the pdest10 vector (invitrogen). The ADD domain of ATRX was cloned into pet101 vector and purified via a C term His tag using Ni-NTA resin (Qiagen) according to manufacturer's instructions.

RNA and DNA EMSA and Double Filter Binding Assays:

EMSAs and filter binding assays were performed as described previously (Cifuentes-Rojas et al., 2014).

In Vitro Protein-RNA Interaction Assays: 2 µl g ATRX, 2 µg PRC2 and 1 µg Repeat A RNA were combined in buffer containing 50 mM Tris-HCl pH 8.0, 100 mM NaCl, 1.5 mM $MgCl_2$, 10 µg/ml BSA, 0.05% NP40, 1 mM DTT, 20 U RNaseOUT (Invitrogen™), 50 ng/µl yeast tRNA (Ambion® Cat # AM7119) and 1 mM ATP in a 20 µl reaction and incubated at 37° C. for 30 min. Reactions were added to Protein G coupled a-EZH2 at 4° C. for 2 h and washed with 1× binding buffer. Beads were split in 2: for RNA and protein analyses. RNA was eluted with formamide-urea buffer, loaded on a 6% Urea-PAGE and SYBR Gold stained. Proteins were eluted by boiling beads in SDS loading buffer.

For ternary complex IPs, 3 µg ATRX, PRC2 and Repeat A RNA were incubated at 30° C. in an RNA-EMSA binding reaction (see above) and precipitated using α-HA beads. Beads were washed with 1× binding buffer and complexes eluted with 1 µg/µl HA peptide. HA eluate was incubated with a-EZH2-protein G dynabeads. After washing, beads were split into 2 parts: for RNA and protein western blot. RNA was eluted with 0.2M glycine pH 2.0, neutralized with Tris.Cl pH 8.0 and end labeled in a PNK reaction for visualization.

200 ng of 5' Biotin tagged Repeat A dsDNA was immobilized to Streptavidin Myone dynabeads. 25 nM ATRX and 35 nM RNA were combined in an EMSA reaction at 30° C. for 20 min, added to DNA and incubated for 20 min at 30° C. Beads were washed (as above) and nucleic acids were end labeled and resolved on an 18% Urea-PAGE gel.

Photocrosslinking:

In vitro transcription reactions were done as previously described (Hernandez et al., 2008) for 16 hrs at 37° C. with addition of 1 nM 4-Thio-UTP and $^{32}$Pα-GTP and $^{32}$Pα-CTP at 0.6 µM. Binding reactions were performed as described previously (Cifuentes-Rojas et al., 2014), irradiated for 12 min with 365-nm UV and digested with 0.1 ng RNase A, 1 U RNase T1 and 1 U RNase V1 for 20 min. SDS loading buffer was added and samples run on a 3-8% Tris-acetate SDS gradient gel.

ChIP-Seq Read Mapping:

ChIP-seq samples were sequenced using Illumina HiSeq2000 resulting in 25-50 million 50 bp paired-end reads per sample. Using ASAP tool (bioinformatics.babraham.ac.uk/projects/ASAP/), reads were aligned allele-specifically to CAST/EiJ and 129S1/SvJm genomes constructed using high quality polymorphisms to the C57/B16 reference genome (mm9). 25% of reads mapped uniquely and allele-specifically and 45% equally well to both genomes. Composite coverage tracks were generated using alignment against mm9 with ≤2 alternative mappings allowed. 80% of reads were aligned, with 10-15% of them discarded due to multiple alternate mappings. Input-normalized read densities were computed using SPP (Kharchenko et al., 2008) after PCR duplicate removal.

Peak Calling:

Regions of ATRX enrichment were determined based on tag counts in a 1 Kb window sliding with a 200 bp step. Statistical significance of enrichment of ChIP vs input was estimated using negative binomial distribution, with mean based on input tag count in input and size parameter (s) selected based on manual inspection of resulting peak calls. Regions of enrichment were defined by merging adjacent significantly enriched windows separated by ≤1 Kb.

Coverage Over Genomic Elements:

Coverage over TSS-proximal regions, gene bodies, or non-overlapping genome-wide 1 Kb bins was calculated from input-normalized SPP read densities. Actively expressed genes were identified using the cutoff of FPKM≥1.0 based on RNA-Seq data from (Yang et al., 2010). Input-normalized coverage over 1 Kb windows for Xist CHART and EZH2 ChIP-Seq was computed based on data from (Pinter et al., 2012; Simon et al., 2013). Significance of change in EZH2 and H3K27me3 densities produced by ATRX KD was assessed by t-test in separate quartiles of unique RefSeq genes ranked by WT ATRX density over gene body.

Example 1. A Proteomics Screen Identifies ATRX as a Candidate XCI Regulator

Because the macroH2A (mH2A) histone variant is enriched within gene-dense bands of the Xi together with Xist RNA and PRC2 (Chadwick and Willard, 2004; Costanzi and Pehrson, 1998), we performed an unbiased proteomics screen using mH2A as bait in an affinity purification. We expressed FLAG-tagged mH2A in 293, a human fibroblast cell line, and carried out FLAG immunoprecipitation followed by mass spectrometry (IP-MS). We observed several known interactors of mH2A, including PARP1 and linker histone H1 (FIG. 1A, left and middle panels; FIG. 8A)(Nusinow et al., 2007), as well as MECP2 and HP1. In addition, IP-MS revealed the 280-kD ATRX protein (FIG. 1A, 8B). We validated all interacting proteins by Western blot after FLAG-mH2A IP (FIG. 1A, right panel, and data not shown).

ATRX caught our attention, as it was shown to be enriched on the Xi by immunofluorescence (Baumann and De La Fuente, 2009) and has an ATPase and helicase domain (Clynes et al., 2013; Ratnakumar and Bernstein, 2013). ATRX is known as an unusual SNF2-like member of the SWI/SNF family of chromatin remodelers, as it appears to have only weak remodeling activity and does not affect nucleosome phasing in vitro. It does, however, have ATPase activity that is mildly stimulated by naked DNA and mononucleosomes (Tang et al., 2004; Xue et al., 2003), and a translocase activity that displaces a third strand of a DNA triplex (Mitson et al., 2011; Xue et al., 2003). The atypical N-terminal PHD finger domain of ATRX (a.k.a., ATRX-Dnmt3-Dnmt3L [ADD] domain) binds to unmodified histone H3-lysine 4 and to di- or tri-methylated H3-lysine 9 (Dhayalan et al., 2011; Eustermann et al., 2011; Iwase et al., 2011), in keeping with ATRX's role in maintaining pericentric heterochromatin and telomeres (Goldberg et al., 2010; Lewis et al., 2010). Mutations in ATRX cause X-linked mental retardation and alpha-thalassemia in humans, with ~80% of mutations mapping to the PHD finger and helicase domains (Gibbons et al., 2008). Although ATRX appears enriched on the Xi and plays a role in peri-implantation development (Garrick et al., 2006), whether ATRX plays a role in XCI is unknown.

Figure 1B:
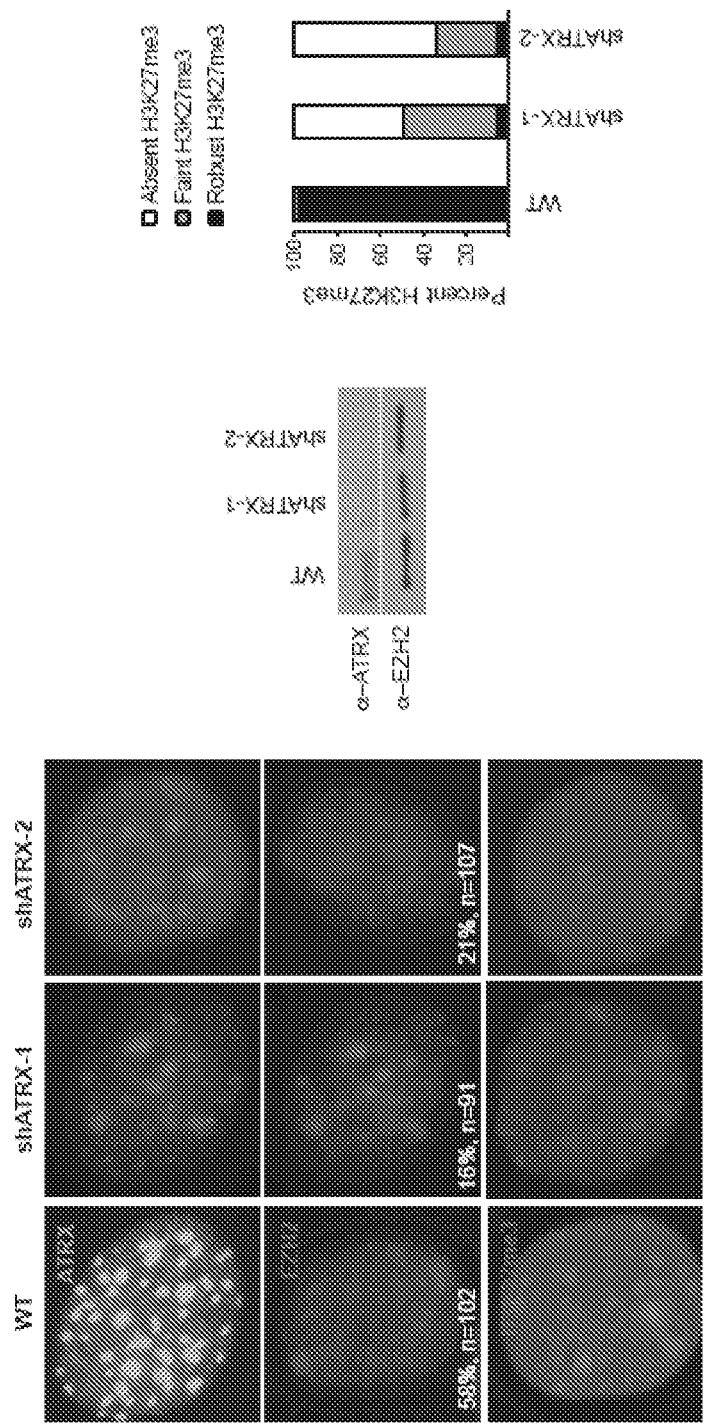
Figure 1C:
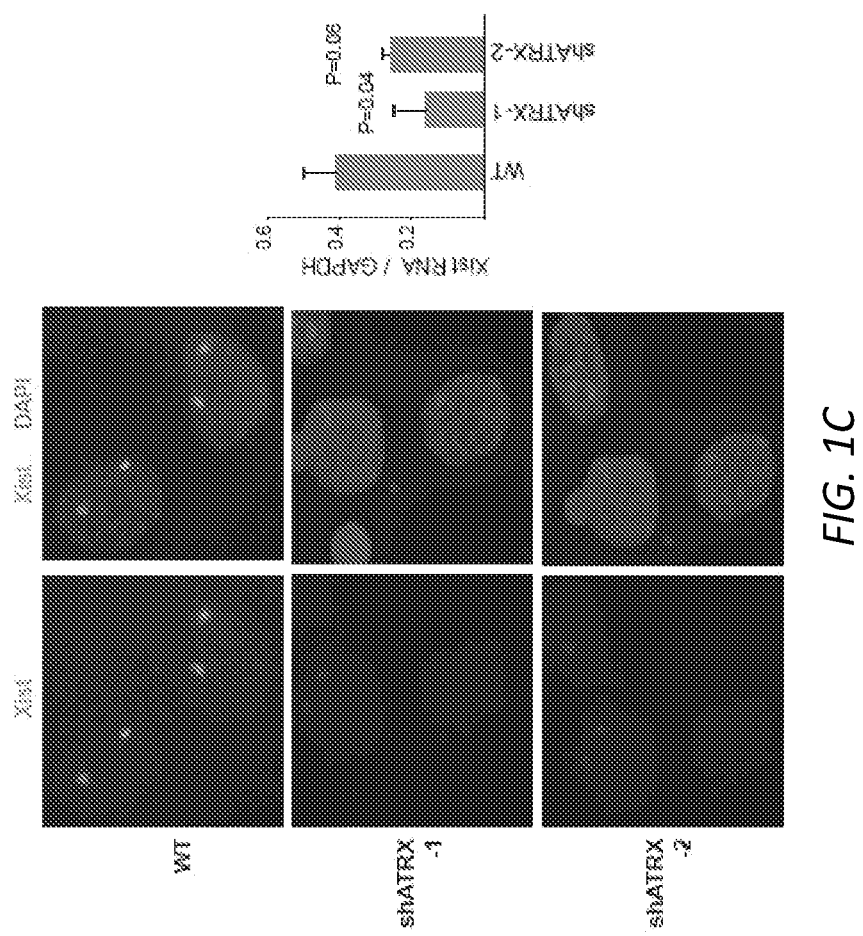
Figure 1D:
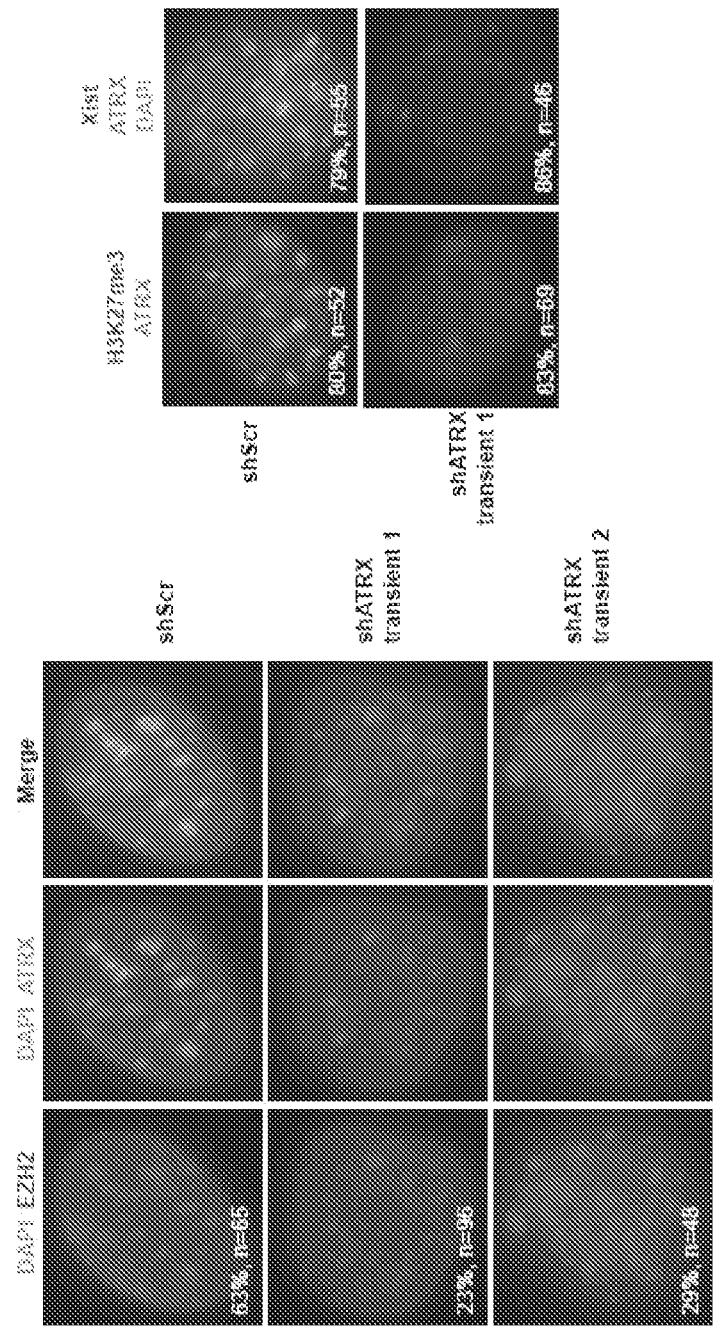

To investigate, we generated clones of mouse embryonic fibroblasts (MEF) with stable ATRX knockdown (KD) (shATRX-1, -2) and >90% depletion of ATRX protein (FIG. 1B). We examined localization of EZH2, the PRC2 subunit that catalyzes the trimethylation of histone H3 at lysine-27 (H3K27me3). Interestingly, immunofluorescence showed that, while ≈60% of WT cells showed prominent EZH2 foci on the Xi, only 16-20% of ATRX KD cells retained EZH2 (FIG. 1B). Moreover, H3K27me3 on the X-chromosome was either absent or markedly reduced in shATRX cells. At the same time, RNA fluorescent in situ hybridization (FISH) showed that Xist RNA localized poorly, with quantitative RT-PCR showing that total Xist RNA levels were reduced 40-60% (FIG. 1C). Transient ATRX KDs in MEFs (48 h) showed that EZH2 localization was similarly compromised (FIG. 1D). In transient knockdowns, there was no obvious disturbance to Xist localization or H3K27me3, consistent with the short-term stability of Xist RNA and H3K27me3. Similar results were obtained using two independent ATRX shRNAs, whereas scrambled shRNA controls (Scr) resulted in no changes to Xist, EZH2, or H3K27me3 localization. Xist levels and localization were affected only in the long term, consistent with the notion that H3K27me3 at the Xist promoter targeted by RepA facilitates Xist upregulation (Sun et al., 2006; Zhao et al., 2008) and that the H3K27me3 mark is depleted only after several rounds of DNA replication. These findings hinted at a role of ATRX in recruiting and spreading PRC2 to form a "cloud" on the Xi.

Example 2. Xist-Mediated Recruitment of PRC2 Depends on ATRX

Figure 2A:
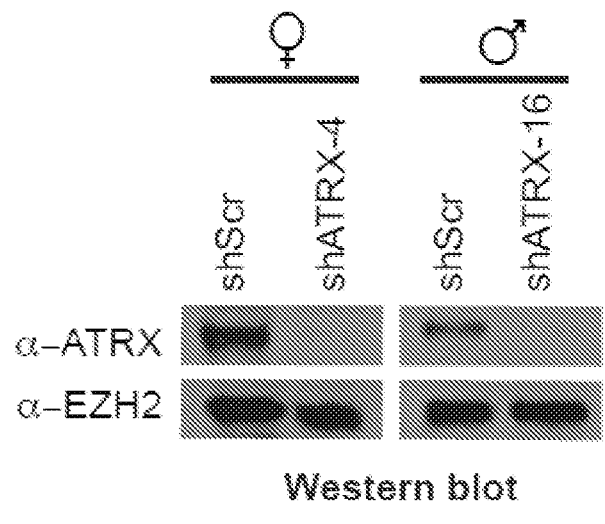
Figure 2B:
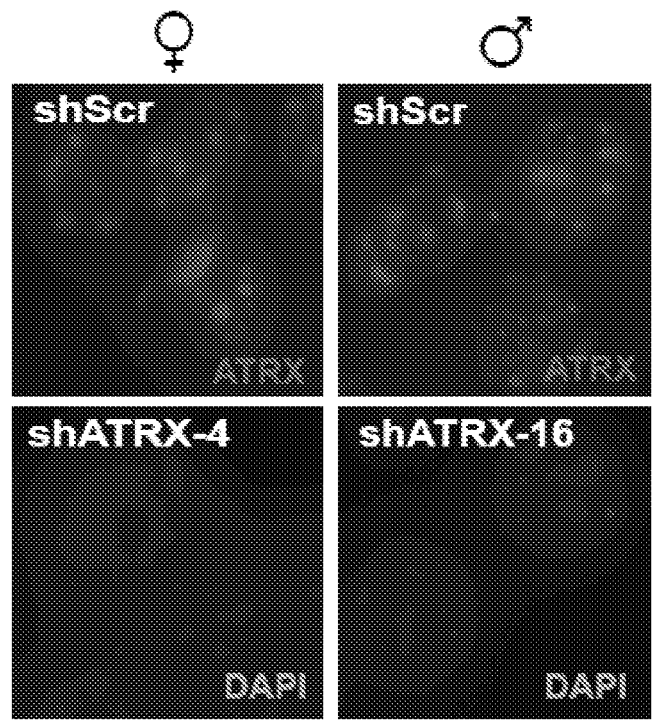
Figure 2C:
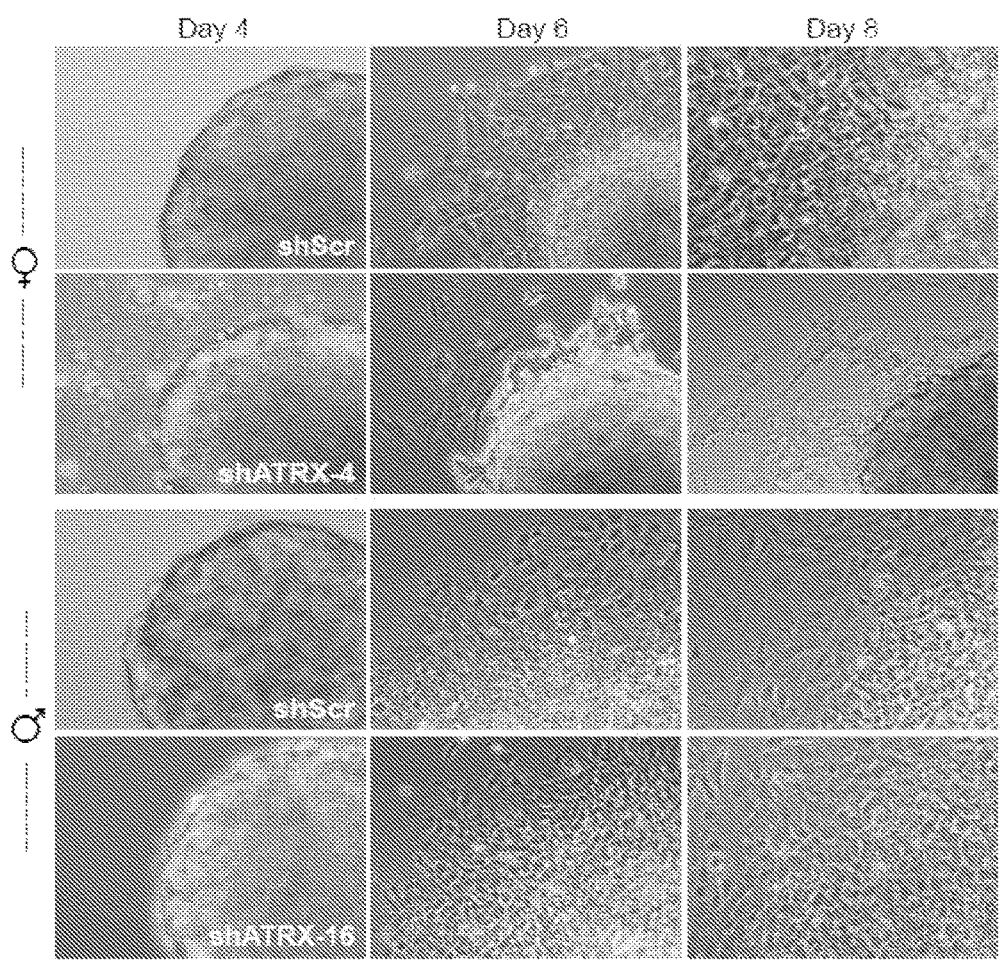
Figure 2D:
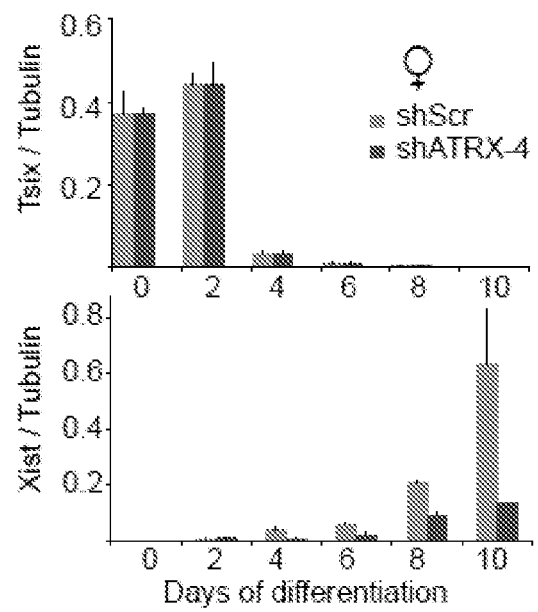
Figure 2E:
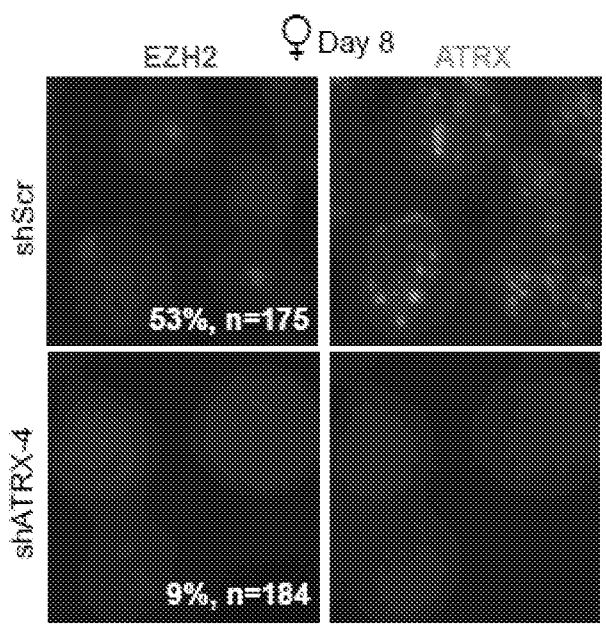
Figure 2F:
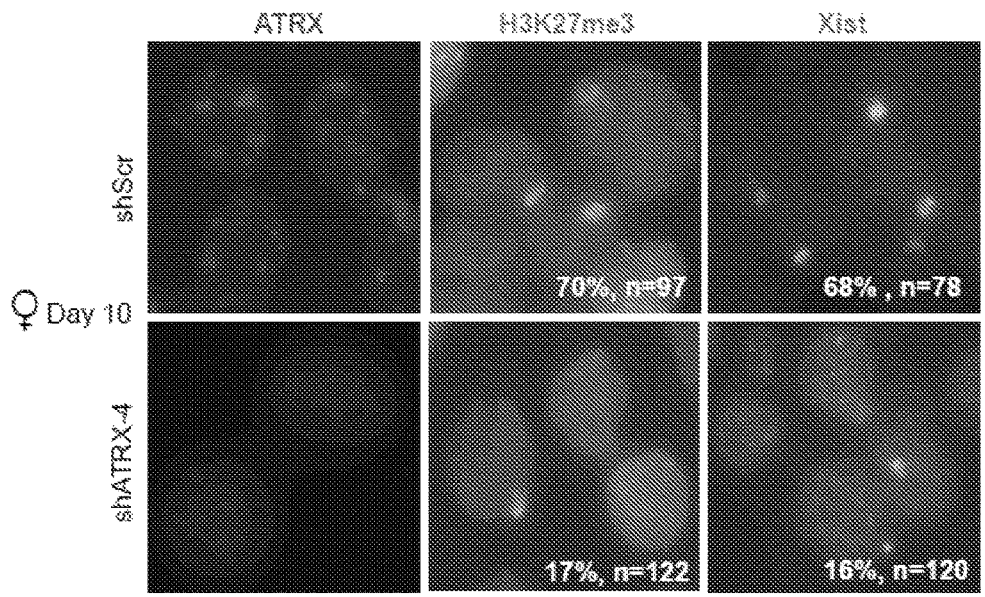
Figure 2G:
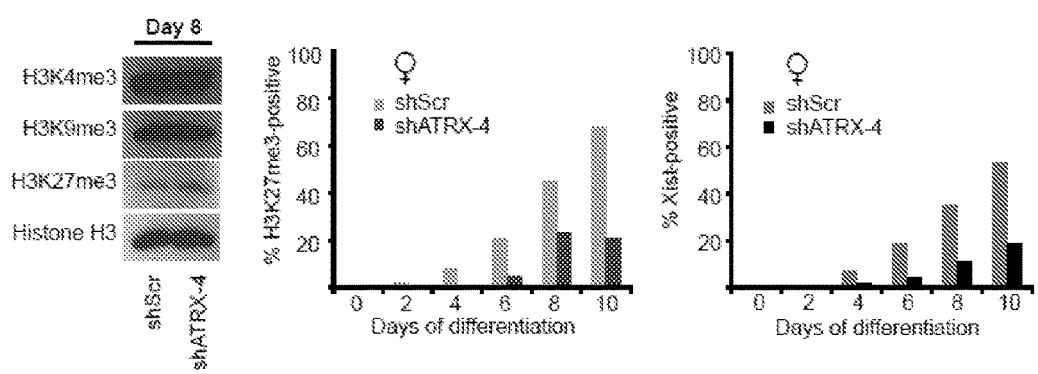
Figure 2K:
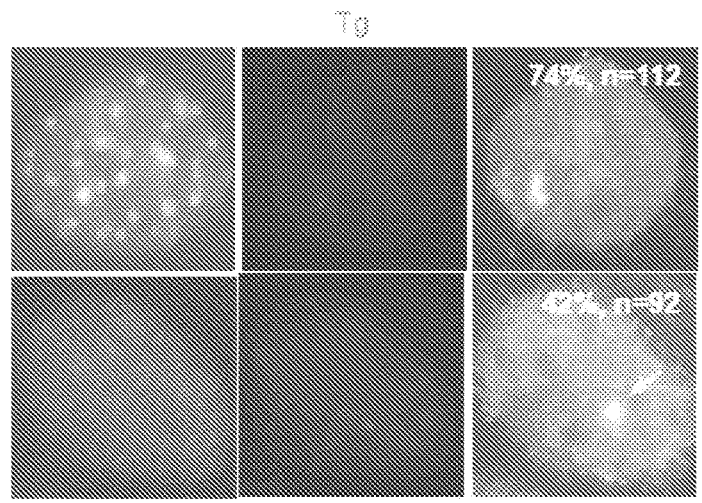

To examine whether there were sex-specific phenotypes of ATRX deficiency, we used a mouse embryonic stem cell (ESC) model to recapitulate random XCI during ex vivo cell differentiation. We generated male and female ESC clones with stable ATRX KD (FIG. 2A,B; representative clones shown) and compared their behavior to shScr control clones in time-course analyses from differentiation days 0-10. While no differences were evident from days 0-4, sex-specific differences emerged between days 4-8 (FIG. 2C,D). shATRX female cells showed defective embryoid body (EB) outgrowth, whereas shScr control and male shATRX clones grew robustly (FIG. 2C). Immunostaining showed appropriate downregulation of pluripotency markers, such as NANOG, between days 0-8 in all clones (FIG. 9A, B), indicating that the defect was not caused by failed entry into the differentiation pathway per se. The Xist regulator, Tsix, was also appropriately downregulated in shATRX and shScr female ESC between days 0-10 (FIG. 2D). These results indicated a developmental defect downstream of the differentiation signal. In spite of normal Tsix downregulation, however, Xist RNA was not appropriately upregulated in shATRX cells. Furthermore, EZH2 targeting was severely compromised, as only 9% of shATRX cells (n=184) showed EZH2 enrichment (FIG. 2E) and only 17% of cells showed H3K27me3 enrichment (FIG. 2F,G) on the Xi, even though H3K27me3 levels were unperturbed globally (FIG. 2G). Therefore, ATRX depletion resulted in female-specific outgrowth defects related to an inability to initiate XCI.

To probe further, we circumvented a dependency of Xist expression on ATRX and used an inducible transgenic system in which Xist RNA is upregulated by addition of doxycycline (dox)(Jeon and Lee, 2011). In this "X+P" system, Xist is carried on an autosomal transgene in male cells and is upregulated >20-fold upon induction, accompanied by recruitment of PRC2 along the autosome in cis. In stable shATRX X+P clones (FIG. 2H; representative clone #4 shown), ATRX KD did not affect total cellular EZH2 levels (FIG. 2H) and dox-induction led to an appropriate increase of Xist expression (FIG. 2I), indicating successful bypass of shATRX's effect on Xist expression. Immuno-RNA FISH showed that EZH2 and H3K27me3 enrichment were observed on the Xist-coated chromosome in 66% and 74% of ATRX+ transgenic cells, respectively, confirming the sufficiency of ectopic Xist expression to recruit and spread EZH2 in cis (FIG. 2J,K). However, on ATRX KD, EZH2 and H3K27me3 recruitment decreased to 34% and 42%, respectively. Thus, ATRX is required for Xist RNA-mediated recruitment of PRC2.

Figure 3A:
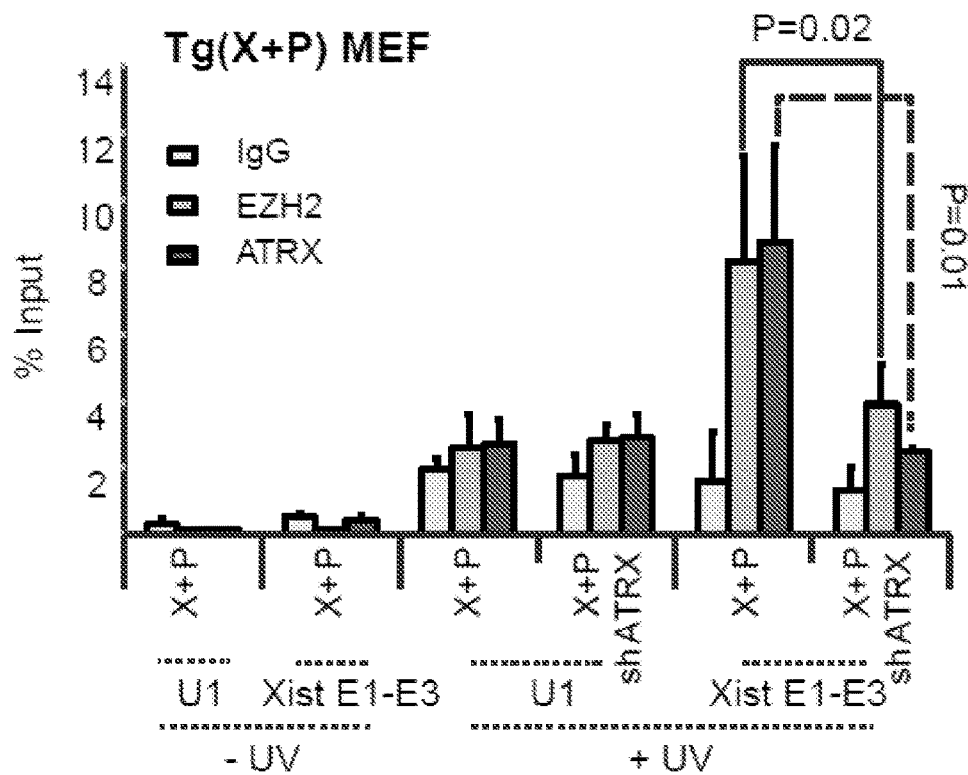
Figure 3E:
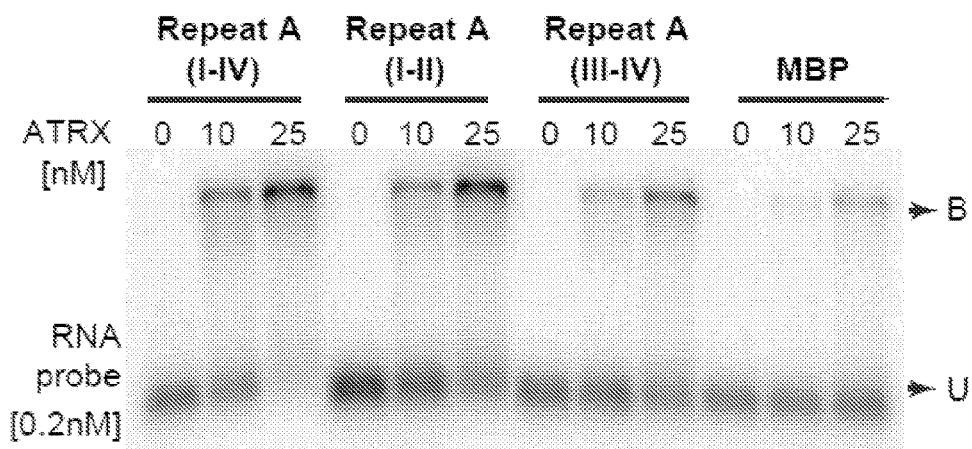

Example 3. ATRX is a High-Affinity RNA-Binding Protein that Loads PRC2 onto Xist RNA To ask if Xist and ATRX directly interact in vivo, we performed UV-crosslink RNA immunoprecipitation (UV-RIP; FIG. 3A). As expected, in ATRX+ transgenic system (X+P), EZH2 pulled down Xist RNA under UV crosslinking conditions, consistent with a direct interaction between EZH2 and Xist RNA (Zhao et al., 2008). Intriguingly, ATRX also pulled down Xist RNA. This association was detectable only when cells were subjected to UV-crosslinking, suggesting that Xist is directly bound to ATRX. Neither EZH2 nor ATRX pulled down the nonspecific RNA control, U1 RNA. Significantly, when ATRX was knocked down (X+P shATRX), the ability of EZH2 to interact with Xist RNA was compromised (P=0.02; FIG. 3A). Similarly, EZH2-Xist RNA interactions were disrupted in wildtype (WT) female MEF cells when ATRX was depleted (P=0.007; FIG. 3B). These data demonstrate that ATRX-Xist interaction facilitates binding of PRC2 to Xist RNA in vivo.

Figure 3F:
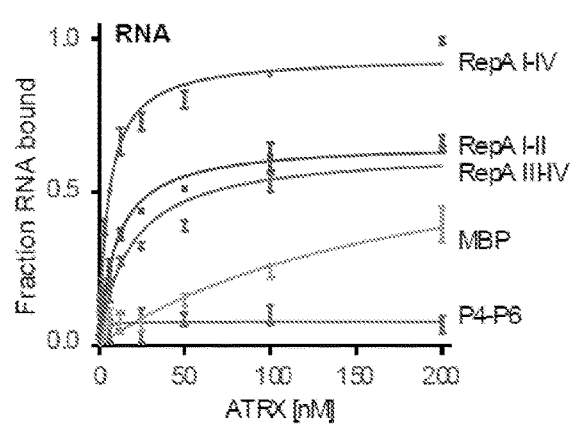

To understand mechanism, we characterized ATRX-RNA interactions in vitro. PRC2 binds RepA/Xist via Repeat A (Zhao et al., 2008), a 435-nt motif consisting of 8.5 repeats of a 28-nucleotide sequence, with the potential to form several structures, including two long stem-loop structures, I-II and III-IV (FIG. 3C) (Duszczyk et al., 2011; Maenner et al., 2010; Wutz et al., 2002; Zhao et al., 2008). To ask how ATRX facilitates PRC2 interaction with Repeat A, we first performed RNA electromobility shift assays (EMSA) using purified full-length ATRX (FIG. 3D, left panels, 10B). ATRX robustly shifted Repeat A in a concentration-dependent manner (FIG. 3E), with ~100% probe binding at <100 nM ATRX protein (FIG. 10C). To determine which region of Repeat A is sufficient for ATRX binding, we split Repeat A into I-II versus III-IV (FIG. 10A) and found that binding still occurred, albeit at lower levels. We calculated dissociation constants ($K_d$) from binding isotherms plotted from densitometric analysis of double-filter binding assays (FIG. 10D). Binding curves were fitted using a nonlinear regression model, with high $R^2$ values showing excellent fit of data points to the curve (FIG. 3F). ATRX strongly bound Repeat A I-IV, with a $K_d$ of 5.41±0.40 nM. Subfragments I-II and III-IV retained binding with $K_d$'s of 9.96±0.89 nM and 17.90±3.35 nM, respectively. To test the specificity of ATRX-RNA interactions, we used the first 300 nt of the Maltose Binding Protein (MBP) mRNA of *Escherichia coli* and the P4-P6 ribozyme of Tetrahymena, two non-cognate RNAs. Neither bound ATRX to an appreciable extent ($K_d$>>200 nM). We conclude that ATRX has high affinity and specificity for Repeat A RNA.

Figure 3G:
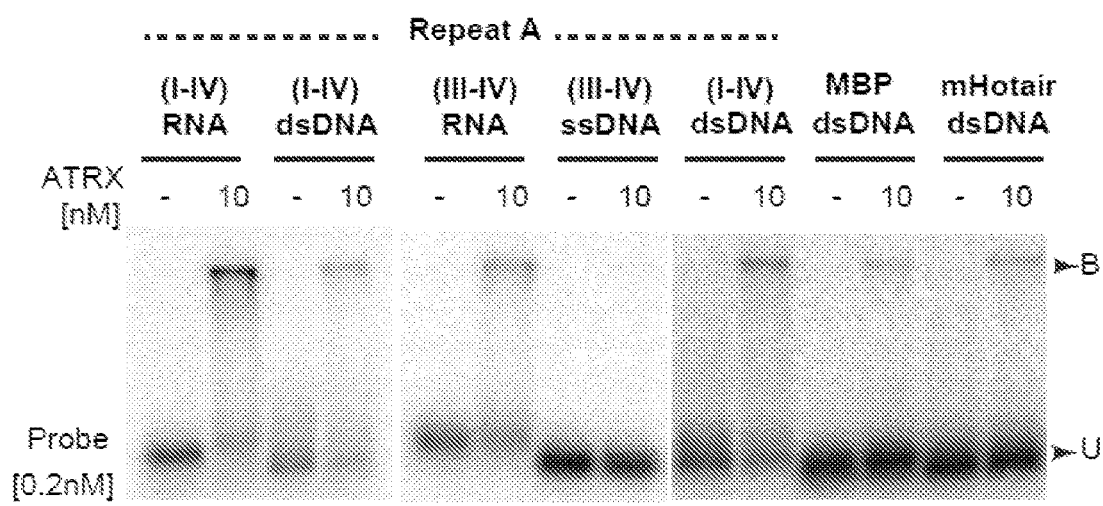
Figure 3H:
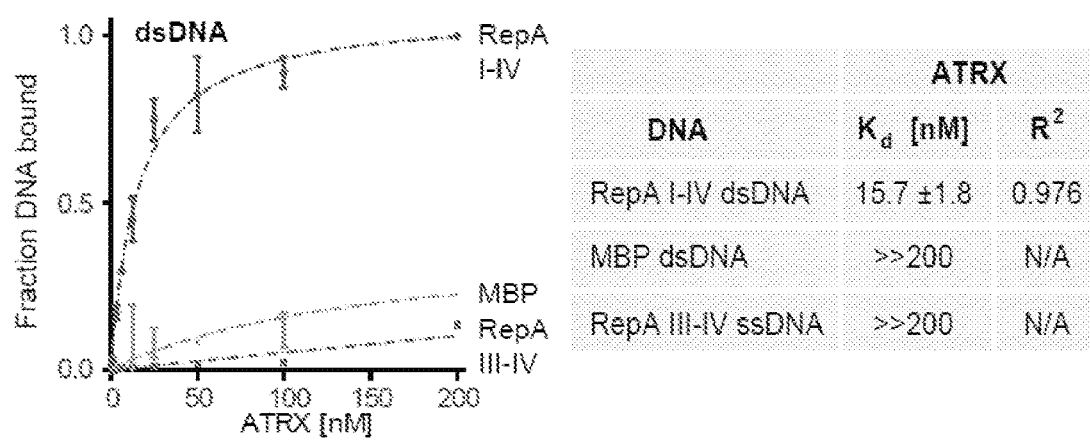
Figure 3I:
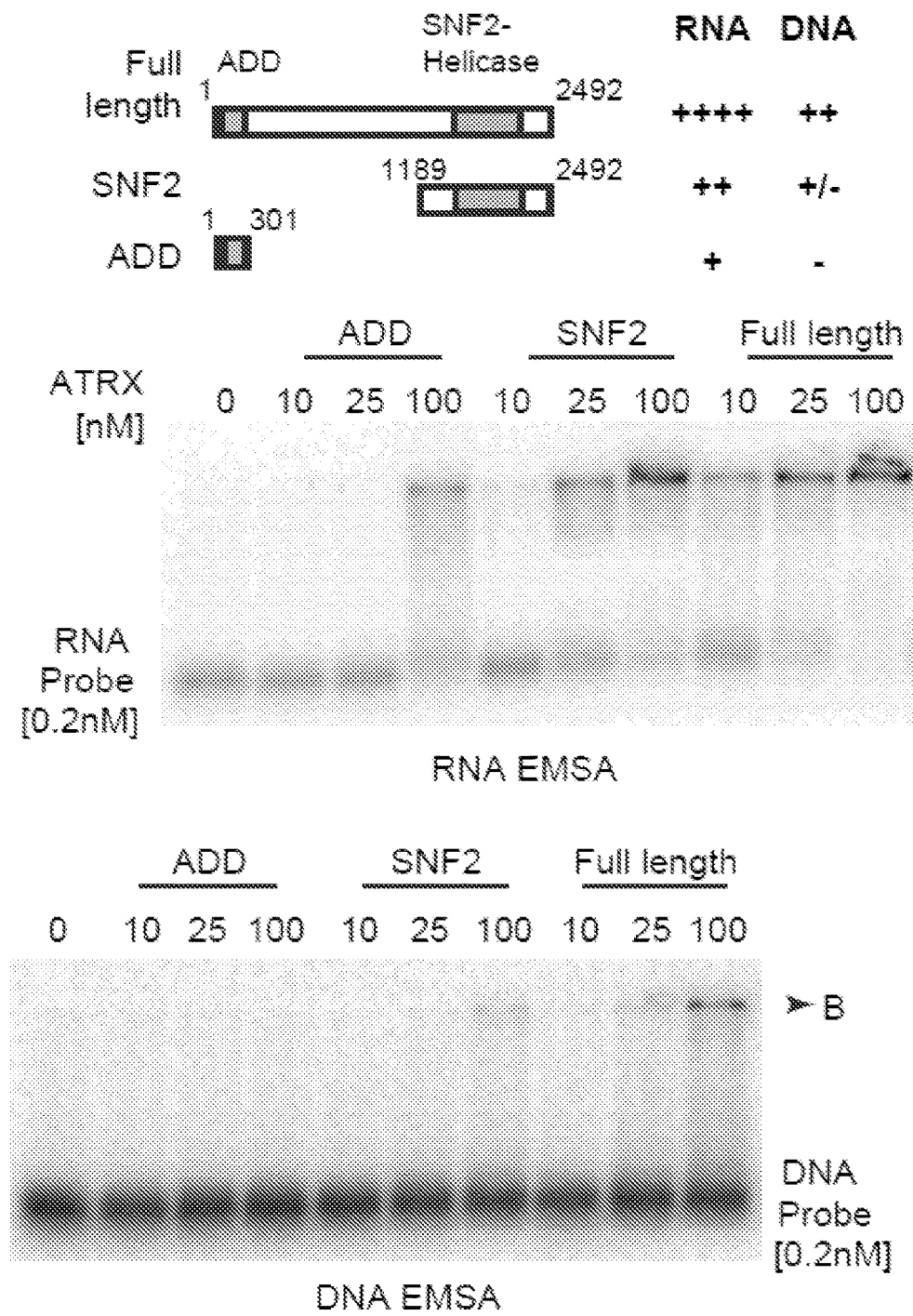

Interestingly, ATRX could also bind Repeat A double-stranded DNA (dsDNA; $K_d$=15.7)(FIG. 3G,H). However, it could not bind well to the single-stranded DNA (ssDNA), nor MBP and mouse Hotair dsDNAs (FIG. 3G,H; $K_d$>>200 nM). Therefore, ATRX has high affinity for both Repeat A RNA and dsDNA, and belongs to an emerging class of "bivalent" chromatin factors capable of binding both RNA and DNA [e.g., CTCF (Sun et al., 2013) and YY1 (Jeon and Lee, 2011)]. Competition analysis showed that 10-1000× molar excess of cold Repeat A dsDNA could not titrate away ATRX from Repeat A I-IV RNA probe (FIG. 10E) and, reciprocally, cold Repeat A I-IV RNA could not titrate ATRX away from the dsDNA probe (FIG. 10F), suggesting that ATRX interacts with RNA and dsDNA via distinct domains. To delineate binding domains, we generated subfragments of ATRX (FIG. 3D,I). The helicase domain could bind Repeat A RNA at 10-25 nM, but not so well as full-length ATRX. On the other hand, it bound dsDNA poorly, if at all (FIG. 3I). Gel shifts with the ADD domain showed binding to RNA at 100 nM, but not to DNA at the same concentration.

Figure 4A:
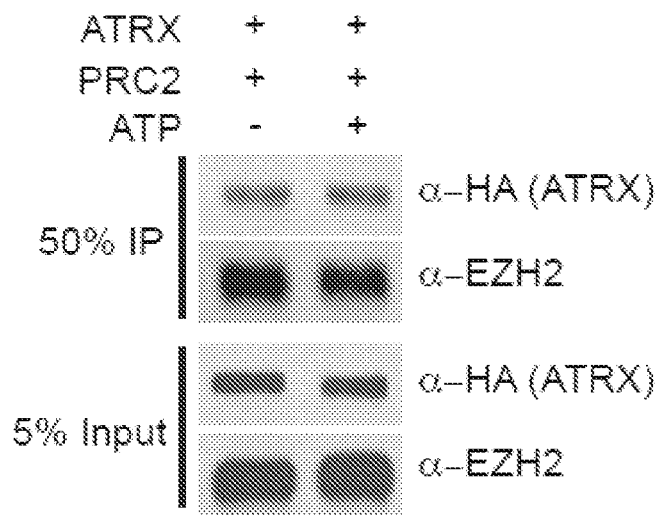
Figure 4B:
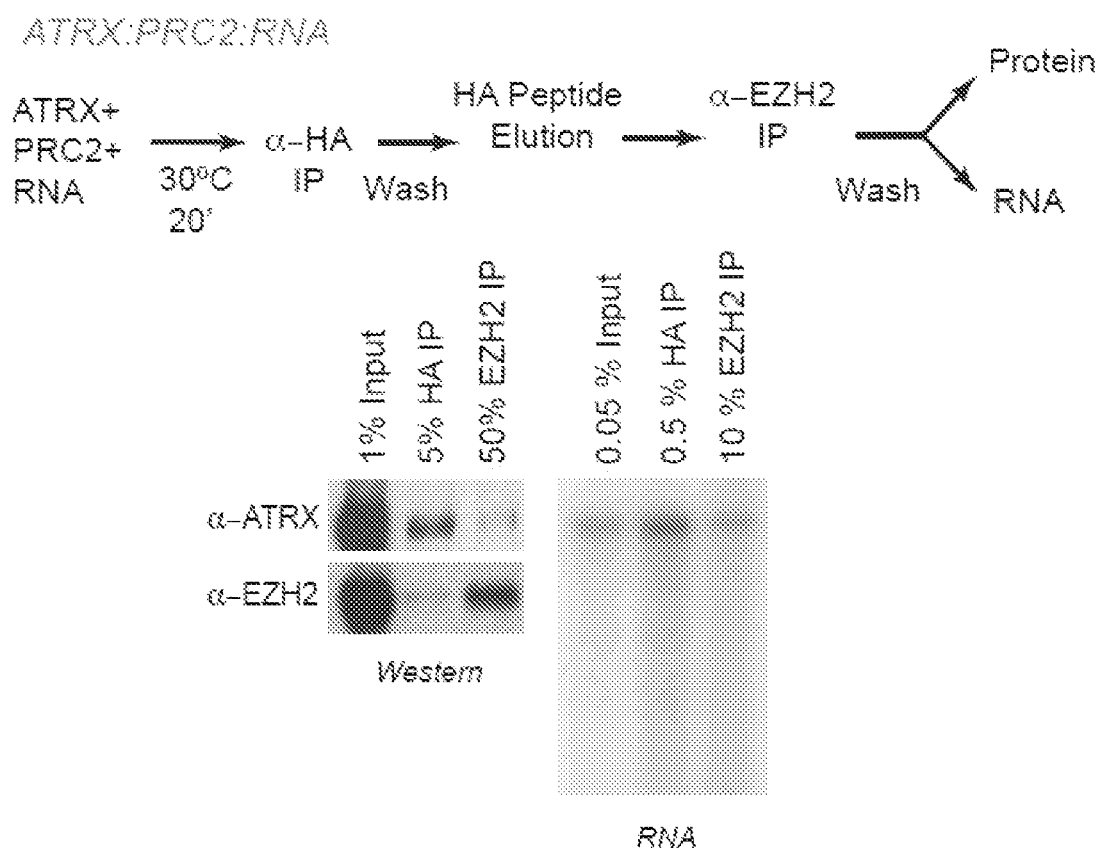

Because ATRX and PRC2 both bind Repeat A RNA, we asked whether ATRX and PRC2 could make direct contact to create an ATRX-RNA-PRC2 ternary complex. Using purified proteins, we observed that they do (FIG. 4A). This finding is consistent with a yeast two-hybrid screen in which EZH2 was identified as a directly interacting partner for ATRX (Cardoso et al., 1998), but which has not been verified by in vivo analyses. Notably, PRC2 components were not identified by our IP-MS analysis, though ATRX was a clear interacting partner (FIG. 1A). This apparent discrepancy may be due to substoichiometric ATRX-PRC2 associations in vivo and to mH2A being used as a bait in the proteomics screen. To confirm the ternary complex in vitro, we performed tandem IP, first pulling down ATRX via the HA tag, then immunoprecipitating PRC2 with an EZH2 antibody. Indeed, we observed end-labelled Repeat A RNA in the tandem IP (FIG. 4B), indicating that ATRX, PRC2, and Repeat A RNA formed a ternary complex.

Figure 4C:
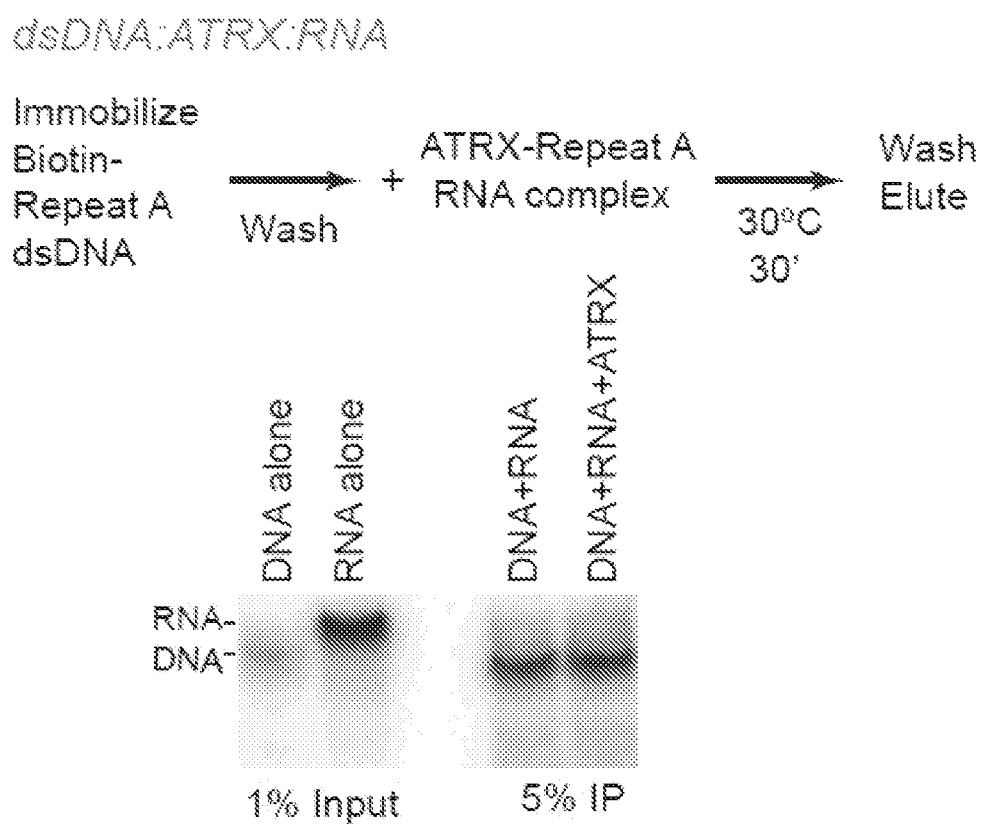

Given pairwise interactions between ATRX-RNA and ATRX-DNA (FIG. 3E-I), we also explored the possibility of an ATRX-RNA-DNA ternary complex. We immobilized biotinylated Repeat A dsDNA on streptavidin beads and tested its ability to bind the ATRX-Repeat A RNA complex. We reasoned that, if the ATRX-RNA complex could engage dsDNA, RNA would be visualized after elution from the column. Under these conditions, RNA was minimally present, if at all, in the eluate (FIG. 4C). Thus, if an RNA:ATRX:dsDNA ternary complex could form, it may be too transient to detect in vitro. We conclude that ATRX, PRC2, and Repeat A RNA forms a stable ternary complex, but that ATRX likely does not form a stable ternary complex with RNA and dsDNA in vitro.

Figure 4D:
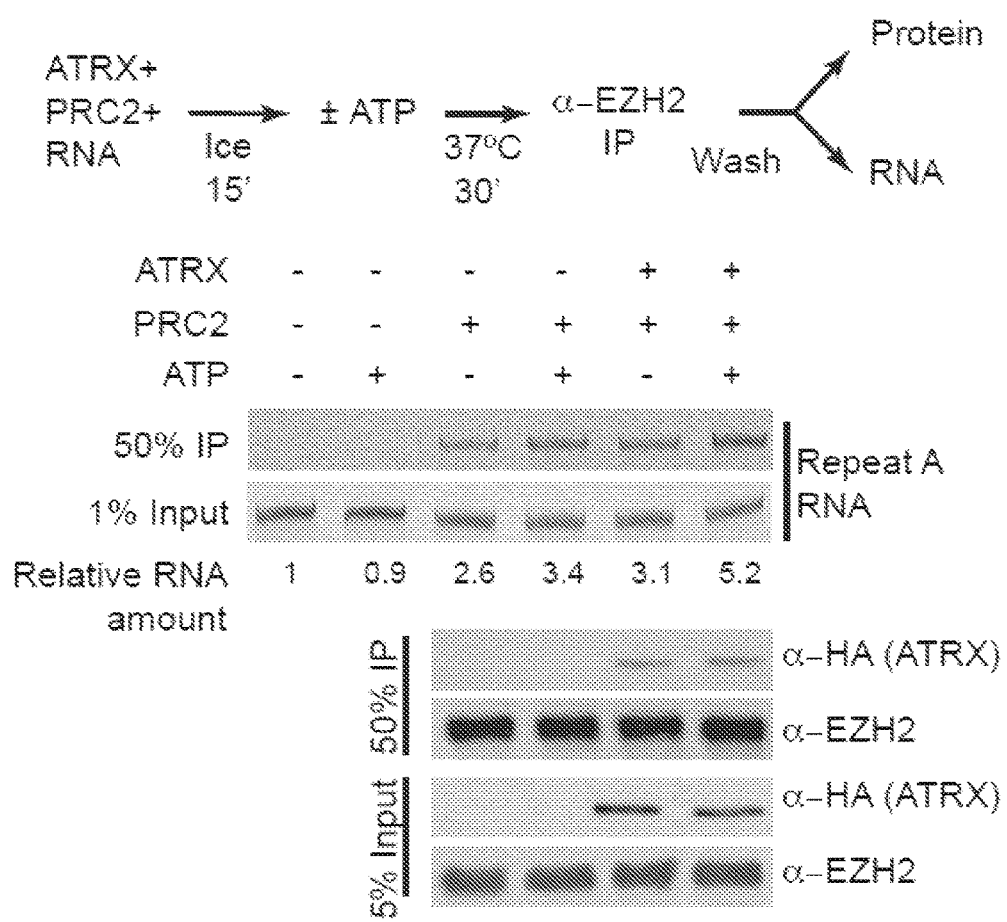
Figure 4E:
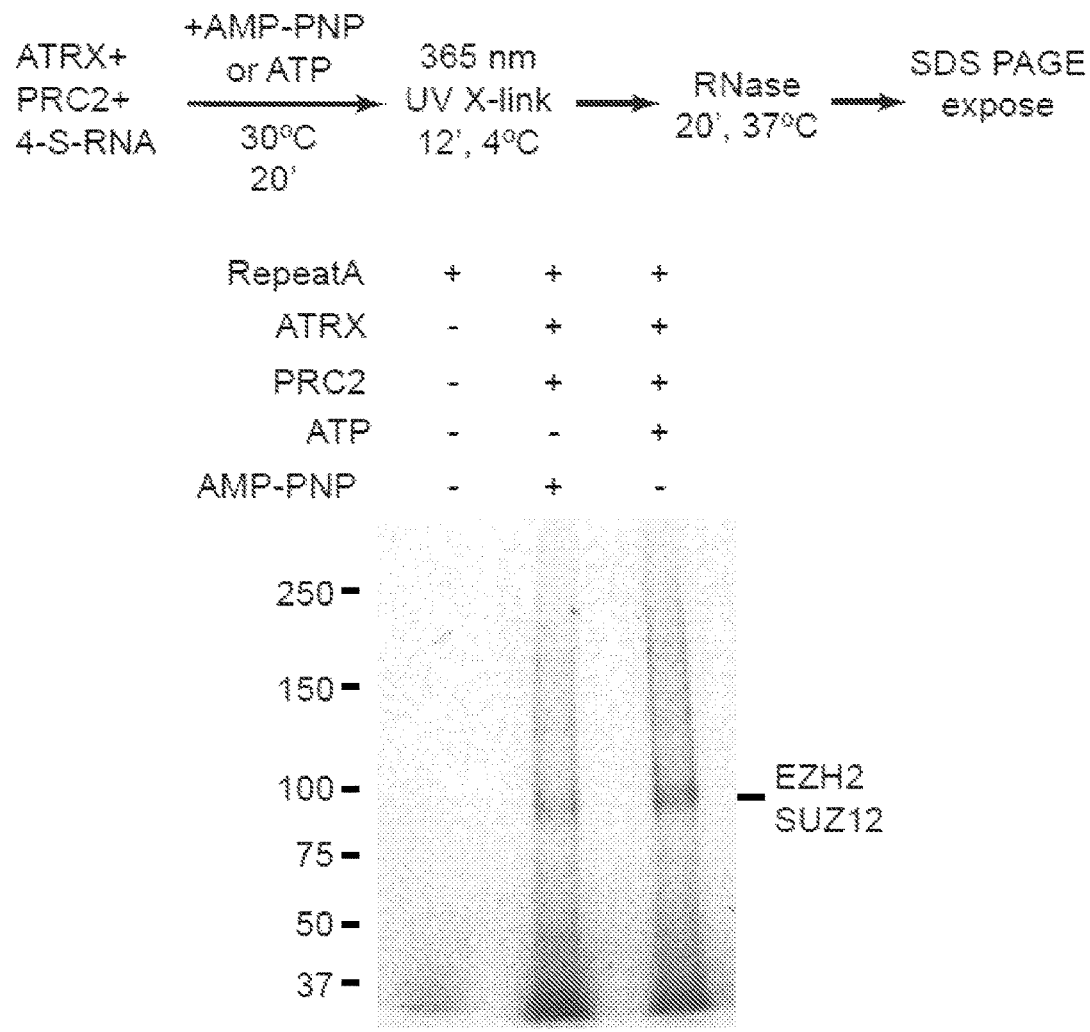

With ATRX possessing an ATPase domain, we examined how interaction dynamics might be changed by ATP. We assessed PRC2-RNA binding in the presence or absence of ATRX and/or ATP by immunoprecipitating EZH2 to quantitate the amount of RNA bound (FIG. 4D). Interestingly, ATRX's stimulatory effect was modestly increased (2-fold) in the presence of ATP, raising the possibility that ATRX may act by remodeling Repeat A to a configuration that promotes PRC2 binding. To test this idea, we carried out an RNAse protection assay with photocrosslinking. We incubated PRC2 with thiolated radiolabeled Repeat A RNA in the presence of ATRX and ATP or the non-hydrolysable analogue, AMP-PNP. The resulting complexes were subjected to UV crosslinking and treated with RNase A, T1, and V1. In principle, protein-bound radiolabeled RNA would be protected from digestion and detected in an SDS-PAGE autoradiograph. In five biological replicates, the presence of ATRX and ATP consistently resulted in greater protection of Repeat A RNA from RNAses, as visualized by the increased RNA signal bound to EZH2/SUZ12 (FIG. 4E), two known RNA-binding subunits of PRC2 (Cifuentes-Rojas et al., 2014). Together, these experiments show that ATRX stimulates binding of PRC2 to Repeat A RNA in a manner that is enhanced by ATP.

Figure 4F:
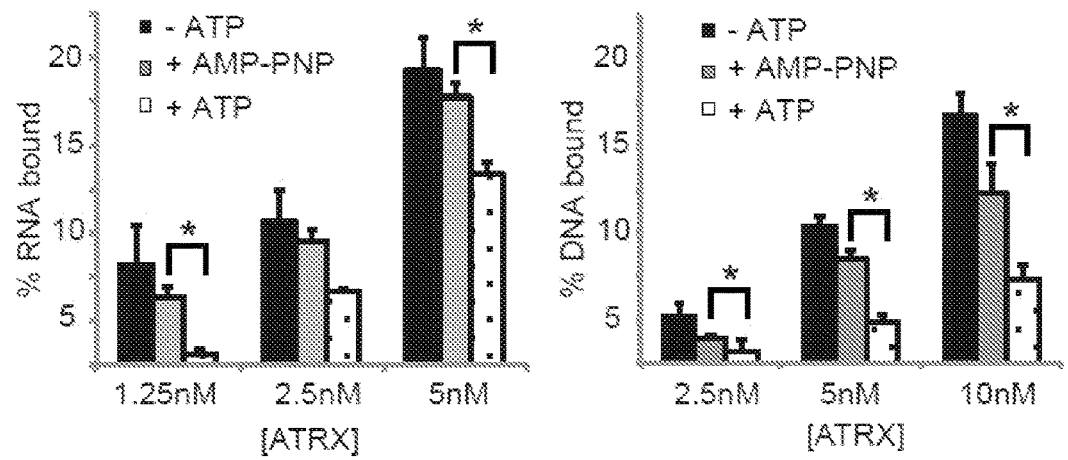

Intriguingly, ATRX bound RNA and DNA less well in the presence of ATP (FIG. 4F). However, when AMP-PNP was used, binding was not affected. This observation suggests that the nucleic acids are released by ATRX upon ATP hydrolysis. That is, ATRX may release RNA (and DNA) once the nucleic acid is reconfigured for PRC2 binding. The transient nature of the interactions may explain why a dsDNA-ATRX-RNA ternary complex was difficult to detect (FIG. 4C). The to ATRX:RNA:PRC2 ternary complex may be easier to detect (FIG. 4B) because it is held in place by both PRC2-RNA and PRC2-ATRX interactions. Combined, our data demonstrate that ATRX directly promotes binding of PRC2 to RepA/Xist RNA in vivo and in vitro.

Example 4. A Hotspot of ATRX Localization at the Xic

We investigated genomic binding patterns for ATRX by performing chromatin immunoprecipitation with deep sequencing (ChIP-seq). To distinguish between Xa and Xi, we used genetically marked hybrid cell lines in which the Xi is invariably of Mus musculus (mus) origin and the Xa of Mus castaneus (cas) origin (Ogawa et al., 2008; Pinter et al., 2012). Analysis of two biological replicates revealed that, in MEFs and ESC, ATRX was broadly distributed along all chromosomes (Chr)—including ChrX and a representative autosome, Chr13—with preferential enrichment in gene-dense regions (FIG. 5A). Allele-specific analysis of ChIP-seq coverage density plots for ATRX, EZH2, and H3K27me3 (Pinter et al., 2012) and CHART-seq analysis of Xist RNA (Simon et al., 2013) revealed that the four epitopes were concentrated in the same regions of the Xi in female MEFs (FIG. 5B), supporting the idea that ATRX, PRC2, and Xist RNA are functionally linked. Strong ATRX binding occurred at ~4987 sites, with 4% in promoter regions (transcription start site [TSS]±3 kb), 24% in coding gene bodies, and the rest in intergenic space (including enhancers, unannotated lncRNA transcription units)(FIG. 5C). This distribution is consistent with previous ChIP-seq analysis in male ESCs (Law et al., 2010).

Figure 11A:
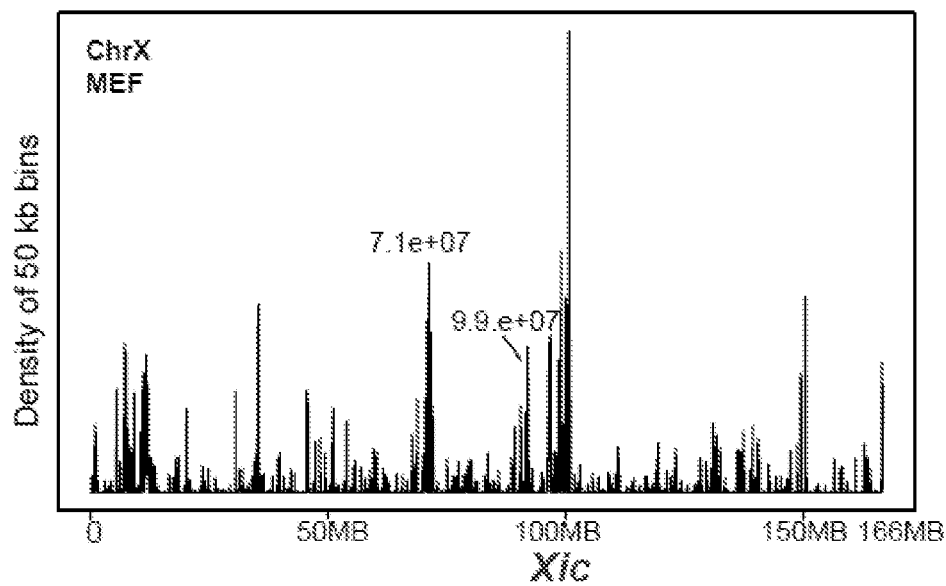
Figure 11B:
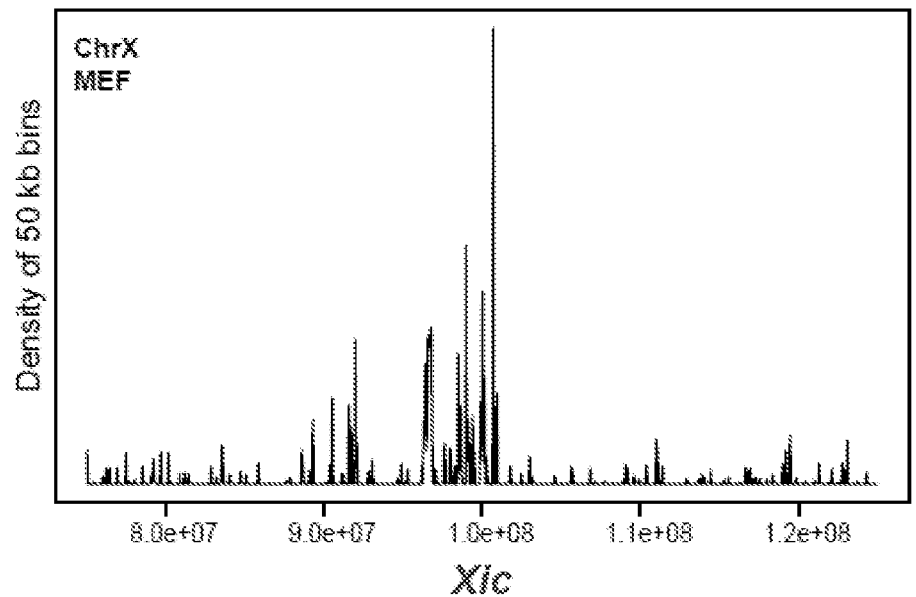
Figure 11C:
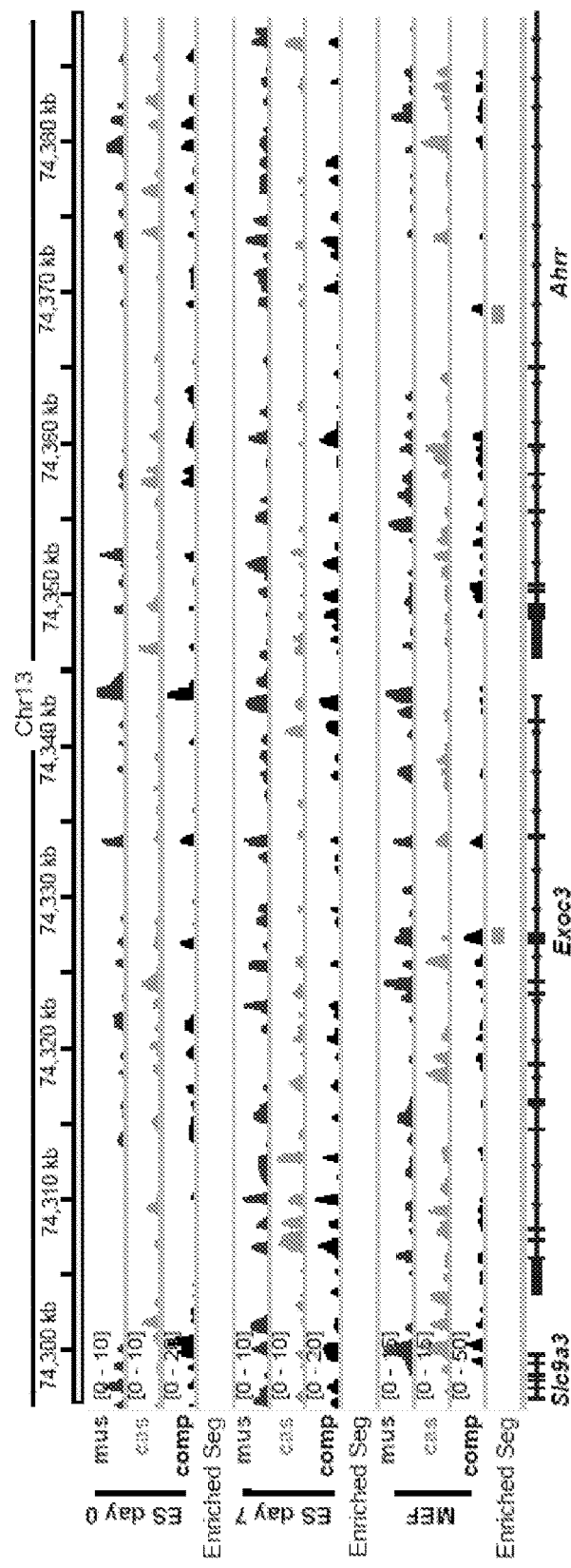
Figure 11D:
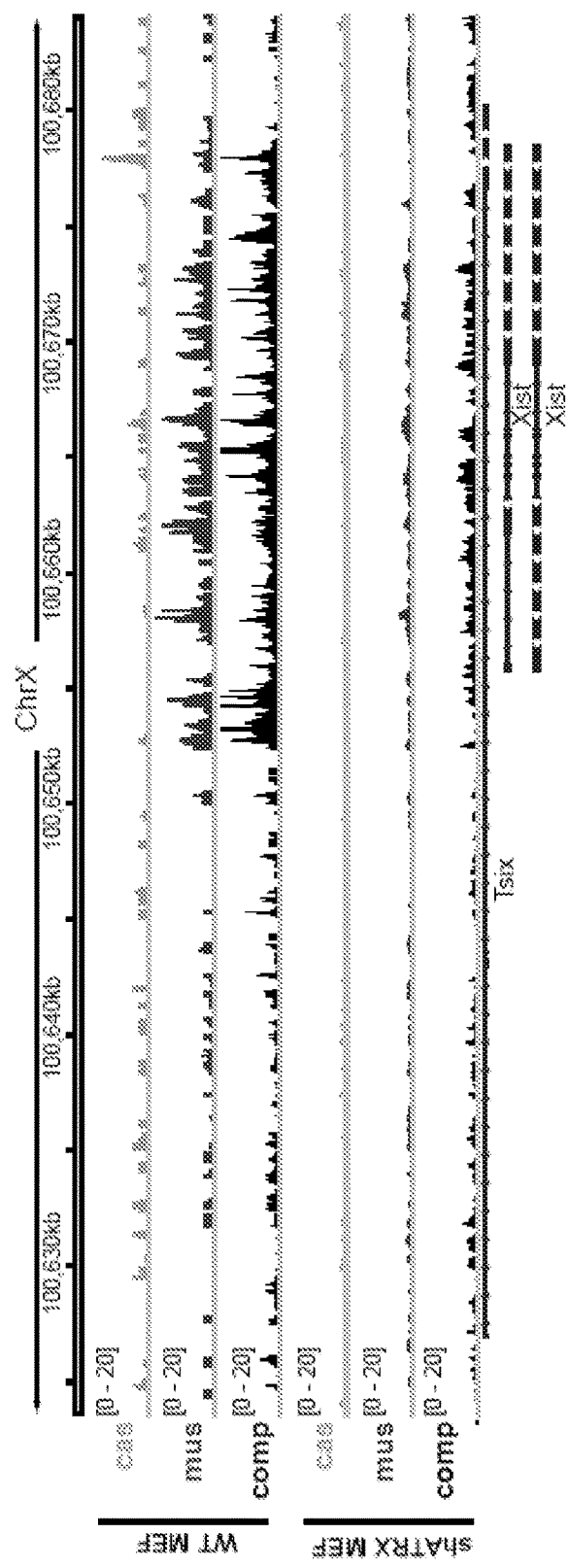

Among thousands of ATRX sites on ChrX, one locus stood out (FIG. 5D-E, 11A-B). Xist was among the top genic hits in female MEFs (FIG. 5F) and was covered by ATRX along its entire length, contrasting with the restricted peaks characteristic of other loci (FIG. 11C). Allele-specific ChIP-seq of shATRX MEFs showed loss of enriched signals at Xist (FIG. 11D), confirming the specificity of the ATRX ChIP-seq analysis. ATRX enrichment at Xist was developmentally specific, being absent in pre-XCI ESC and present in post-XCI MEF. Furthermore, enrichment was observed only on the Xi (mus, FIG. 5E). However, ATRX coverage across Xi alleles was not enriched relative to the genomic average (FIG. 5G, representative Chr13 shown; KS test, P=1). Nor was ATRX coverage different on average between two classes of Xi genes—those expressed on Xa versus those that are silent (FIG. 5H; KS test, P=0.8031), indicating that ATRX was no more enriched on X-genes that are expressed in MEFs. Furthermore, ATRX coverage in genes that escape XCI was not significantly different between Xa and Xi (FIG. 5I, purple dots; KS test, P=0.75).

Figure 5J:
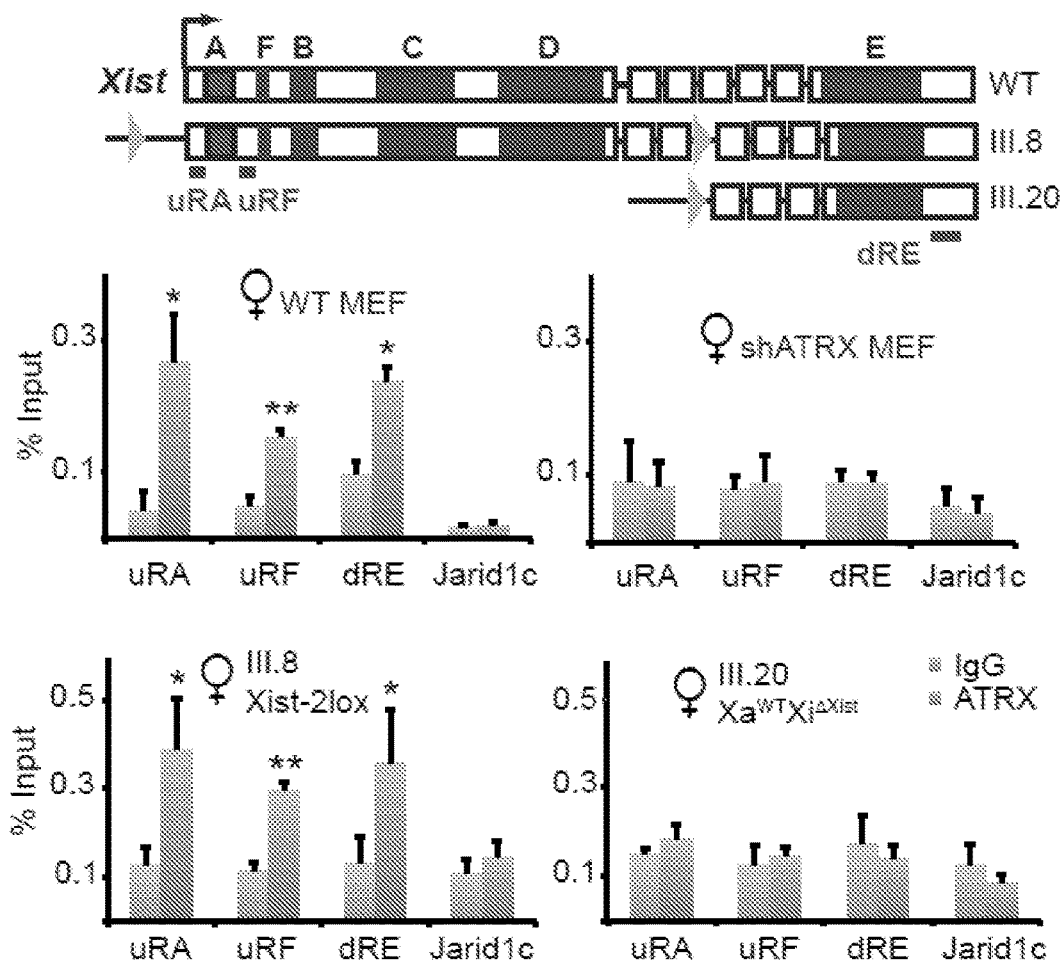
Figure 5K:
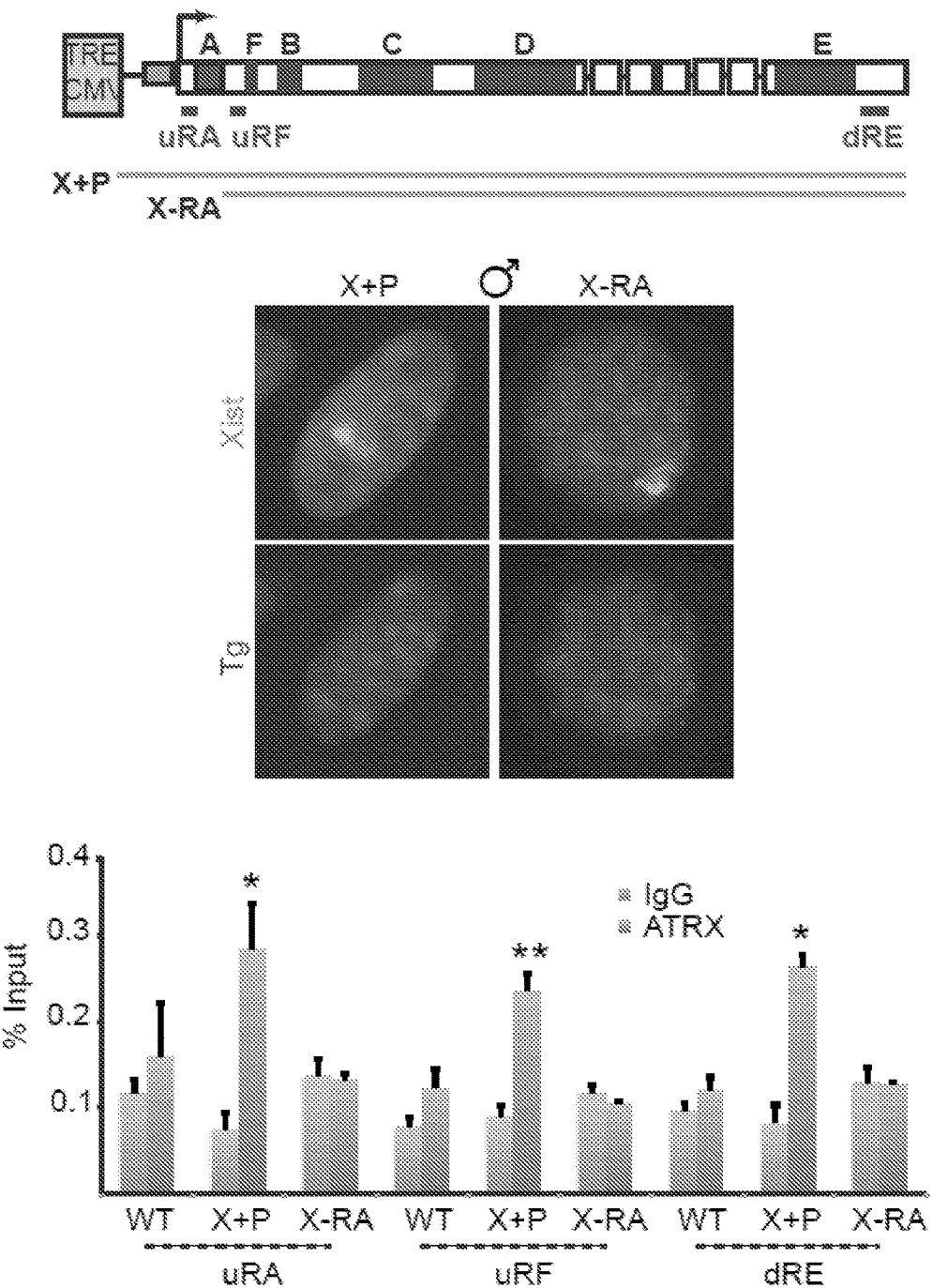
Figures 5L, 6A:
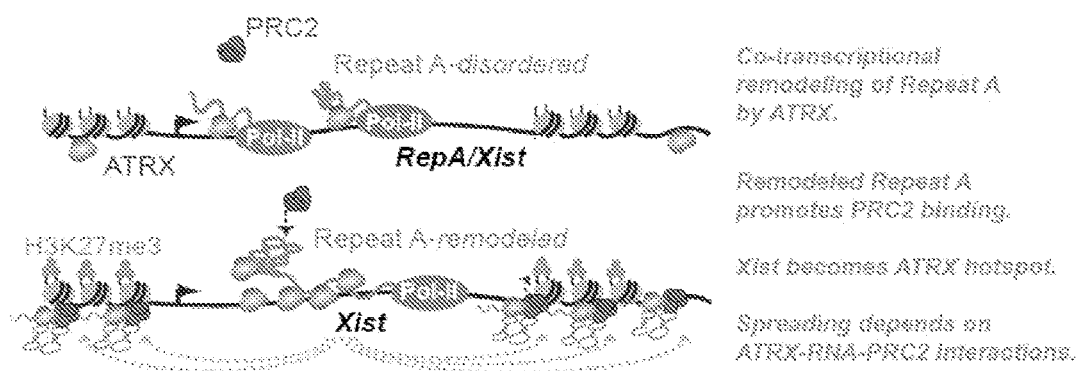

ChIP-qPCR confirmed that, in WT female MEFs, ATRX was significantly enriched (relative to IgG pulldowns) within the Xist gene regardless of what positions were queried (FIG. 5J). By contrast, Jarid1c—an X-linked gene that escapes XCI did not show significant ATRX enrichment. Enrichment at all Xist positions, including the nucleation center (uRF) was lost upon ATRX KD (FIG. 5J). ChIP-qPCR also verified the allele-specific nature of ATRX localization. The MEF line, $Xa^{WT} Xi^{2lox}$ (clone 111.8), carried two loxP sites flanking a 16 kb Xist sequence on the Xi, whereas $Xa^{WT}$ $Xi^{\Delta Xist}$ (clone 111.20) carried a 16 kb conditional deletion of Xist on the Xi (Zhang et al., 2007). ATRX was significantly enriched at Xist only in the $Xa^{WT}$ $Xi^{2lox}$, the cell line bearing an intact Xist gene on the Xi (FIG. 5J). Given that ATRX-RNA interactions are mediated by Repeat A RNA (FIG. 1-4), we asked whether the localization of ATRX to the chromatin hotspot depended on Repeat A DNA. In the Xist transgene model, ChIP-qPCR showed that, while deleting Repeat A (X-RA) did not affect spreading of Xist RNA along the chromosome as shown by RNA FISH (FIG. 5K, top panels)(Jeon and Lee, 2011), it abolished ATRX localization to the Xist locus (FIG. 5K, bottom graph). Repeat A is therefore essential for ATRX-Xist chromatin interactions in vivo.

We conclude that the Xi allele of Xist is a hotspot of ATRX binding. These data lead to a model in which ATRX binds the Repeat A motif and reconfigures the RepA/Xist transcript to promote PRC2 binding (FIG. 5L), with poising of ATRX at the Repeat A DNA potentially aiding ATRX-RNA interactions. Following nucleation at the Xist hotspot, the ATRX-RNA-PRC2 ternary complex spreads outwardly along the Xi.

Example 5. ATRX-Dependent Recruitment of PRC2 on a Global Scale

Figure 6B:
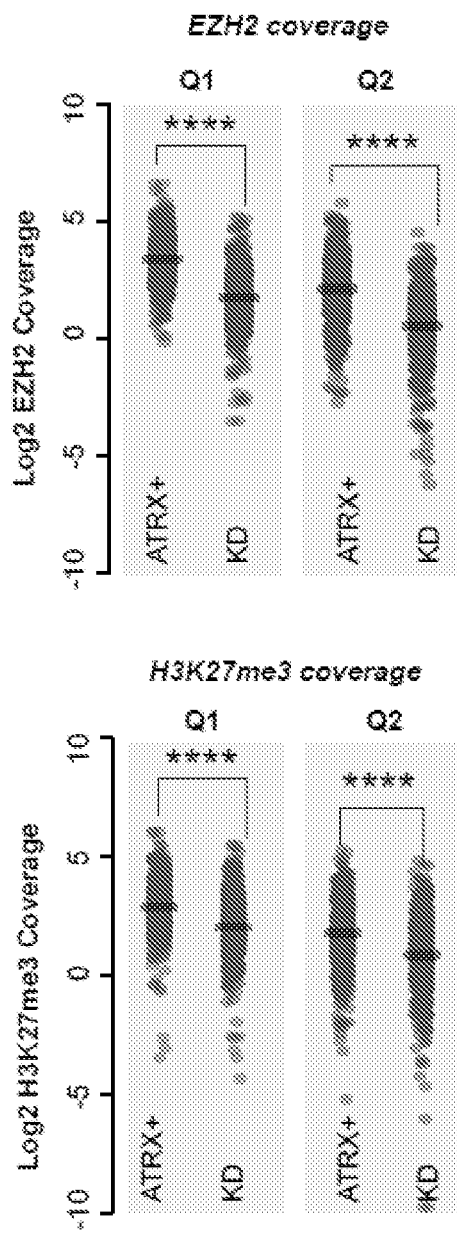
Figure 6C:
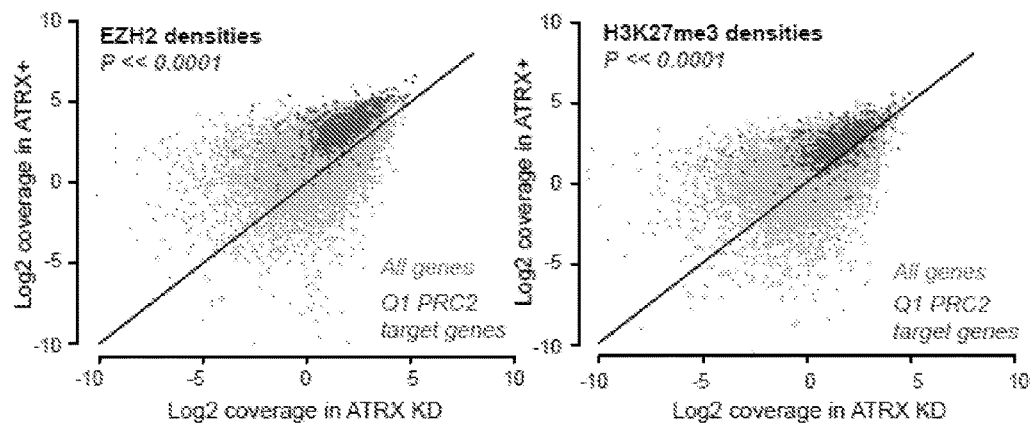
Figure 6D:
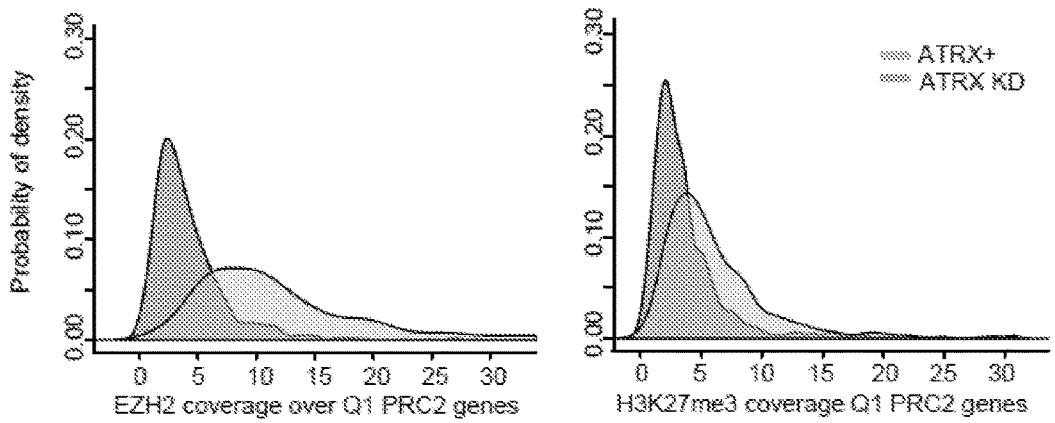
Figure 6E:
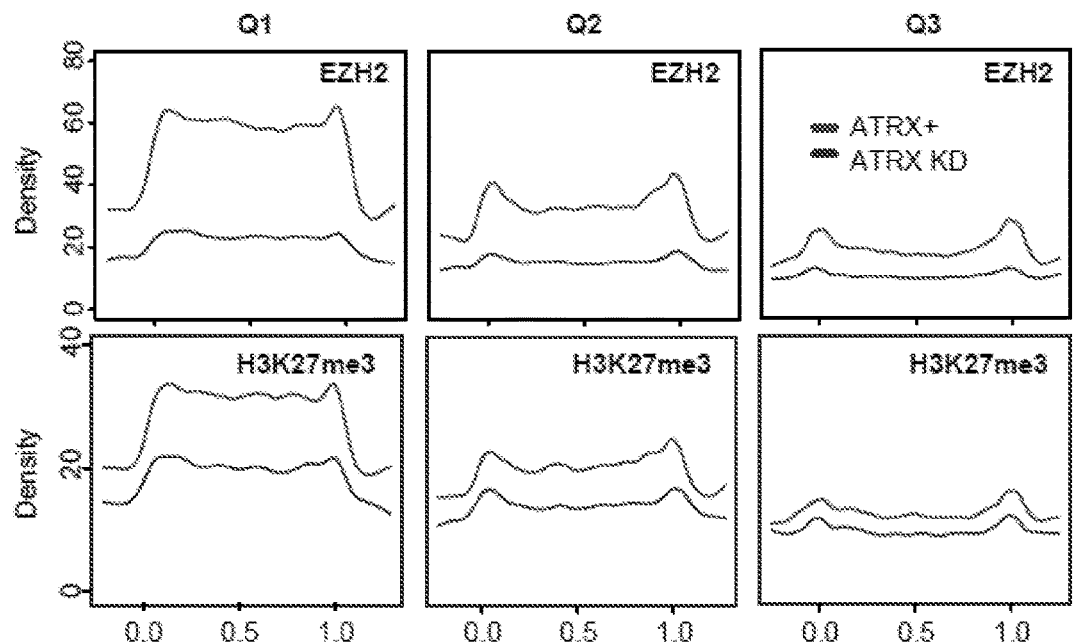

We next investigated whether ATRX's effect on PRC2 localization extended beyond the Xi. We classified 21,677 annotated unique RefSeq genes into equal quartiles (Q1-Q4) based on ATRX coverage (FIG. 6A; Tables 4, 5), with Q1 having high positive ATRX coverage and Q2 moderate coverage. Interestingly, Q1 and Q2 harbored a large number of PRC2 target genes, together accounting for 63% of all autosomal PRC2 target genes. By contrast, Q3 and Q4 had near-zero or negative ATRX coverage and harbored fewer PRC2 target genes. To determine whether loss of ATRX affected PRC2 recruitment to genes marked by ATRX binding, we compared EZH2 and H3K27me3 coverages in ATRX+ versus ATRX-deficient cells (FIG. 6B). Indeed, ATRX KD affected PRC2 localization and function, with the 2- to 4-fold drop in EZH2 and H3K27me3 coverages being highly significant (FIG. 6B). Scatterplots showed an obvious shift in EZH2 and H3K27me3 coverage for Q1 PRC2 targets (FIG. 6C, purple dots; Table SI). We also examined probability density functions for EZH2 and H3K27me3 to determine the likelihood that a given gene in ATRX-deficient cells will have decreased EZH2 and H3K27me3 coverage based on the population behavior of ATRX-PRC2 target genes (FIG. 6D). The distribution for ATRX KD is left- and upwardly shifted, indicating that the probability of a target gene in ATRX KD having a low EZH2 (or H3K27me3) coverage is greater than that of the same gene in ATRX+. To examine how EZH2 and H3K27me3 patterns change within gene bodies, we performed metagene analysis (FIG. 6E). In ATRX+, EZH2 and H3K27me3 patterns showed characteristic gene-body enrichment. Upon ATRX KD, EZH2 and H3K27me3 densities dramatically decreased in Q1 and Q2 genes, with decrease occurring at TSS's and within gene bodies. Minimal changes were observed for Q3 and Q4 genes (FIG. 6E and data not shown). Analysis of biological replicates showed good reproducibility (FIG. 12A-B, data not shown). Collectively, these data demonstrate that ATRX is also required to target PRC2 to autosomal genes.

Figure 6F:
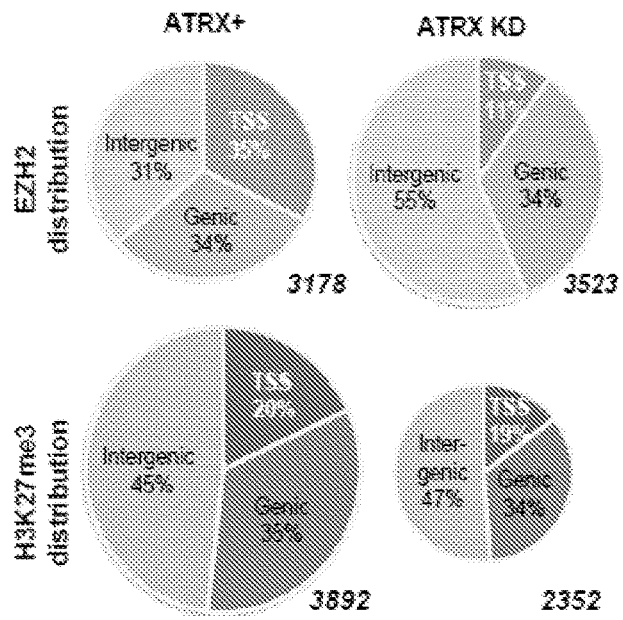

Given the loss of PRC2 from genic regions upon ATRX KD, we asked whether PRC2 became ectopically localized elsewhere. Examination of global EZH2 and H3K27me3 ChIP-seq patterns revealed an intriguing shift to intergenic space (FIG. 6F). In ATRX+, EZH2 was bound to 3178 sites, roughly distributed equally among gene bodies, promoters, and intergenic space. On the other hand, in ATRX KD, EZH2 shifted away from promoters and expanded into intergenic space. Thus, ATRX is required to specify PRC2 localization to genes in general.

Figure 6G:
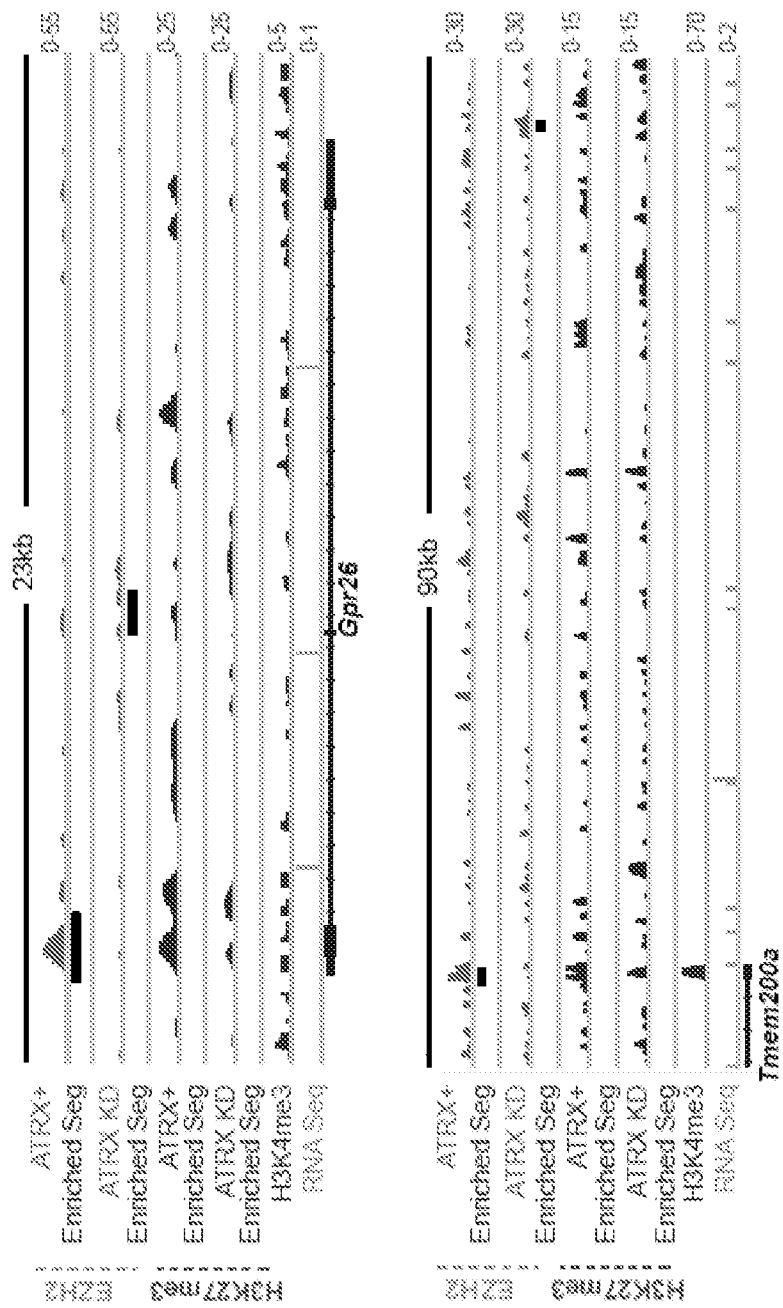

Curiously, the distribution pattern for H3K27me3 peaks did not change in ATRX-depleted cells, as the percentages occurring in TSS, gene bodies, and intergenic space remained the same (FIG. 6F, purple pie charts). At the same time, bulk H3K27me3 levels also did not change on ATRX KD in MEFs and ES cells (FIG. 2G and data not shown). In spite of unchanged overall levels of H3K27me3 and genomic ChIP-seq density, there was an apparent loss of H3K27me3 peaks in many regions (FIG. 6F). Combined, these observations suggest a significant change in H3K27me3 patterns concurrent with mistargeting of PRC2. At the Polycomb target, Gpr26, loss of ATRX resulted in loss of EZH2 binding to the promoter and a relative reduction in H3K27me3 across the gene body (FIG. 6G). At Tmem200a, loss of EZH2 binding at the promoter was accompanied by a new EZH2-binding site ~70 kb upstream in intergenic space. However, in spite of the newly acquired EZH2 site, H3K27me3 densities were not increased in the intergenic region. Altogether, these data demonstrate that loss of ATRX function causes improper PRC2 targeting, shifting bulk PRC2 to ectopic intergenic space where chaotic or unstable PRC2 accumulation results in decreased selectivity of H3K27 methylation. We conclude that ATRX is a specificity determinant for PRC2 localization and function.

Figure 7A:
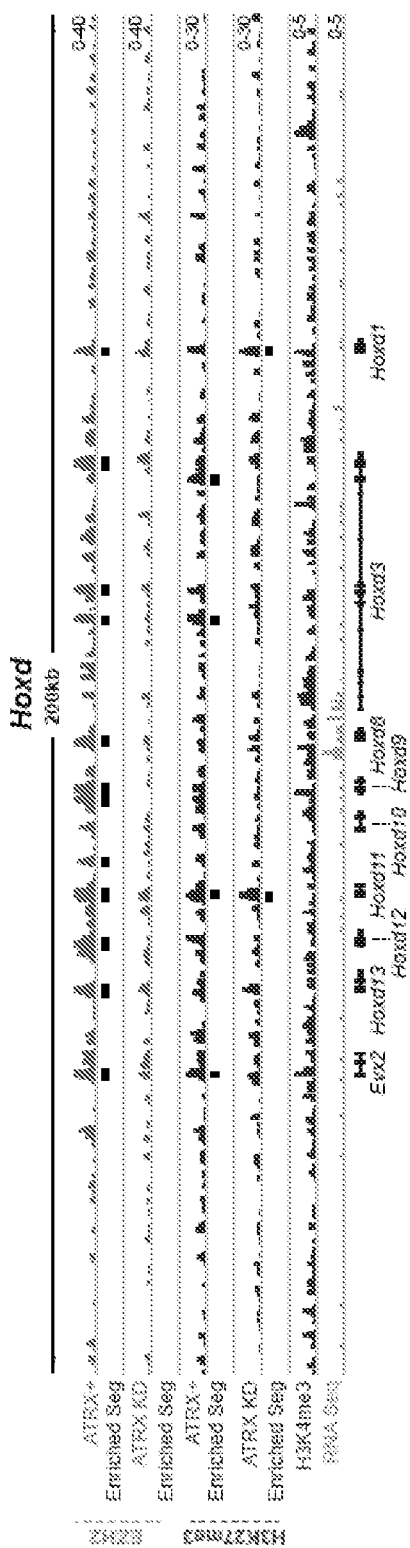
Figure 7B:
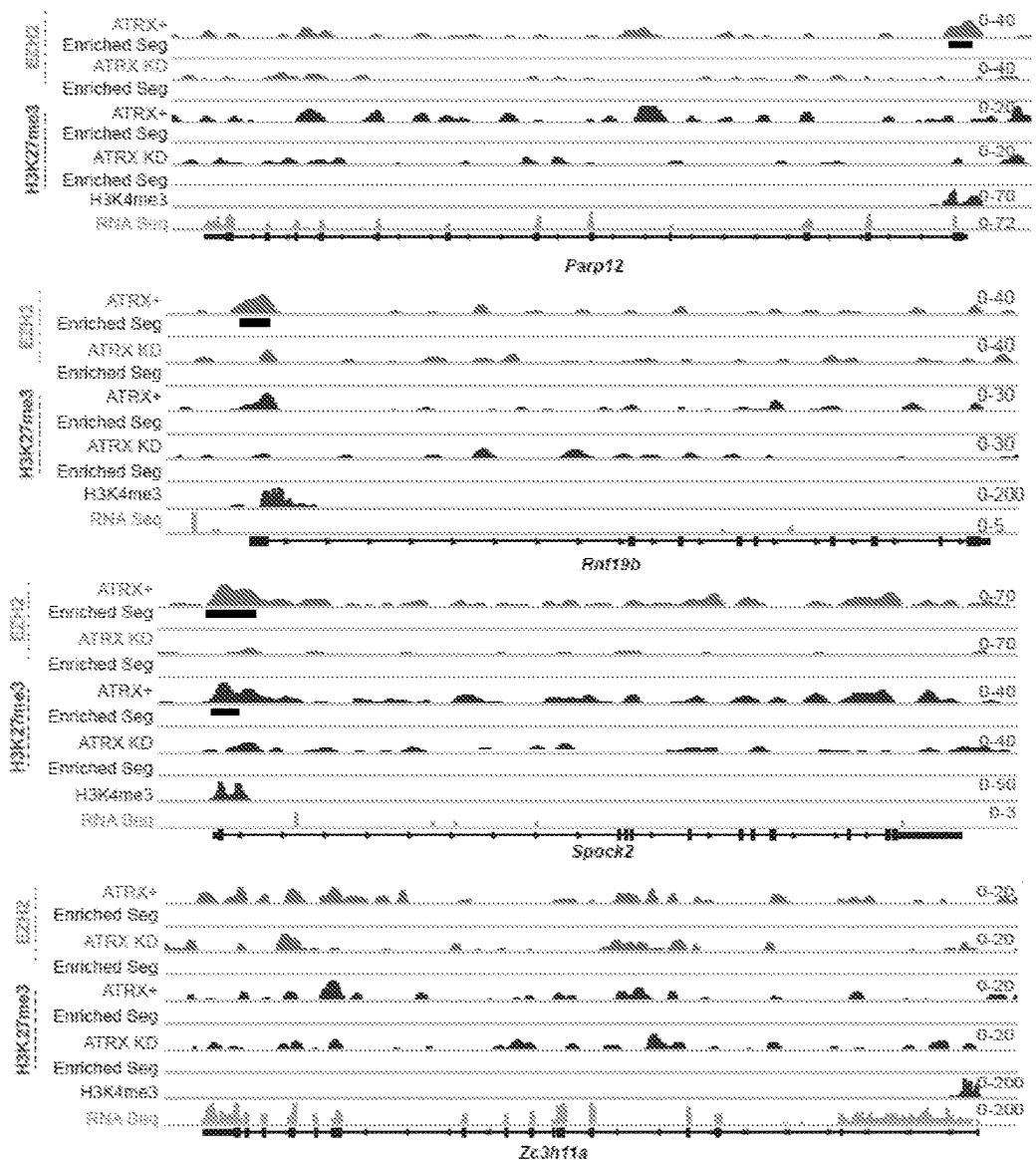
Figure 7C:
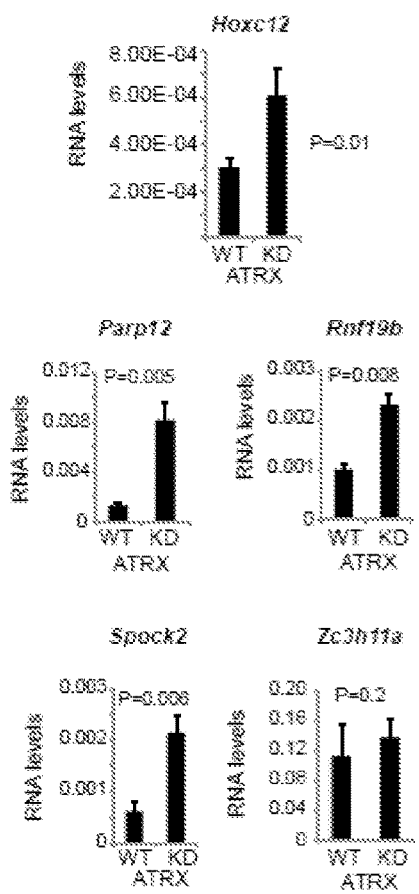
Figure 7D:
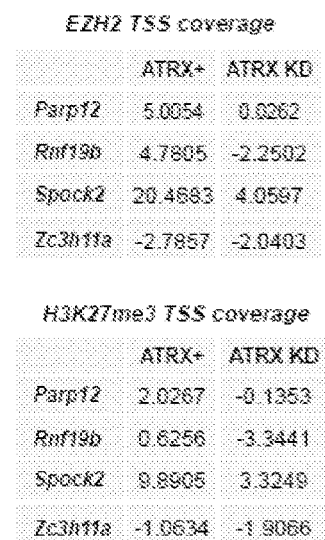
Figure 7E:
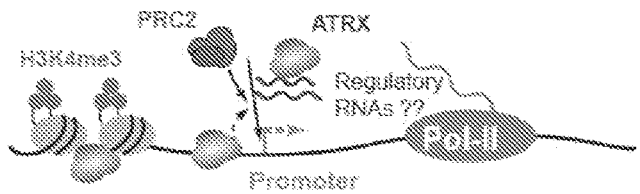
Figure 13A:
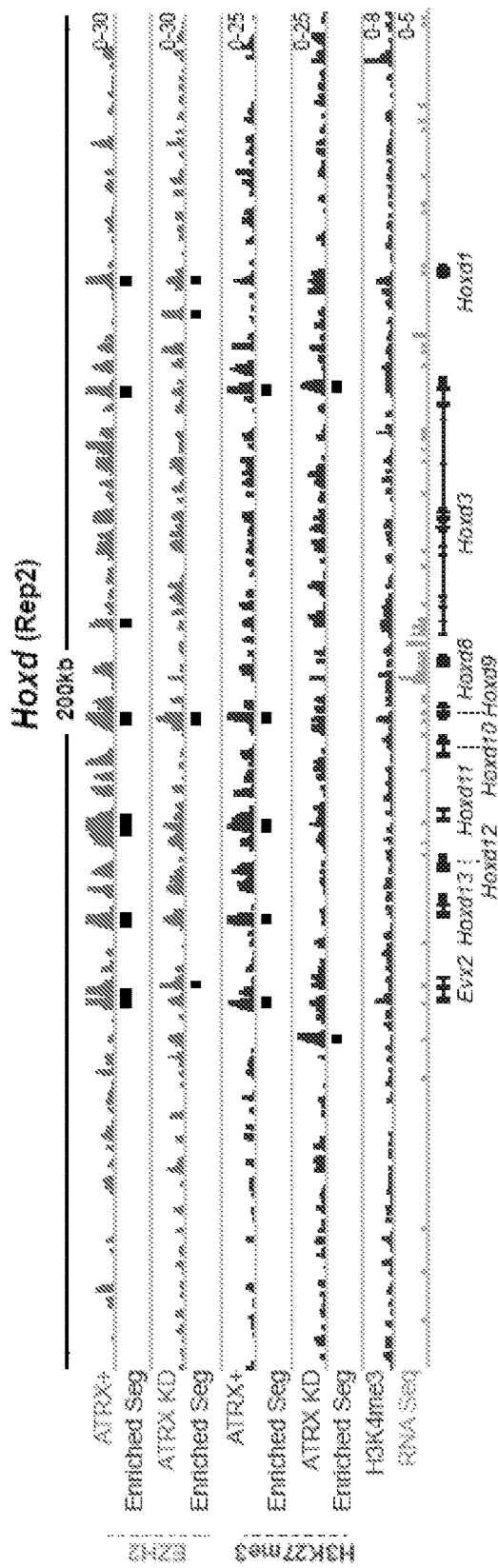
Figure 13B:
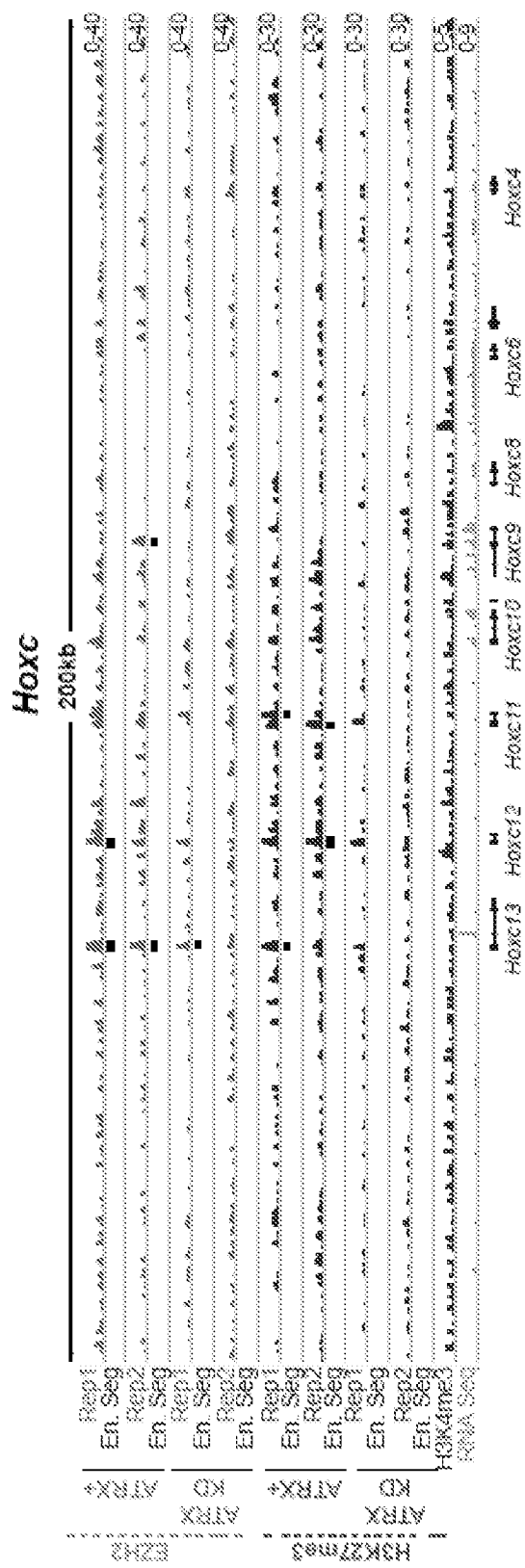
Figure 13C:
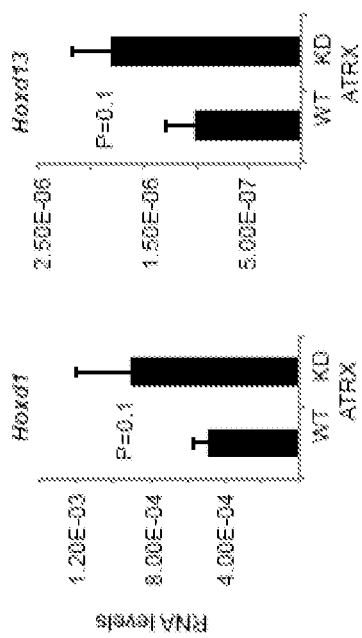
Figure 13D:
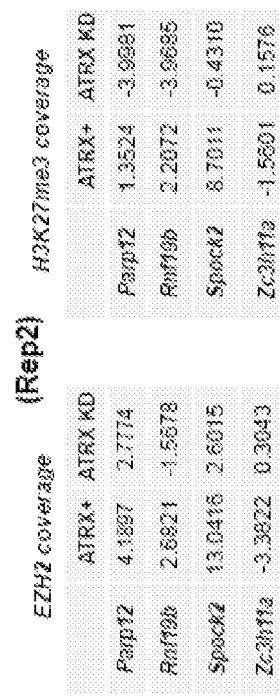

To determine whether failure of PRC2 targeting results in gene expression changes, we tested specific Polycomb targets (FIG. 7A,B; 13A,B). Within the Hoxc and Hoxd clusters, EZH2 and H3K27me3 were highly enriched in ATRX+ MEFs. Upon ATRX KD, EZH2 and H3K27me3 levels were significantly reduced, as evidenced by both decreased peak numbers as well as overall coverages across the locus. Quantitative RT-PCR analysis revealed concomitant gene upregulation (FIG. 7C, 13C). At Parp12, Rnf19b, and Spock2, EZH2 bound the TSS region in ATRX+ cells (FIG. 7B). On ATRX KD, EZH2 and H3K27me3 were consistently lost at the promoters (FIG. 7B,D; biological replicate shown in FIG. 13D) and gene expression increased 2- to 5-fold at all loci (FIG. 7C). In contrast, expression of Zc3 h11a—a control that is not a Polycomb target—did not change significantly after ATRX KD. We conclude that ATRX plays a global role in gene regulation by controlling PRC2 localization.

Example 7. Human ATRX Genomic Localization Sites

The ATRX peaks in the mm9 mouse assembly coordinates were converted to human coordinates using Galaxy Server's LiftOver utility (The liftOver utility effectively maps one genome to another, allowing rapid identification of regions of interest between successive assemblies of the same species or between two distinct species; available online at usegalaxy.org). This tool is based in the Liftover utility from the UC Santa Cruz Genome Browser. Mouse-to-human LiftOver of the mouse chromosome coordinates and strand of these mouse Peaks was performed in the Galaxy server to generate orthologous human chromosome coordinates. The parameters used were "0.1 minimum ratio of bases that must remap" from mm9 to Hg19 as is the default for the program when performing a Liftover between different species. This process and LiftOver chains are generally described in Kent et al., Proc. Nat'l Acad. Sci., 100(20) 11484-11489 (2003).

REFERENCES

Baumann, C., and De La Fuente, R. (2009). ATRX marks the inactive X chromosome (Xi) in somatic cells and during imprinted X chromosome inactivation in trophoblast stem cells. Chromosoma 118, 209-222.

Brown, C. J., Hendrich, B. D., Rupert, J. L., Lafreniere, R. G., Xing, Y., Lawrence, J., and Willard, H. F. (1992). The human XIST gene: analysis of a 17 kb inactive X-specific RNA that contains conserved repeats and is highly localized within the nucleus. Cell 71, 527-542.

Cardoso, C., Timsit, S., Villard, L., Khrestchatisky, M., Fontes, M., and Colleaux, L. (1998). Specific interaction between the XNP/ATR-X gene product and the SET domain of the human EZH2 protein. Human molecular genetics 7, 679-684.

Chadwick, B. P., and Willard, H. F. (2004). Multiple spatially distinct types of facultative heterochromatin on the human inactive X chromosome. Proceedings of the National Academy of Sciences of the United States of America 101, 17450-17455. Cifuentes-Rojas, C., Hernandez, A. J., Sarma, K., and Lee, J. T. (2014). Regulatory Interactions between RNA and Polycomb Repressive Complex 2. Molecular cell.

Clemson, C. M., McNeil, J. A., Willard, H. F., and Lawrence, J. B. (1996). XIST RNA paints the inactive X chromosome at interphase: evidence for a novel RNA involved in nuclear/chromosome structure. The Journal of cell biology 132, 259-275.

Clynes, D., Higgs, D. R., and Gibbons, R. J. (2013). The chromatin remodeller ATRX: a repeat offender in human disease. Trends in biochemical sciences 38, 461-466.

Costanzi, C., and Pehrson, J. R. (1998). Histone macroH2A1 is concentrated in the inactive X chromosome of female mammals. Nature 393, 599-601.

Curran, T. G., Bryson, B. D., Reigelhaupt, M., Johnson, H., and White, F. M. (2013). Computer aided manual validation of mass spectrometry-based proteomic data. Methods 61, 219-226.

da Rocha, S. T., Boeva, V., Escamilla-Del-Arenal, M., Ancelin, K., Granier, C., Matias, N. R., Sanulli, S., Chow, J., Schulz, E., Picard, C., et al. (2014). Jarid2 Is Implicated in the Initial Xist-Induced Targeting of PRC2 to the Inactive X Chromosome. Molecular cell 53, 301-316.

Davidovich, C., Zheng, L., Goodrich, K. J., and Cech, T. R. (2013). Promiscuous RNA binding by Polycomb repressive complex 2. Nature structural & molecular biology 20, 1250-1257.

Dhayalan, A., Tamas, R., Bock, I., Tattermusch, A., Dimitrova, E., Kudithipudi, S., Ragozin, S., and Jeltsch, A. (2011). The ATRX-ADD domain binds to H3 tail peptides and reads the combined methylation state of K4 and K9. Human molecular genetics 20, 2195-2203.

Dupont, C., and Gribnau, J. (2013). Different flavors of X-chromosome inactivation in mammals. Current opinion in cell biology 25, 314-321.

Duszczyk, M. M., Wutz, A., Rybin, V., and Sattler, M. (2011). The Xist RNA A-repeat comprises a novel AUCG tetraloop fold and a platform for multimerization. RNA 17, 1973-1982.

Eustermann, S., Yang, J. C., Law, M. J., Amos, R., Chapman, L. M., Jelinska, C., Garrick, D., Clynes, D., Gibbons, R. J., Rhodes, D., et al. (2011). Combinatorial readout of histone H3 modifications specifies localization of ATRX to heterochromatin. Nature structural & molecular biology 18, 777-782.

Garrick, D., Sharpe, J. A., Arkell, R., Dobbie, L., Smith, A. J., Wood, W. G., Higgs, D. R., and Gibbons, R. J. (2006). Loss of Atrx affects trophoblast development and the pattern of X-inactivation in extraembryonic tissues. PLoS genetics 2, e58.

Gibbons, R. J., Wada, T., Fisher, C. A., Malik, N., Mitson, M. J., Steensma, D. P., Fryer, A., Goudie, D. R., Krantz, I. D., and Traeger-Synodinos, J. (2008). Mutations in the chromatin-associated protein ATRX. Human mutation 29, 796-802.

Goldberg, A. D., Banaszynski, L. A., Noh, K. M., Lewis, P. W., Elsaesser, S. J., Stadler, S., Dewell, S., Law, M., Guo, X., Li, X., et al. (2010). Distinct factors control histone variant H3.3 localization at specific genomic regions. Cell 140, 678-691.

Helin, K., and Dhanak, D. (2013). Chromatin proteins and modifications as drug targets. Nature 502, 480-488.

Hernandez, A., Panigrahi, A., Cifuentes-Rojas, C., Sacharidou, A., Stuart, K., and Cruz-Reyes, J. (2008). Determinants for association and guide RNA-directed endonuclease cleavage by purified RNA editing complexes from *Trypanosoma brucei*. Journal of molecular biology 381, 35-48.

Hoki, Y., Kimura, N., Kanbayashi, M., Amakawa, Y., Ohhata, T., Sasaki, H., and Sado, T. (2009). A proximal conserved repeat in the Xist gene is essential as a genomic element for X-inactivation in mouse. Development 136, 139-146.

Ilik, I. A., Quinn, J. J., Georgiev, P., Tavares-Cadete, F., Maticzka, D., Toscano, S., Wan, Y., Spitale, R. C., Luscombe, N., Backofen, R., et al. (2013). Tandem stem-loops in roX RNAs act together to mediate X chromosome dosage compensation in *Drosophila*. Molecular cell 51, 156-173.

Iwase, S., Xiang, B., Ghosh, S., Ren, T., Lewis, P. W., Cochrane, J. C., Allis, C. D., Picketts, D. J., Patel, D. J., Li, H., et al. (2011). ATRX ADD domain links an atypical histone methylation recognition mechanism to human mental-retardation syndrome. Nature structural & molecular biology 18, 769-776.

Jeon, Y., and Lee, J. T. (2011). YY1 tethers Xist RNA to the inactive X nucleation center. Cell 146, 119-133.

Johnson, H., Del Rosario, A. M., Bryson, B. D., Schroeder, M. A., Sarkaria, J. N., and White, F. M. (2012). Molecular characterization of EGFR and EGFRvIII signaling networks in human glioblastoma tumor xenografts. Molecular & cellular proteomics: MCP 11, 1724-1740.

Kaneko, S., Bonasio, R., Saldana-Meyer, R., Yoshida, T., Son, J., Nishino, K., Umezawa, A., and Reinberg, D. (2014). Interactions between JARID2 and noncoding RNAs regulate PRC2 recruitment to chromatin. Molecular cell 53, 290-300. Kaneko, S., Son, J., Shen, S. S., Reinberg, D., and Bonasio, R. (2013). PRC2 binds active promoters and contacts nascent RNAs in embryonic stem cells. Nature structural & molecular biology 20, 1258-1264.

Kanhere, A., Viiri, K., Araujo, C. C., Rasaiyaah, J., Bouwman, R. D., Whyte, W. A., Pereira, C. F., Brookes, E., Walker, K., Bell, G. W., et al. (2010). Short RNAs Are Transcribed from Repressed Polycomb Target Genes and Interact with Polycomb Repressive Complex-2. Molecular cell 38, 675-688.

Khalil, A. M., Guttman, M., Huarte, M., Garber, M., Raj, A., Rivea Morales, D., Thomas, K., Presser, A., Bernstein, B.

E., van Oudenaarden, A., et al. (2009). Many human large intergenic noncoding RNAs associate with chromatin-modifying complexes and affect gene expression. Proceedings of the National Academy of Sciences of the United States of America.

Kharchenko, P. V., Tolstorukov, M. Y., and Park, P. J. (2008). Design and analysis of ChIP-seq experiments for DNA-binding proteins. Nature biotechnology 26, 1351-1359.

Law, M. J., Lower, K. M., Voon, H. P., Hughes, J. R., Garrick, D., Viprakasit, V., Mitson, M., De Gobbi, M., Marra, M., Morris, A., et al. (2010). ATR-X syndrome protein targets tandem repeats and influences allele-specific expression in a size-dependent manner. Cell 143, 367-378.

Lee, J. T. (2012). Epigenetic regulation by long noncoding RNAs. Science 338, 1435-1439.

Lee, J. T., and Bartolomei, M. S. (2013). X-inactivation, imprinting, and long noncoding RNAs in health and disease. Cell 152, 1308-1323.

Lee, J. T., Davidow, L. S., and Warshawsky, D. (1999). Tsix, a gene antisense to Xist at the X-inactivation centre. Nature genetics 21, 400-404.

Lewis, P. W., Elsaesser, S. J., Noh, K. M., Stadler, S. C., and Allis, C. D. (2010). Daxx is an H3.3-specific histone chaperone and cooperates with ATRX in replication-independent chromatin assembly at telomeres. Proceedings of the National Academy of Sciences of the United States of America 107, 14075-14080.

Maenner, S., Blaud, M., Fouillen, L., Savoye, A., Marchand, V., Dubois, A., Sanglier-Cianferani, S., Van Dorsselaer, A., Clerc, P., Avner, P., et al. (2010). 2-D structure of the A region of Xist RNA and its implication for PRC2 association. PLoS biology 8, e1000276.

Maenner, S., Muller, M., Frohlich, J., Langer, D., and Becker, P. B. (2013). ATP-dependent roX RNA remodeling by the helicase maleless enables specific association of MSL proteins. Molecular cell 51, 174-184.

Mitson, M., Kelley, L. A., Sternberg, M. J., Higgs, D. R., and Gibbons, R. J. (2011). Functional significance of mutations in the Snf2 domain of ATRX. Human molecular genetics 20, 2603-2610.

Muller, J., and Verrijzer, P. (2009). Biochemical mechanisms of gene regulation by polycomb group protein complexes. Current opinion in genetics & development 19, 150-158.

Nusinow, D. A., Hernandez-Munoz, I., Fazzio, T. G., Shah, G. M., Kraus, W. L., and Panning, B. (2007). Poly(ADP-ribose) polymerase 1 is inhibited by a histone H2A variant, MacroH2A, and contributes to silencing of the inactive X chromosome. The Journal of biological chemistry 282, 12851-12859.

Ogawa, Y., Sun, B. K., and Lee, J. T. (2008). Intersection of the RNA interference and X-inactivation pathways. Science 320, 1336-1341.

Pinter, S. F., Sadreyev, R. I., Yildirim, E., Jeon, Y., Ohsumi, T. K., Borowsky, M., and Lee, J. T. (2012). Spreading of X chromosome inactivation via a hierarchy of defined Polycomb stations. Genome research 22, 1864-1876.

Ratnakumar, K., and Bernstein, E. (2013). ATRX: the case of a peculiar chromatin remodeler. Epigenetics: official journal of the DNA Methylation Society 8, 3-9.

Simon, J. A., and Kingston, R. E. (2013). Occupying chromatin: Polycomb mechanisms for getting to genomic targets, stopping transcriptional traffic, and staying put. Molecular cell 49, 808-824.

Simon, M. D., Pinter, S. F., Fang, R., Sarma, K., Rutenberg-Schoenberg, M., Bowman, S. K., Kesner, B. A., Maier, V. K., Kingston, R. E., and Lee, J. T. (2013). High-resolution Xist binding maps reveal two-step spreading during X-chromosome inactivation. Nature 504, 465-469.

Starmer, J., and Magnuson, T. (2009). A new model for random X chromosome inactivation. Development 136, 1-10.

Sun, B. K., Deaton, A. M., and Lee, J. T. (2006). A transient heterochromatic state in Xist preempts X inactivation choice without RNA stabilization. Molecular cell 21, 617-628.

Sun, S., Del Rosario, B. C., Szanto, A., Ogawa, Y., Jeon, Y., and Lee, J. T. (2013). Jpx RNA activates Xist by evicting CTCF. Cell 153, 1537-1551.

Tang, J., Wu, S., Liu, H., Stratt, R., Barak, O. G., Shiekhattar, R., Picketts, D. J., and Yang, X. (2004). A novel transcription regulatory complex containing death domain-associated protein and the ATR-X syndrome protein. The Journal of biological chemistry 279, 20369-20377.

Tian, D., Sun, S., and Lee, J. T. (2010). The long noncoding RNA, Jpx, is a molecular switch for X chromosome inactivation. Cell 143, 390-403.

Wilker, E. W., van Vugt, M. A., Artim, S. A., Huang, P. H., Petersen, C. P., Reinhardt, H. C., Feng, Y., Sharp, P. A., Sonenberg, N., White, F. M., et al. (2007). 14-3-3sigma controls mitotic translation to facilitate cytokinesis. Nature 446, 329-332.

Wutz, A. (2011). Gene silencing in X-chromosome inactivation: advances in understanding facultative heterochromatin formation. Nat Rev Genet 12, 542-553.

Wutz, A., Rasmussen, T. P., and Jaenisch, R. (2002). Chromosomal silencing and localization are mediated by different domains of Xist RNA. Nature genetics 30, 167-174.

Xue, Y., Gibbons, R., Yan, Z., Yang, D., McDowell, T. L., Sechi, S., Qin, J., Zhou, S., Higgs, D., and Wang, W. (2003). The ATRX syndrome protein forms a chromatin-remodeling complex with Daxx and localizes in promyelocytic leukemia nuclear bodies. Proceedings of the National Academy of Sciences of the United States of America 100, 10635-10640.

Yang, F., Babak, T., Shendure, J., and Disteche, C. M. (2010). Global survey of escape from X inactivation by RNA-sequencing in mouse. Genome research 20, 614-622.

Yildirim, E., Sadreyev, R. I., Pinter, S. F., and Lee, J. T. (2012). X-chromosome hyperactivation in mammals via nonlinear relationships between chromatin states and transcription. Nature structural & molecular biology 19, 56-61.

Zhang, L. F., Huynh, K. D., and Lee, J. T. (2007). Perinucleolar targeting of the inactive X during S phase: evidence for a role in the maintenance of silencing. Cell 129, 693-706.

Zhao, J., Ohsumi, T. K., Kung, J. T., Ogawa, Y., Grau, D. J., Sarma, K., Song, J. J., Kingston, R. E., Borowsky, M., and Lee, J. T. (2010). Genome-wide identification of polycomb-associated RNAs by RIP-seq. Molecular cell 40, 939-953.

Zhao, J., Sun, B. K., Erwin, J. A., Song, J. J., and Lee, J. T. (2008). Polycomb proteins targeted by a short repeat RNA to the mouse X chromosome. Science 322, 750-756.

TABLE 1

| chromosome | start | stop | strand | nearest gene | ID |
|---|---|---|---|---|---|
| 1 | 3984200 | 3985200 | + | int | 1 |
| 1 | 4048800 | 4050200 | + | int | 2 |
| 1 | 4837600 | 4839000 | + | int | 3 |
| 1 | 4946800 | 4947800 | − | Rgs20 | 4 |
| 1 | 4946800 | 4947800 | − | Rgs20 | 5 |
| 1 | 5096200 | 5097400 | + | Atp6v1h | 6 |
| 1 | 5347000 | 5348600 | + | int | 7 |
| 1 | 5953600 | 5955000 | + | int | 8 |
| 1 | 6010600 | 6011600 | + | int | 9 |
| 1 | 6712600 | 6713600 | + | int | 10 |
| 1 | 7165200 | 7166200 | + | int | 11 |
| 1 | 8145200 | 8146400 | + | int | 12 |
| 1 | 8846000 | 8847000 | − | Sntg1 | 13 |
| 1 | 9017600 | 9018600 | − | Sntg1 | 14 |
| 1 | 9171800 | 9172800 | − | Sntg1 | 15 |
| 1 | 9182000 | 9183000 | − | Sntg1 | 16 |
| 1 | 9431800 | 9433000 | + | int | 17 |
| 1 | 9504600 | 9506000 | + | int | 18 |
| 1 | 9568400 | 9569400 | − | 2610203C22Rik | 19 |
| 1 | 9711800 | 9713200 | + | int | 20 |
| 1 | 12136200 | 12137200 | + | int | 21 |
| 1 | 12151100 | 12152100 | + | int | 22 |
| 1 | 12348200 | 12349200 | + | int | 23 |
| 1 | 12665000 | 12666000 | + | int | 24 |
| 1 | 13447200 | 13448200 | + | int | 25 |
| 1 | 13609600 | 13610200 | + | int | 26 |
| 1 | 13675800 | 13676800 | + | Xkr9 | 27 |
| 1 | 16761800 | 16762800 | + | int | 28 |
| 1 | 16900600 | 16901600 | + | int | 29 |
| 1 | 17350400 | 17351400 | + | int | 30 |
| 1 | 17505400 | 17506400 | + | int | 31 |
| 1 | 17510600 | 17511600 | + | int | 32 |
| 1 | 17666400 | 17667400 | + | int | 33 |
| 1 | 17786400 | 17787600 | + | int | 34 |
| 1 | 18033000 | 18034000 | + | int | 35 |
| 1 | 18265000 | 18266200 | + | int | 36 |
| 1 | 18790600 | 18791600 | + | int | 37 |
| 1 | 18812200 | 18813600 | + | int | 38 |
| 1 | 19122900 | 19123800 | + | Tcfap2d | 39 |
| 1 | 19285000 | 19286200 | + | int | 40 |
| 1 | 19351000 | 19352000 | + | int | 41 |
| 1 | 20046400 | 20047400 | + | int | 42 |
| 1 | 20121200 | 20122200 | − | Pkhd1 | 43 |
| 1 | 20571800 | 20572800 | − | Pkhd1 | 44 |
| 1 | 20932200 | 20933400 | + | int | 45 |
| 1 | 21492600 | 21493800 | − | Kcnq5 | 46 |
| 1 | 22013800 | 22014400 | + | int | 47 |
| 1 | 22680000 | 22681000 | − | Rims1 | 48 |
| 1 | 22854000 | 22855000 | + | int | 49 |
| 1 | 23704000 | 23705200 | + | int | 50 |
| 1 | 24429800 | 24430800 | − | Col19a1 | 51 |
| 1 | 25036800 | 25038000 | + | int | 52 |
| 1 | 25090000 | 25091400 | + | int | 53 |
| 1 | 25194400 | 25195600 | − | Bai3 | 54 |
| 1 | 25517600 | 25518800 | − | Bai3 | 55 |
| 1 | 25687400 | 25688400 | − | Bai3 | 56 |
| 1 | 25732600 | 25733600 | − | Bai3 | 57 |
| 1 | 25944200 | 25945400 | + | int | 58 |
| 1 | 26027800 | 26028400 | + | int | 59 |
| 1 | 26401400 | 26402400 | + | int | 60 |
| 1 | 26623800 | 26625400 | + | int | 61 |
| 1 | 26872200 | 26873200 | + | int | 62 |
| 1 | 26906600 | 26908000 | + | int | 63 |
| 1 | 27433400 | 27434800 | + | int | 64 |
| 1 | 27537400 | 27538800 | + | int | 65 |
| 1 | 27592600 | 27593600 | + | int | 66 |
| 1 | 27597800 | 27599000 | + | int | 67 |
| 1 | 27602600 | 27604400 | + | int | 68 |
| 1 | 27657600 | 27658600 | + | int | 69 |
| 1 | 27663200 | 27664400 | + | int | 70 |
| 1 | 27694200 | 27695200 | + | int | 71 |
| 1 | 27857200 | 27858200 | + | int | 72 |
| 1 | 27957000 | 27958200 | + | int | 73 |
| 1 | 28422400 | 28423400 | + | int | 74 |
| 1 | 28878400 | 28879600 | + | int | 75 |
| 1 | 29610200 | 29611600 | + | int | 76 |
| 1 | 29847800 | 29848800 | + | int | 77 |
| 1 | 29889000 | 29890000 | + | int | 78 |
| 1 | 30060600 | 30062200 | + | int | 79 |
| 1 | 30103800 | 30105000 | + | int | 80 |
| 1 | 30174800 | 30176400 | + | int | 81 |
| 1 | 30373000 | 30374000 | + | int | 82 |
| 1 | 30746200 | 30747800 | + | int | 83 |
| 1 | 31501400 | 31502400 | + | int | 84 |
| 1 | 31683600 | 31684800 | + | int | 85 |
| 1 | 31814600 | 31815600 | + | int | 86 |
| 1 | 31850000 | 31851600 | + | int | 87 |
| 1 | 32473400 | 32474800 | + | Khdrbs2 | 88 |
| 1 | 32614000 | 32615000 | + | Khdrbs2 | 89 |
| 1 | 32852000 | 32853600 | + | int | 90 |
| 1 | 33239000 | 33240400 | + | int | 91 |
| 1 | 33883000 | 33884000 | + | int | 92 |
| 1 | 35496600 | 35497600 | + | int | 93 |
| 1 | 36586400 | 36587600 | − | Ankrd23 | 94 |
| 1 | 40794600 | 40795600 | + | Slc9a2 | 95 |
| 1 | 41579400 | 41581000 | + | int | 96 |
| 1 | 43427600 | 43428600 | + | int | 97 |
| 1 | 44004400 | 44005400 | + | Tpp2 | 98 |
| 1 | 44148400 | 44149600 | − | 1700029F09Rik | 99 |
| 1 | 44207000 | 44208000 | + | Ercc5 | 100 |
| 1 | 44691200 | 44692200 | + | Gulp1 | 101 |
| 1 | 44700800 | 44701800 | + | Gulp1 | 102 |
| 1 | 44811600 | 44812800 | + | Gulp1 | 103 |
| 1 | 44923600 | 44924800 | + | int | 104 |
| 1 | 45034000 | 45035200 | + | int | 105 |
| 1 | 45039800 | 45040800 | + | int | 106 |
| 1 | 45130800 | 45131800 | + | int | 107 |
| 1 | 45283800 | 45285000 | + | int | 108 |
| 1 | 45709600 | 45710800 | + | int | 109 |
| 1 | 45803800 | 45805400 | + | int | 110 |
| 1 | 46892000 | 46893000 | − | Slc39a10 | 111 |
| 1 | 47883800 | 47884800 | + | int | 112 |
| 1 | 48021600 | 48022600 | + | int | 113 |
| 1 | 48066000 | 48067000 | + | int | 114 |
| 1 | 48099200 | 48101000 | + | int | 115 |
| 1 | 48167200 | 48168200 | + | int | 116 |
| 1 | 48622000 | 48623200 | + | int | 117 |
| 1 | 48764800 | 48766000 | + | int | 118 |
| 1 | 48836800 | 48837800 | + | int | 119 |
| 1 | 49156000 | 49157400 | + | int | 120 |
| 1 | 49248000 | 49249200 | + | int | 121 |
| 1 | 49253400 | 49254400 | + | int | 122 |
| 1 | 49284400 | 49285600 | + | int | 123 |
| 1 | 49406000 | 49407000 | + | int | 124 |
| 1 | 49421000 | 49422000 | + | int | 125 |
| 1 | 49549000 | 49550400 | + | int | 126 |
| 1 | 49637800 | 49638800 | + | int | 127 |
| 1 | 49675000 | 49676000 | + | int | 128 |
| 1 | 49930000 | 49931200 | + | int | 129 |
| 1 | 50024200 | 50025800 | + | int | 130 |
| 1 | 50159800 | 50161200 | + | int | 131 |
| 1 | 50300200 | 50301200 | + | int | 132 |
| 1 | 50363000 | 50364400 | + | int | 133 |
| 1 | 50502200 | 50503200 | + | int | 134 |
| 1 | 50751600 | 50752800 | + | int | 135 |
| 1 | 50851600 | 50852600 | + | int | 136 |
| 1 | 51025200 | 51026200 | + | Tmeff2 | 137 |
| 1 | 51217000 | 51218000 | + | Tmeff2 | 138 |
| 1 | 51638600 | 51639800 | + | int | 139 |
| 1 | 51780200 | 51781200 | + | int | 140 |
| 1 | 52048600 | 52049800 | + | int | 141 |
| 1 | 52735600 | 52737000 | − | Mfsd6 | 142 |
| 1 | 52735600 | 52737000 | − | Mfsd6 | 143 |
| 1 | 52834000 | 52835400 | + | int | 144 |
| 1 | 53224000 | 53225200 | − | 1700019A02Rik | 145 |
| 1 | 53305200 | 53306200 | − | Pms1 | 146 |
| 1 | 53431200 | 53432600 | + | int | 147 |
| 1 | 54287000 | 54288000 | + | int | 148 |
| 1 | 55471200 | 55472200 | + | Plcl1 | 149 |
| 1 | 55526000 | 55527600 | + | Plcl1 | 150 |
| 1 | 55744800 | 55746000 | + | Plcl1 | 151 |
| 1 | 55747200 | 55748600 | + | Plcl1 | 152 |
| 1 | 56491600 | 56492600 | + | int | 153 |
| 1 | 56655600 | 56656600 | + | int | 154 |

TABLE 1-continued

| chromosome | start | stop | strand | nearest gene | ID |
|---|---|---|---|---|---|
| 1 | 56838200 | 56840000 | + | int | 155 |
| 1 | 57442400 | 57443600 | + | int | 156 |
| 1 | 57912600 | 57913600 | + | Spats2l | 157 |
| 1 | 57912600 | 57913600 | + | Spats2l | 158 |
| 1 | 58763800 | 58765600 | + | int | 159 |
| 1 | 58864200 | 58865200 | + | Casp8 | 160 |
| 1 | 58864200 | 58865200 | + | Casp8 | 161 |
| 1 | 58906800 | 58907800 | + | int | 162 |
| 1 | 59786600 | 59788000 | + | int | 163 |
| 1 | 59982600 | 59983800 | + | Fam117b | 164 |
| 1 | 60704400 | 60705400 | + | int | 165 |
| 1 | 61454000 | 61455200 | + | int | 166 |
| 1 | 61521600 | 61522800 | + | int | 167 |
| 1 | 61883200 | 61884200 | + | Pard3b | 168 |
| 1 | 61933600 | 61934600 | + | Pard3b | 169 |
| 1 | 62774600 | 62776000 | + | Nrp2 | 170 |
| 1 | 62774600 | 62776000 | + | Nrp2 | 171 |
| 1 | 63411200 | 63412200 | + | int | 172 |
| 1 | 64313400 | 64314800 | + | int | 173 |
| 1 | 65117600 | 65118600 | − | Crygc | 174 |
| 1 | 65117600 | 65118600 | − | Crygc | 175 |
| 1 | 65146400 | 65148000 | − | Cryga | 176 |
| 1 | 65300000 | 65301000 | + | Pikfyve | 177 |
| 1 | 65409800 | 65410800 | + | Pth2r | 178 |
| 1 | 65577200 | 65578800 | + | int | 179 |
| 1 | 65649200 | 65650400 | + | int | 180 |
| 1 | 66493600 | 66494600 | + | int | 181 |
| 1 | 66559600 | 66561200 | + | Unc80 | 182 |
| 1 | 66892400 | 66893600 | − | Acadl | 183 |
| 1 | 67173600 | 67174800 | + | Cps1 | 184 |
| 1 | 68347600 | 68349000 | − | Erbb4 | 185 |
| 1 | 68414400 | 68416000 | − | Erbb4 | 186 |
| 1 | 68643400 | 68644600 | − | Erbb4 | 187 |
| 1 | 68688000 | 68689000 | − | Erbb4 | 188 |
| 1 | 68912600 | 68913600 | − | Erbb4 | 189 |
| 1 | 69452200 | 69453200 | + | int | 190 |
| 1 | 69606000 | 69607200 | − | Ikzf2 | 191 |
| 1 | 69895200 | 69896200 | + | Spag16 | 192 |
| 1 | 70667800 | 70669000 | + | Spag16 | 193 |
| 1 | 70667800 | 70669000 | + | Spag16 | 194 |
| 1 | 70774800 | 70775800 | + | Vwc2l | 195 |
| 1 | 71738800 | 71739800 | + | int | 196 |
| 1 | 72160000 | 72161600 | + | int | 197 |
| 1 | 72602200 | 72603400 | + | int | 198 |
| 1 | 73456200 | 73457200 | − | Pinc | 199 |
| 1 | 74399400 | 74400600 | + | Pnkd | 200 |
| 1 | 74399400 | 74400600 | + | Pnkd | 201 |
| 1 | 74618000 | 74619000 | − | Zfp142 | 202 |
| 1 | 75227200 | 75228400 | + | int | 203 |
| 1 | 75487600 | 75488600 | − | Obsl1 | 204 |
| 1 | 75814400 | 75815800 | + | int | 205 |
| 1 | 77567000 | 77568200 | + | int | 206 |
| 1 | 79414200 | 79415400 | + | int | 207 |
| 1 | 79541800 | 79543000 | + | int | 208 |
| 1 | 80037600 | 80038600 | + | int | 209 |
| 1 | 80457200 | 80458400 | + | int | 210 |
| 1 | 80912200 | 80913800 | + | int | 211 |
| 1 | 80936000 | 80937000 | + | int | 212 |
| 1 | 80987000 | 80988000 | + | int | 213 |
| 1 | 81125400 | 81126400 | + | 9430031J16Rik | 214 |
| 1 | 81461200 | 81462400 | + | int | 215 |
| 1 | 81593000 | 81594000 | + | int | 216 |
| 1 | 81878800 | 81880200 | + | int | 217 |
| 1 | 82506800 | 82508000 | − | Col4a4 | 218 |
| 1 | 84984400 | 84985400 | + | int | 219 |
| 1 | 84989800 | 84991200 | + | int | 220 |
| 1 | 85082800 | 85084000 | + | int | 221 |
| 1 | 85110800 | 85111800 | + | int | 222 |
| 1 | 85118000 | 85119000 | + | int | 223 |
| 1 | 85184200 | 85185600 | + | int | 224 |
| 1 | 85197200 | 85198400 | + | Gm7609 | 225 |
| 1 | 87349400 | 87350400 | + | int | 226 |
| 1 | 87534600 | 87535600 | + | Sp140 | 227 |
| 1 | 87822600 | 87823800 | + | int | 228 |
| 1 | 88996600 | 88997600 | − | Alpi | 229 |
| 1 | 89379000 | 89380000 | − | Ngef | 230 |
| 1 | 89379000 | 89380000 | − | Ngef | 231 |
| 1 | 90231800 | 90232800 | + | Trpm8 | 232 |
| 1 | 90239600 | 90240600 | + | Trpm8 | 233 |
| 1 | 90919000 | 90920000 | + | int | 234 |
| 1 | 91654000 | 91655200 | + | Agap1 | 235 |
| 1 | 92299200 | 92300600 | + | int | 236 |
| 1 | 93012000 | 93013000 | + | Lrrfip1 | 237 |
| 1 | 93012000 | 93013000 | + | Lrrfip1 | 238 |
| 1 | 93012000 | 93013000 | + | Lrrfip1 | 239 |
| 1 | 93560400 | 93561600 | + | int | 240 |
| 1 | 95684600 | 95685600 | + | Atg4b | 241 |
| 1 | 95747600 | 95748800 | + | D2hgdh | 242 |
| 1 | 95813400 | 95814600 | + | int | 243 |
| 1 | 96748600 | 96750200 | + | int | 244 |
| 1 | 96754600 | 96755600 | + | int | 245 |
| 1 | 96883400 | 96884400 | + | int | 246 |
| 1 | 96969200 | 96970200 | + | int | 247 |
| 1 | 96976400 | 96977400 | + | int | 248 |
| 1 | 98315600 | 98316600 | + | int | 249 |
| 1 | 98356400 | 98357400 | + | int | 250 |
| 1 | 98534000 | 98535200 | + | int | 251 |
| 1 | 98542600 | 98543600 | + | int | 252 |
| 1 | 98842200 | 98843200 | − | Slco6b1 | 253 |
| 1 | 98893400 | 98894400 | − | Slco6b1 | 254 |
| 1 | 99522600 | 99523600 | + | int | 255 |
| 1 | 100160200 | 100161600 | + | int | 256 |
| 1 | 100437600 | 100438600 | + | int | 257 |
| 1 | 100961600 | 100962600 | + | int | 258 |
| 1 | 101285400 | 101287200 | + | int | 259 |
| 1 | 101693000 | 101694000 | + | Cntnap5b | 260 |
| 1 | 102018600 | 102019600 | + | Cntnap5b | 261 |
| 1 | 102054000 | 102055000 | + | Cntnap5b | 262 |
| 1 | 102087000 | 102088200 | + | Cntnap5b | 263 |
| 1 | 102168800 | 102169800 | + | Cntnap5b | 264 |
| 1 | 102316200 | 102317200 | + | Cntnap5b | 265 |
| 1 | 102570200 | 102571200 | + | int | 266 |
| 1 | 103103000 | 103104000 | + | int | 267 |
| 1 | 103106600 | 103107600 | + | int | 268 |
| 1 | 103594200 | 103595200 | + | int | 269 |
| 1 | 104052200 | 104053200 | + | int | 270 |
| 1 | 104927600 | 104928600 | + | int | 271 |
| 1 | 105221800 | 105222800 | + | int | 272 |
| 1 | 106094800 | 106096200 | + | int | 273 |
| 1 | 106391000 | 106392000 | + | int | 274 |
| 1 | 108923400 | 108924800 | + | int | 275 |
| 1 | 109016200 | 109017800 | + | int | 276 |
| 1 | 109115600 | 109116600 | + | int | 277 |
| 1 | 109803000 | 109804000 | + | int | 278 |
| 1 | 110131200 | 110132200 | + | int | 279 |
| 1 | 110406400 | 110408000 | + | int | 280 |
| 1 | 110413200 | 110414800 | + | int | 281 |
| 1 | 110624400 | 110625600 | + | int | 282 |
| 1 | 110852800 | 110853800 | + | int | 283 |
| 1 | 111057800 | 111059000 | + | int | 284 |
| 1 | 111122400 | 111123400 | + | int | 285 |
| 1 | 111166000 | 111167200 | + | int | 286 |
| 1 | 111228000 | 111229600 | + | int | 287 |
| 1 | 111429400 | 111430400 | + | int | 288 |
| 1 | 111825800 | 111827000 | + | int | 289 |
| 1 | 111881400 | 111882600 | + | Cdh7 | 290 |
| 1 | 112163200 | 112164200 | + | int | 291 |
| 1 | 112224400 | 112225400 | + | int | 292 |
| 1 | 112600000 | 112601200 | + | int | 293 |
| 1 | 112717600 | 112718600 | + | int | 294 |
| 1 | 112945200 | 112946800 | + | int | 295 |
| 1 | 113378000 | 113379200 | + | int | 296 |
| 1 | 113415000 | 113416000 | + | int | 297 |
| 1 | 113539800 | 113540800 | + | int | 298 |
| 1 | 113748400 | 113749400 | + | int | 299 |
| 1 | 113796400 | 113797600 | + | int | 300 |
| 1 | 114220600 | 114222200 | + | int | 301 |
| 1 | 114561400 | 114562400 | + | int | 302 |
| 1 | 114798000 | 114799000 | + | int | 303 |
| 1 | 114844000 | 114845000 | + | int | 304 |
| 1 | 115298200 | 115299200 | + | int | 305 |
| 1 | 116072000 | 116073200 | + | int | 306 |
| 1 | 117155200 | 117156400 | + | int | 307 |
| 1 | 117175800 | 117177200 | + | int | 308 |

TABLE 1-continued

| chromosome | start | stop | strand | nearest gene | ID |
|---|---|---|---|---|---|
| 1 | 117248400 | 117250000 | + | int | 309 |
| 1 | 117259000 | 117260000 | + | int | 310 |
| 1 | 118071200 | 118072400 | + | Cntnap5a | 311 |
| 1 | 118353400 | 118354800 | + | Cntnap5a | 312 |
| 1 | 118976000 | 118978000 | + | int | 313 |
| 1 | 119674800 | 119676400 | + | int | 314 |
| 1 | 120652600 | 120653800 | + | int | 315 |
| 1 | 121194200 | 121195200 | + | int | 316 |
| 1 | 121378600 | 121379600 | − | Ralb | 317 |
| 1 | 121459200 | 121460400 | − | Epb4int1l5 | 318 |
| 1 | 121787600 | 121788800 | + | int | 319 |
| 1 | 122042400 | 122043400 | + | 3110009E18Rik | 320 |
| 1 | 122238200 | 122239200 | + | C1ql2 | 321 |
| 1 | 123776800 | 123777800 | + | int | 322 |
| 1 | 124084200 | 124085200 | + | int | 323 |
| 1 | 125032000 | 125033400 | + | int | 324 |
| 1 | 125600200 | 125601200 | − | Dpp10 | 325 |
| 1 | 126102400 | 126103600 | + | int | 326 |
| 1 | 127691600 | 127692600 | + | Gpr39 | 327 |
| 1 | 129208000 | 129209000 | + | Mgat5 | 328 |
| 1 | 130804200 | 130806000 | + | int | 329 |
| 1 | 130997600 | 130998600 | + | int | 330 |
| 1 | 131050000 | 131051000 | + | int | 331 |
| 1 | 131491800 | 131492800 | + | Thsd7b | 332 |
| 1 | 131874800 | 131876200 | + | Thsd7b | 333 |
| 1 | 131917000 | 131918400 | + | Thsd7b | 334 |
| 1 | 132255600 | 132256800 | + | int | 335 |
| 1 | 132260400 | 132261400 | + | int | 336 |
| 1 | 133434200 | 133435200 | + | Fam72a | 337 |
| 1 | 134603600 | 134604800 | − | Nfasc | 338 |
| 1 | 134603600 | 134604800 | − | Nfasc | 339 |
| 1 | 135678200 | 135679400 | + | int | 340 |
| 1 | 136302600 | 136303800 | + | Cyb5r1 | 341 |
| 1 | 136584800 | 136586000 | + | Syt2 | 342 |
| 1 | 136694600 | 136695600 | − | 9530009M10Rik | 343 |
| 1 | 136694600 | 136695600 | − | Ppp1r12b | 344 |
| 1 | 138808200 | 138809400 | − | Nr5a2 | 345 |
| 1 | 138808200 | 138809400 | − | Nr5a2 | 346 |
| 1 | 138906600 | 138907800 | + | int | 347 |
| 1 | 139059200 | 139060200 | + | int | 348 |
| 1 | 139217000 | 139218200 | + | int | 349 |
| 1 | 139257200 | 139258200 | + | int | 350 |
| 1 | 140710400 | 140711400 | + | int | 351 |
| 1 | 141290000 | 141291000 | + | int | 352 |
| 1 | 141668000 | 141669000 | − | EG214403 | 353 |
| 1 | 141728600 | 141729800 | − | BC026782 | 354 |
| 1 | 141743600 | 141744600 | − | BC026782 | 355 |
| 1 | 141831600 | 141833200 | + | int | 356 |
| 1 | 141938600 | 141939600 | + | int | 357 |
| 1 | 142041600 | 142042600 | − | Cfh | 358 |
| 1 | 142049800 | 142051400 | − | Cfh | 359 |
| 1 | 142505000 | 142506000 | + | Kcnt2 | 360 |
| 1 | 142552800 | 142553800 | + | int | 361 |
| 1 | 142761000 | 142762000 | + | int | 362 |
| 1 | 142915200 | 142916600 | + | int | 363 |
| 1 | 143056000 | 143057000 | + | int | 364 |
| 1 | 143193200 | 143194600 | + | int | 365 |
| 1 | 143608400 | 143610200 | + | int | 366 |
| 1 | 143725600 | 143726600 | + | int | 367 |
| 1 | 143759400 | 143760400 | + | int | 368 |
| 1 | 143866200 | 143867200 | + | int | 369 |
| 1 | 143878800 | 143880600 | + | int | 370 |
| 1 | 144094200 | 144095400 | + | int | 371 |
| 1 | 144200800 | 144202000 | + | int | 372 |
| 1 | 144544800 | 144545800 | + | int | 373 |
| 1 | 144576400 | 144577400 | + | int | 374 |
| 1 | 144699400 | 144700600 | + | int | 375 |
| 1 | 145158400 | 145160000 | + | int | 376 |
| 1 | 145332600 | 145333600 | + | int | 377 |
| 1 | 146339600 | 146340800 | + | int | 378 |
| 1 | 146651400 | 146652400 | + | int | 379 |
| 1 | 146953600 | 146954600 | + | int | 380 |
| 1 | 147178200 | 147179200 | + | int | 381 |
| 1 | 147621600 | 147622800 | + | int | 382 |
| 1 | 147861800 | 147862800 | + | int | 383 |
| 1 | 149019000 | 149020200 | + | int | 384 |
| 1 | 149378400 | 149379600 | + | int | 385 |
| 1 | 149953200 | 149954600 | + | int | 386 |
| 1 | 150278000 | 150279000 | + | int | 387 |
| 1 | 150488600 | 150489800 | + | int | 388 |
| 1 | 150580200 | 150581400 | + | int | 389 |
| 1 | 150769600 | 150770800 | + | int | 390 |
| 1 | 150968600 | 150969800 | + | int | 391 |
| 1 | 151621800 | 151622800 | + | int | 392 |
| 1 | 152041600 | 152042800 | + | int | 393 |
| 1 | 152262000 | 152263000 | + | Tpr | 394 |
| 1 | 152515800 | 152517200 | − | Hmcn1 | 395 |
| 1 | 152969000 | 152970200 | + | int | 396 |
| 1 | 153263400 | 153264600 | − | 1200016B10Rik | 397 |
| 1 | 153958200 | 153959400 | + | int | 398 |
| 1 | 155218200 | 155219200 | + | int | 399 |
| 1 | 155569800 | 155571000 | + | int | 400 |
| 1 | 155992200 | 155993400 | + | int | 401 |
| 1 | 156357000 | 156358000 | − | Cacna1e | 402 |
| 1 | 156783200 | 156784200 | + | int | 403 |
| 1 | 157253200 | 157254200 | − | Xpr1 | 404 |
| 1 | 159245400 | 159246400 | − | Rasal2 | 405 |
| 1 | 159247600 | 159248600 | − | Rasal2 | 406 |
| 1 | 159750800 | 159751800 | + | int | 407 |
| 1 | 159926800 | 159927800 | + | int | 408 |
| 1 | 161132000 | 161133200 | + | int | 409 |
| 1 | 161263800 | 161265000 | + | Rfwd2 | 410 |
| 1 | 162694000 | 162695000 | − | Rabgap1l | 411 |
| 1 | 163575000 | 163576000 | + | int | 412 |
| 1 | 164557800 | 164559000 | + | int | 413 |
| 1 | 165119000 | 165120000 | + | int | 414 |
| 1 | 165576600 | 165577800 | + | int | 415 |
| 1 | 165646800 | 165648000 | − | Mettl11b | 416 |
| 1 | 167881000 | 167882000 | − | Pou2f1 | 417 |
| 1 | 168092600 | 168093600 | + | Gpa33 | 418 |
| 1 | 168499600 | 168500600 | + | int | 419 |
| 1 | 168878000 | 168879000 | + | int | 420 |
| 1 | 169269600 | 169271400 | + | int | 421 |
| 1 | 169762800 | 169764000 | + | Lmx1a | 422 |
| 1 | 170649000 | 170650400 | + | int | 423 |
| 1 | 171473400 | 171474400 | + | int | 424 |
| 1 | 171863800 | 171864800 | + | 1700084C01Rik | 425 |
| 1 | 172732200 | 172733200 | − | Atf6 | 426 |
| 1 | 173000400 | 173001800 | + | int | 427 |
| 1 | 173003800 | 173004800 | + | int | 428 |
| 1 | 173008000 | 173009400 | + | int | 429 |
| 1 | 173245800 | 173246800 | + | int | 430 |
| 1 | 173847200 | 173848200 | + | Slamf6 | 431 |
| 1 | 175003000 | 175004200 | + | int | 432 |
| 1 | 175432400 | 175433400 | + | int | 433 |
| 1 | 176330600 | 176331600 | + | int | 434 |
| 1 | 176780800 | 176783200 | − | Grem2 | 435 |
| 1 | 176908600 | 176909000 | + | int | 436 |
| 1 | 176994000 | 176995000 | − | Rgs7 | 437 |
| 1 | 179011800 | 179013000 | − | Akt3 | 438 |
| 1 | 179210800 | 179212000 | + | int | 439 |
| 1 | 179278800 | 179280000 | + | int | 440 |
| 1 | 179457400 | 179458600 | + | int | 441 |
| 1 | 179666800 | 179668000 | + | 1700016C15Rik | 442 |
| 1 | 179824200 | 179825200 | + | int | 443 |
| 1 | 180404200 | 180405400 | + | Efcab2 | 444 |
| 1 | 181133600 | 181134600 | − | Smyd3 | 445 |
| 1 | 183237600 | 183238600 | + | int | 446 |
| 1 | 183328600 | 183330200 | + | Cnih3 | 447 |
| 1 | 183621800 | 183622800 | + | int | 448 |
| 1 | 184237400 | 184238600 | + | int | 449 |
| 1 | 184590200 | 184591200 | + | int | 450 |
| 1 | 184719200 | 184720200 | + | Susd4 | 451 |
| 1 | 184920600 | 184922000 | + | int | 452 |
| 1 | 185500200 | 185501200 | + | int | 453 |
| 1 | 186569800 | 186570800 | + | int | 454 |
| 1 | 189241400 | 189242400 | + | int | 455 |
| 1 | 189942000 | 189943000 | + | Esrrg | 456 |
| 1 | 189973200 | 189974200 | + | Esrrg | 457 |
| 1 | 191339600 | 191340800 | + | int | 458 |
| 1 | 192268000 | 192269000 | + | int | 459 |
| 1 | 192306800 | 192307800 | + | int | 460 |
| 1 | 192785800 | 192787200 | − | Vash2 | 461 |
| 1 | 192785800 | 192787200 | − | Vash2 | 462 |

TABLE 1-continued

| chromo-some | start | stop | strand | nearest gene | ID |
|---|---|---|---|---|---|
| 1 | 192942000 | 192943400 | + | int | 463 |
| 1 | 193091800 | 193092800 | + | int | 464 |
| 1 | 193133000 | 193134200 | − | Nenf | 465 |
| 1 | 193234400 | 193235800 | + | int | 466 |
| 1 | 193500200 | 193501200 | + | int | 467 |
| 1 | 195017400 | 195018800 | − | Traf3ip3 | 468 |
| 1 | 196668200 | 196669200 | + | int | 469 |
| 1 | 196886800 | 196887800 | − | Cd46 | 470 |
| 2 | 3609400 | 3610600 | + | int | 471 |
| 2 | 5050200 | 5051200 | + | int | 472 |
| 2 | 5089200 | 5090200 | + | Ccdc3 | 473 |
| 2 | 5299400 | 5301200 | − | Camk1d | 474 |
| 2 | 6237200 | 6240800 | + | int | 475 |
| 2 | 6389600 | 6390600 | + | int | 476 |
| 2 | 7499000 | 7500000 | + | int | 477 |
| 2 | 7550800 | 7552200 | + | int | 478 |
| 2 | 7643400 | 7644600 | + | int | 479 |
| 2 | 8003200 | 8004200 | + | int | 480 |
| 2 | 8178600 | 8179600 | + | int | 481 |
| 2 | 8338800 | 8340000 | + | int | 482 |
| 2 | 9883000 | 9884200 | − | Taf3 | 483 |
| 2 | 10627000 | 10628200 | + | int | 484 |
| 2 | 12696800 | 12698000 | + | int | 485 |
| 2 | 13433200 | 13434200 | − | Trdmt1 | 486 |
| 2 | 14073400 | 14074400 | + | int | 487 |
| 2 | 15978400 | 15979600 | + | int | 488 |
| 2 | 16381200 | 16382200 | + | Plxdc2 | 489 |
| 2 | 17044400 | 17045600 | + | int | 490 |
| 2 | 17717800 | 17719000 | + | int | 491 |
| 2 | 19088200 | 19089600 | + | int | 492 |
| 2 | 20811200 | 20812200 | − | Arhgap21 | 493 |
| 2 | 22589600 | 22590800 | + | int | 494 |
| 2 | 23062800 | 23063800 | + | 4931423N10Rik | 495 |
| 2 | 23171400 | 23172400 | + | int | 496 |
| 2 | 23518200 | 23519200 | + | int | 497 |
| 2 | 23710400 | 23711400 | + | int | 498 |
| 2 | 23773200 | 23774600 | + | int | 499 |
| 2 | 24007200 | 24008400 | + | Il1f8 | 500 |
| 2 | 25287200 | 25288400 | + | Abca2 | 501 |
| 2 | 25843200 | 25844400 | + | int | 502 |
| 2 | 25895000 | 25896000 | + | int | 503 |
| 2 | 26335000 | 26336000 | − | Notch1 | 504 |
| 2 | 26375200 | 26376200 | + | int | 505 |
| 2 | 26538800 | 26539800 | + | int | 506 |
| 2 | 27668200 | 27669400 | + | int | 507 |
| 2 | 28607800 | 28608800 | + | 1190002A17Rik | 508 |
| 2 | 33666200 | 33667200 | − | Fam125b | 509 |
| 2 | 35868600 | 35869800 | + | int | 510 |
| 2 | 36593800 | 36595200 | + | int | 511 |
| 2 | 36749400 | 36750600 | + | int | 512 |
| 2 | 36842400 | 36843600 | + | int | 513 |
| 2 | 36872800 | 36873800 | + | int | 514 |
| 2 | 37001400 | 37003000 | + | int | 515 |
| 2 | 37056600 | 37057600 | + | Olfr365 | 516 |
| 2 | 37730400 | 37731600 | − | Dennd1a | 517 |
| 2 | 39174800 | 39175800 | + | int | 518 |
| 2 | 39238800 | 39239800 | + | int | 519 |
| 2 | 39300000 | 39301000 | + | int | 520 |
| 2 | 39386800 | 39387800 | + | int | 521 |
| 2 | 39405400 | 39406400 | + | int | 522 |
| 2 | 39553800 | 39554800 | + | int | 523 |
| 2 | 39789600 | 39791000 | + | int | 524 |
| 2 | 39809000 | 39810200 | + | int | 525 |
| 2 | 39823800 | 39825200 | + | int | 526 |
| 2 | 39974200 | 39975200 | + | int | 527 |
| 2 | 40343600 | 40344600 | + | int | 528 |
| 2 | 40472600 | 40473600 | − | Lrp1b | 529 |
| 2 | 41606400 | 41607400 | − | Lrp1b | 530 |
| 2 | 41907200 | 41908800 | − | Lrp1b | 531 |
| 2 | 41939400 | 41941000 | − | Lrp1b | 532 |
| 2 | 42153000 | 42154400 | − | Lrp1b | 533 |
| 2 | 42273400 | 42274700 | − | Lrp1b | 534 |
| 2 | 42305000 | 42306000 | − | Lrp1b | 535 |
| 2 | 42414800 | 42416400 | − | Lrp1b | 536 |
| 2 | 42571400 | 42572600 | + | int | 537 |
| 2 | 43353600 | 43355000 | + | int | 538 |
| 2 | 43447600 | 43448600 | + | Kynu | 539 |
| 2 | 43952000 | 43953000 | + | Arhgap15 | 540 |
| 2 | 44585400 | 44586600 | − | Gtdc1 | 541 |
| 2 | 44857200 | 44858200 | − | Zeb2 | 542 |
| 2 | 45274200 | 45275600 | + | int | 543 |
| 2 | 46193000 | 46194400 | + | int | 544 |
| 2 | 46577800 | 46578800 | + | int | 545 |
| 2 | 46830600 | 46831600 | + | int | 546 |
| 2 | 46839200 | 46840400 | + | int | 547 |
| 2 | 47306200 | 47307400 | + | int | 548 |
| 2 | 47308800 | 47310000 | + | int | 549 |
| 2 | 47400400 | 47401400 | + | int | 550 |
| 2 | 47912400 | 47913400 | + | int | 551 |
| 2 | 48822400 | 48823400 | + | Mbd5 | 552 |
| 2 | 48915600 | 48916600 | + | Mbd5 | 553 |
| 2 | 49621200 | 49622200 | + | Kif5c | 554 |
| 2 | 49801600 | 49803000 | + | Lypd6b | 555 |
| 2 | 49842400 | 49843400 | + | int | 556 |
| 2 | 50194400 | 50195400 | + | int | 557 |
| 2 | 51288400 | 51289400 | + | int | 558 |
| 2 | 51706000 | 51707600 | + | int | 559 |
| 2 | 51953800 | 51955000 | + | Rif1 | 560 |
| 2 | 53332800 | 53333800 | + | int | 561 |
| 2 | 53550600 | 53551600 | + | int | 562 |
| 2 | 53966600 | 53967600 | + | int | 563 |
| 2 | 54377200 | 54378200 | + | Galnt13 | 564 |
| 2 | 54690400 | 54691400 | + | Galnt13 | 565 |
| 2 | 54824400 | 54825800 | + | Galnt13 | 566 |
| 2 | 55099200 | 55100800 | + | int | 567 |
| 2 | 55379800 | 55380800 | + | Kcnj3 | 568 |
| 2 | 55976800 | 55978200 | + | int | 569 |
| 2 | 55991000 | 55992400 | + | int | 570 |
| 2 | 56264600 | 56266000 | + | int | 571 |
| 2 | 56325600 | 56327200 | + | int | 572 |
| 2 | 56798600 | 56800200 | + | int | 573 |
| 2 | 58959000 | 58960200 | − | Ccdc148 | 574 |
| 2 | 61964200 | 61965200 | + | Slc4a10 | 575 |
| 2 | 62612800 | 62613800 | − | Kcnh7 | 576 |
| 2 | 64019400 | 64020600 | + | int | 577 |
| 2 | 64120800 | 64122000 | + | int | 578 |
| 2 | 64479600 | 64480600 | + | int | 579 |
| 2 | 64555800 | 64557200 | + | int | 580 |
| 2 | 64609400 | 64611000 | + | int | 581 |
| 2 | 67163200 | 67164800 | + | int | 582 |
| 2 | 67256600 | 67257600 | + | int | 583 |
| 2 | 69210800 | 69212200 | + | int | 584 |
| 2 | 69812600 | 69813800 | + | Ubr3 | 585 |
| 2 | 70219800 | 70220800 | + | Myo3b | 586 |
| 2 | 70393800 | 70394800 | + | int | 587 |
| 2 | 71730600 | 71731600 | + | Pdk1 | 588 |
| 2 | 73797400 | 73799000 | + | int | 589 |
| 2 | 73917000 | 73918000 | + | int | 590 |
| 2 | 75726000 | 75727200 | + | Agps | 591 |
| 2 | 75811600 | 75812800 | + | int | 592 |
| 2 | 77432200 | 77433200 | − | Zfp385b | 593 |
| 2 | 77432200 | 77433200 | − | Zfp385b | 594 |
| 2 | 77934800 | 77935800 | + | int | 595 |
| 2 | 79549800 | 79551000 | + | Ppp1r1c | 596 |
| 2 | 79599200 | 79600600 | + | Ppp1r1c | 597 |
| 2 | 79926200 | 79927400 | − | Pde1a | 598 |
| 2 | 79926200 | 79927400 | − | Pde1a | 599 |
| 2 | 80661200 | 80662200 | + | int | 600 |
| 2 | 80970800 | 80971800 | + | int | 601 |
| 2 | 81051600 | 81053200 | + | int | 602 |
| 2 | 81065000 | 81066000 | + | int | 603 |
| 2 | 81144800 | 81146200 | + | int | 604 |
| 2 | 81221800 | 81223000 | + | int | 605 |
| 2 | 81505400 | 81509000 | + | int | 606 |
| 2 | 82216200 | 82217800 | + | int | 607 |
| 2 | 82299200 | 82300600 | + | int | 608 |
| 2 | 82762800 | 82764000 | + | int | 609 |
| 2 | 83221400 | 83222400 | + | int | 610 |
| 2 | 83363000 | 83364200 | + | int | 611 |
| 2 | 84221000 | 84222000 | − | Calcrl | 612 |
| 2 | 85145200 | 85146200 | + | int | 613 |
| 2 | 85616600 | 85617800 | + | Olfr1014 | 614 |
| 2 | 85639600 | 85640600 | − | Olfr1016 | 615 |
| 2 | 85689400 | 85690600 | + | Olfr1020 | 616 |

TABLE 1-continued

| chromo-some | start | stop | strand | nearest gene | ID |
|---|---|---|---|---|---|
| 2 | 85703400 | 85704600 | + | int | 617 |
| 2 | 86094800 | 86096000 | − | Olfr1049 | 618 |
| 2 | 86115800 | 86116800 | − | Olfr1051 | 619 |
| 2 | 86278600 | 86280200 | + | int | 620 |
| 2 | 86416000 | 86417200 | + | int | 621 |
| 2 | 86753800 | 86754800 | + | int | 622 |
| 2 | 86917200 | 86918200 | + | int | 623 |
| 2 | 87040800 | 87041800 | + | int | 624 |
| 2 | 87053200 | 87054200 | + | Olfr1113 | 625 |
| 2 | 87630200 | 87631200 | + | int | 626 |
| 2 | 87673000 | 87674200 | + | Olfr1148 | 627 |
| 2 | 87704400 | 87705600 | + | Olfr1152 | 628 |
| 2 | 87780800 | 87781800 | + | int | 629 |
| 2 | 87810200 | 87811600 | − | Olfr1157 | 630 |
| 2 | 88012800 | 88014000 | + | int | 631 |
| 2 | 88038400 | 88039400 | + | int | 632 |
| 2 | 88070800 | 88071800 | + | int | 633 |
| 2 | 88094800 | 88096000 | + | int | 634 |
| 2 | 88194400 | 88195600 | + | int | 635 |
| 2 | 88297600 | 88298800 | + | Olfr1183 | 636 |
| 2 | 88326400 | 88327600 | + | Olfr1184 | 637 |
| 2 | 88444000 | 88445000 | + | int | 638 |
| 2 | 88602200 | 88603200 | + | int | 639 |
| 2 | 88655000 | 88656200 | + | Olfr1202 | 640 |
| 2 | 88670800 | 88672000 | + | Olfr1203 | 641 |
| 2 | 88749200 | 88751000 | − | Olfr1209 | 642 |
| 2 | 89028400 | 89029400 | + | int | 643 |
| 2 | 89769600 | 89771000 | + | Olfr1258 | 644 |
| 2 | 89934600 | 89936000 | + | int | 645 |
| 2 | 90125600 | 90126600 | − | Olfr1272 | 646 |
| 2 | 90235200 | 90236200 | + | int | 647 |
| 2 | 90283600 | 90284800 | − | Ptprj | 648 |
| 2 | 90283600 | 90284800 | − | Ptprj | 649 |
| 2 | 91381200 | 91382200 | + | int | 650 |
| 2 | 93339200 | 93340200 | + | int | 651 |
| 2 | 93720600 | 93721800 | + | int | 652 |
| 2 | 94443000 | 94444400 | + | int | 653 |
| 2 | 95230000 | 95231200 | + | int | 654 |
| 2 | 95532400 | 95533400 | + | int | 655 |
| 2 | 95705600 | 95707000 | + | int | 656 |
| 2 | 95714200 | 95715600 | + | int | 657 |
| 2 | 96139600 | 96140600 | + | int | 658 |
| 2 | 96535000 | 96536000 | + | int | 659 |
| 2 | 97400200 | 97401400 | + | Lrrc4c | 660 |
| 2 | 97488200 | 97489200 | + | int | 661 |
| 2 | 97626600 | 97628000 | + | int | 662 |
| 2 | 98241000 | 98242400 | + | int | 663 |
| 2 | 98260800 | 98262400 | + | int | 664 |
| 2 | 98310200 | 98311200 | + | int | 665 |
| 2 | 98316800 | 98318000 | + | int | 666 |
| 2 | 98357200 | 98358400 | + | int | 667 |
| 2 | 98501800 | 98507800 | + | int | 668 |
| 2 | 98542000 | 98543400 | + | int | 669 |
| 2 | 99591800 | 99592800 | + | int | 670 |
| 2 | 99701400 | 99702400 | + | int | 671 |
| 2 | 99834600 | 99835600 | + | int | 672 |
| 2 | 99960600 | 99961800 | + | int | 673 |
| 2 | 100270400 | 100271600 | + | int | 674 |
| 2 | 100774000 | 100775000 | + | int | 675 |
| 2 | 101096800 | 101097700 | + | int | 676 |
| 2 | 102313600 | 102315000 | + | int | 677 |
| 2 | 102370600 | 102371600 | + | int | 678 |
| 2 | 107632400 | 107633400 | + | int | 679 |
| 2 | 107882200 | 107883400 | + | int | 680 |
| 2 | 107917000 | 107918200 | + | int | 681 |
| 2 | 108026600 | 108027800 | + | int | 682 |
| 2 | 108042200 | 108043800 | + | int | 683 |
| 2 | 108204600 | 108206000 | + | int | 684 |
| 2 | 108432600 | 108433800 | + | int | 685 |
| 2 | 109201600 | 109202800 | + | int | 686 |
| 2 | 109940000 | 109941000 | + | int | 687 |
| 2 | 109942000 | 109943200 | + | int | 688 |
| 2 | 110392200 | 110393400 | + | int | 689 |
| 2 | 110574600 | 110575600 | + | Muc15 | 690 |
| 2 | 110574600 | 110575600 | − | Ano3 | 691 |
| 2 | 110574600 | 110575600 | − | Ano3 | 692 |
| 2 | 110635600 | 110636600 | − | Ano3 | 693 |
| 2 | 110635600 | 110636600 | − | Ano3 | 694 |
| 2 | 110845000 | 110846000 | + | int | 695 |
| 2 | 111150600 | 111151800 | + | int | 696 |
| 2 | 111219000 | 111220200 | + | Olfr1284 | 697 |
| 2 | 111380800 | 111383200 | − | Olfr1294 | 698 |
| 2 | 111504200 | 111505400 | + | Olfr1299 | 699 |
| 2 | 111504200 | 111505400 | + | Olfr1300-ps1 | 700 |
| 2 | 111506800 | 111508400 | + | Olfr1300-ps1 | 701 |
| 2 | 111802400 | 111803800 | − | Olfr1308 | 702 |
| 2 | 114469600 | 114470600 | − | Atpbd4 | 703 |
| 2 | 114533400 | 114535000 | + | int | 704 |
| 2 | 114801400 | 114802400 | + | int | 705 |
| 2 | 115067000 | 115068400 | + | int | 706 |
| 2 | 119880000 | 119882000 | + | int | 707 |
| 2 | 121580800 | 121581800 | − | Frmd5 | 708 |
| 2 | 122092200 | 122093200 | + | int | 709 |
| 2 | 124984400 | 124985600 | + | Slc12a1 | 710 |
| 2 | 125574400 | 125575400 | − | Secisbp2l | 711 |
| 2 | 125711000 | 125712000 | + | Galk2 | 712 |
| 2 | 125801000 | 125802000 | + | Galk2 | 713 |
| 2 | 125985200 | 125986200 | + | Dtwd1 | 714 |
| 2 | 127595200 | 127596200 | − | Nphp1 | 715 |
| 2 | 128786000 | 128787000 | + | int | 716 |
| 2 | 129324200 | 129325200 | − | F830045P16Rik | 717 |
| 2 | 131280000 | 131281000 | + | int | 718 |
| 2 | 131699200 | 131700200 | + | int | 719 |
| 2 | 133551400 | 133552400 | + | int | 720 |
| 2 | 136204400 | 136205800 | − | Pak7 | 721 |
| 2 | 136688400 | 136689600 | + | int | 722 |
| 2 | 139046800 | 139048400 | + | int | 723 |
| 2 | 139268400 | 139269600 | + | int | 724 |
| 2 | 139937600 | 139938600 | + | int | 725 |
| 2 | 140215400 | 140216400 | − | Sel1l2 | 726 |
| 2 | 140702000 | 140703000 | + | Macrod2 | 727 |
| 2 | 141001000 | 141002000 | + | Macrod2 | 728 |
| 2 | 141849200 | 141850200 | + | Macrod2 | 729 |
| 2 | 141863000 | 141864200 | + | Macrod2 | 730 |
| 2 | 141970600 | 141971600 | + | Macrod2 | 731 |
| 2 | 142075800 | 142076800 | + | Macrod2 | 732 |
| 2 | 142219000 | 142220600 | + | int | 733 |
| 2 | 142254000 | 142255400 | + | int | 734 |
| 2 | 147369400 | 147370400 | + | int | 735 |
| 2 | 149178000 | 149179400 | + | int | 736 |
| 2 | 149194200 | 149195600 | + | int | 737 |
| 2 | 151069600 | 151071200 | + | int | 738 |
| 2 | 151175000 | 151176600 | + | int | 739 |
| 2 | 151286600 | 151287800 | + | int | 740 |
| 2 | 156348200 | 156349400 | + | Epb4int1l1 | 741 |
| 2 | 156348200 | 156349400 | + | Epb4int1l1 | 742 |
| 2 | 156600800 | 156601800 | + | Myl9 | 743 |
| 2 | 158110400 | 158111800 | + | int | 744 |
| 2 | 159053000 | 159054200 | + | int | 745 |
| 2 | 159490000 | 159491000 | + | int | 746 |
| 2 | 159944600 | 159946000 | + | int | 747 |
| 2 | 159965600 | 159966800 | + | int | 748 |
| 2 | 161637800 | 161638800 | − | Ptprt | 749 |
| 2 | 162814800 | 162816400 | + | Sgk2 | 750 |
| 2 | 162986200 | 162987200 | + | int | 751 |
| 2 | 163074200 | 163075200 | + | Tox2 | 752 |
| 2 | 166840800 | 166841800 | + | Ddx27 | 753 |
| 2 | 168462400 | 168463800 | − | Atp9a | 754 |
| 2 | 169086200 | 169087600 | + | int | 755 |
| 2 | 170545400 | 170546800 | + | int | 756 |
| 2 | 171508400 | 171509400 | + | int | 757 |
| 2 | 172146000 | 172147000 | + | int | 758 |
| 2 | 172578000 | 172579400 | + | int | 759 |
| 2 | 174866800 | 174867800 | + | int | 760 |
| 2 | 174869400 | 174870400 | + | int | 761 |
| 2 | 176864200 | 176865200 | + | int | 762 |
| 2 | 177093800 | 177094800 | + | int | 763 |
| 2 | 177340000 | 177341000 | + | int | 764 |
| 2 | 177718600 | 177719600 | + | int | 765 |
| 2 | 178344600 | 178345800 | + | int | 766 |
| 2 | 179256400 | 179257600 | + | Cdh4 | 767 |
| 3 | 3354200 | 3355600 | + | int | 768 |
| 3 | 3776400 | 3777600 | + | int | 769 |
| 3 | 3801400 | 3802400 | + | int | 770 |

TABLE 1-continued

| chromosome | start | stop | strand | nearest gene | ID |
|---|---|---|---|---|---|
| 3 | 3893400 | 3894400 | + | int | 771 |
| 3 | 4412200 | 4413200 | + | int | 772 |
| 3 | 4520200 | 4521200 | + | int | 773 |
| 3 | 4992400 | 4993400 | + | int | 774 |
| 3 | 5045600 | 5046600 | + | int | 775 |
| 3 | 5142000 | 5143200 | + | int | 776 |
| 3 | 5445400 | 5447400 | + | int | 777 |
| 3 | 5859800 | 5861600 | + | int | 778 |
| 3 | 5902800 | 5903800 | + | int | 779 |
| 3 | 6280000 | 6281000 | + | int | 780 |
| 3 | 6328600 | 6330000 | + | int | 781 |
| 3 | 6555800 | 6556800 | + | int | 782 |
| 3 | 7605400 | 7606400 | − | Il7 | 783 |
| 3 | 7700800 | 7702000 | + | int | 784 |
| 3 | 7863800 | 7864800 | + | int | 785 |
| 3 | 7906200 | 7907800 | + | int | 786 |
| 3 | 9079000 | 9080600 | + | int | 787 |
| 3 | 9326000 | 9327200 | + | int | 788 |
| 3 | 10561800 | 10563000 | + | int | 789 |
| 3 | 10603400 | 10605000 | + | int | 790 |
| 3 | 10654800 | 10655800 | + | int | 791 |
| 3 | 10789800 | 10790800 | + | int | 792 |
| 3 | 11077800 | 11081200 | + | int | 793 |
| 3 | 11328200 | 11329600 | + | int | 794 |
| 3 | 11367000 | 11368200 | + | int | 795 |
| 3 | 11467400 | 11468400 | + | int | 796 |
| 3 | 11993400 | 11994800 | + | int | 797 |
| 3 | 12247600 | 12248800 | + | int | 798 |
| 3 | 12663400 | 12664600 | + | int | 799 |
| 3 | 12771400 | 12772400 | + | int | 800 |
| 3 | 13266400 | 13267800 | + | int | 801 |
| 3 | 13730400 | 13731400 | + | Ralyl | 802 |
| 3 | 14488800 | 14489800 | + | Slc7a12 | 803 |
| 3 | 14511100 | 14512100 | + | int | 804 |
| 3 | 14570000 | 14571200 | + | Lrrcc1 | 805 |
| 3 | 15123600 | 15124600 | + | int | 806 |
| 3 | 15255200 | 15256200 | + | int | 807 |
| 3 | 15367400 | 15368800 | + | int | 808 |
| 3 | 15387800 | 15388800 | − | Sirpb1a | 809 |
| 3 | 15443800 | 15445600 | + | int | 810 |
| 3 | 15551400 | 15552600 | − | Sirpb1b | 811 |
| 3 | 15553800 | 15555400 | − | Sirpb1b | 812 |
| 3 | 15590400 | 15592200 | + | int | 813 |
| 3 | 15695800 | 15696800 | − | LOC100038947 | 814 |
| 3 | 16417400 | 16418400 | + | int | 815 |
| 3 | 17119400 | 17120600 | + | int | 816 |
| 3 | 17266000 | 17267200 | + | int | 817 |
| 3 | 17332600 | 17333800 | + | int | 818 |
| 3 | 17596600 | 17598000 | + | int | 819 |
| 3 | 17603200 | 17604600 | + | int | 820 |
| 3 | 17645200 | 17646200 | + | int | 821 |
| 3 | 17989200 | 17990200 | − | Cyp7b1 | 822 |
| 3 | 18255200 | 18258000 | + | int | 823 |
| 3 | 18877200 | 18878200 | + | int | 824 |
| 3 | 18882800 | 18884400 | + | int | 825 |
| 3 | 20602400 | 20603400 | + | int | 826 |
| 3 | 20731600 | 20732600 | + | int | 827 |
| 3 | 21089200 | 21090800 | + | int | 828 |
| 3 | 21110200 | 21111600 | + | int | 829 |
| 3 | 21505600 | 21506200 | + | int | 830 |
| 3 | 21508600 | 21509600 | + | int | 831 |
| 3 | 22054600 | 22056000 | + | Tbl1xr1 | 832 |
| 3 | 22765600 | 22766600 | + | int | 833 |
| 3 | 23149000 | 23150200 | + | int | 834 |
| 3 | 23536600 | 23537800 | + | int | 835 |
| 3 | 23854800 | 23856000 | + | int | 836 |
| 3 | 24061400 | 24062800 | + | int | 837 |
| 3 | 24117800 | 24119200 | + | int | 838 |
| 3 | 24239800 | 24241000 | + | int | 839 |
| 3 | 24617000 | 24618000 | + | int | 840 |
| 3 | 24723400 | 24724400 | + | int | 841 |
| 3 | 24857400 | 24859000 | + | int | 842 |
| 3 | 25023800 | 25024800 | + | int | 843 |
| 3 | 25265800 | 25267200 | + | int | 844 |
| 3 | 25297000 | 25298600 | + | int | 845 |
| 3 | 25619000 | 25620000 | − | Nlgn1 | 846 |
| 3 | 25619000 | 25620000 | − | Nlgn1 | 847 |
| 3 | 26188800 | 26189800 | − | Nlgn1 | 848 |
| 3 | 26331200 | 26332200 | + | int | 849 |
| 3 | 27831000 | 27832200 | + | int | 850 |
| 3 | 28133600 | 28134600 | + | int | 851 |
| 3 | 28506200 | 28507200 | + | Tnik | 852 |
| 3 | 28506200 | 28507200 | + | Tnik | 853 |
| 3 | 28823200 | 28824200 | + | Gm1527 | 854 |
| 3 | 28977400 | 28978600 | + | 6130401L20Rik | 855 |
| 3 | 29315600 | 29316800 | + | 6130401L20Rik | 856 |
| 3 | 29315600 | 29316800 | + | Mir551b | 857 |
| 3 | 29455400 | 29456400 | + | 6130401L20Rik | 858 |
| 3 | 30332000 | 30333000 | − | Mecom | 859 |
| 3 | 30673000 | 30674000 | + | int | 860 |
| 3 | 31545000 | 31546000 | + | int | 861 |
| 3 | 31631600 | 31633000 | + | int | 862 |
| 3 | 33178200 | 33179600 | + | int | 863 |
| 3 | 33498600 | 33500000 | + | int | 864 |
| 3 | 33676800 | 33677800 | + | int | 865 |
| 3 | 33812200 | 33813800 | + | int | 866 |
| 3 | 34843000 | 34844000 | + | int | 867 |
| 3 | 35575800 | 35577000 | + | int | 868 |
| 3 | 36204400 | 36205400 | + | int | 869 |
| 3 | 36249200 | 36250200 | + | int | 870 |
| 3 | 36976400 | 36977600 | + | Adad1 | 871 |
| 3 | 37467800 | 37468800 | + | Spata5 | 872 |
| 3 | 38158600 | 38159800 | + | int | 873 |
| 3 | 38718800 | 38719800 | + | int | 874 |
| 3 | 38985200 | 38986200 | + | int | 875 |
| 3 | 41586600 | 41587600 | + | int | 876 |
| 3 | 42406800 | 42407800 | + | int | 877 |
| 3 | 42718600 | 42719600 | + | int | 878 |
| 3 | 42808200 | 42809400 | + | int | 879 |
| 3 | 42936800 | 42938200 | + | int | 880 |
| 3 | 43101600 | 43102600 | + | int | 881 |
| 3 | 43136600 | 43137600 | + | int | 882 |
| 3 | 43161400 | 43162600 | + | int | 883 |
| 3 | 43335600 | 43336600 | + | int | 884 |
| 3 | 43363800 | 43364800 | + | int | 885 |
| 3 | 43510200 | 43511200 | + | int | 886 |
| 3 | 43572800 | 43573800 | + | int | 887 |
| 3 | 43916800 | 43917800 | + | int | 888 |
| 3 | 44081800 | 44082800 | + | int | 889 |
| 3 | 44209000 | 44210200 | + | int | 890 |
| 3 | 44267000 | 44268000 | + | int | 891 |
| 3 | 44441200 | 44442200 | + | int | 892 |
| 3 | 44653000 | 44654400 | + | int | 893 |
| 3 | 44684800 | 44685800 | + | int | 894 |
| 3 | 44885400 | 44886400 | + | int | 895 |
| 3 | 45284200 | 45285400 | + | int | 896 |
| 3 | 45372200 | 45373200 | + | int | 897 |
| 3 | 45769800 | 45771200 | + | int | 898 |
| 3 | 46555800 | 46557000 | + | int | 899 |
| 3 | 46596000 | 46597000 | + | int | 900 |
| 3 | 47093800 | 47095000 | + | int | 901 |
| 3 | 47185600 | 47186800 | + | int | 902 |
| 3 | 47541200 | 47542600 | + | int | 903 |
| 3 | 47891800 | 47892800 | + | int | 904 |
| 3 | 47897000 | 47898000 | + | int | 905 |
| 3 | 47902600 | 47903200 | + | int | 906 |
| 3 | 48218400 | 48219600 | + | int | 907 |
| 3 | 48369800 | 48371400 | + | int | 908 |
| 3 | 48945800 | 48946800 | + | int | 909 |
| 3 | 49308200 | 49309200 | + | int | 910 |
| 3 | 49411200 | 49412200 | + | int | 911 |
| 3 | 49693000 | 49694000 | + | int | 912 |
| 3 | 50044400 | 50045600 | + | int | 913 |
| 3 | 50123200 | 50124200 | + | int | 914 |
| 3 | 50903800 | 50905000 | + | int | 915 |
| 3 | 52562600 | 52563600 | + | int | 916 |
| 3 | 55728400 | 55729400 | − | Nbea | 917 |
| 3 | 56217800 | 56219000 | + | int | 918 |
| 3 | 56367000 | 56368000 | + | int | 919 |
| 3 | 57641400 | 57642600 | + | int | 920 |
| 3 | 57851400 | 57852400 | + | int | 921 |
| 3 | 58992000 | 58993000 | + | Med12l | 922 |
| 3 | 59074200 | 59075600 | + | Med12l | 923 |
| 3 | 59300400 | 59301400 | + | int | 924 |

TABLE 1-continued

| chromosome | start | stop | strand | nearest gene | ID |
|---|---|---|---|---|---|
| 3 | 59503800 | 59505000 | + | int | 925 |
| 3 | 60024400 | 60025400 | + | int | 926 |
| 3 | 60122200 | 60123200 | + | int | 927 |
| 3 | 60573600 | 60574600 | + | int | 928 |
| 3 | 60887200 | 60888200 | + | int | 929 |
| 3 | 60995800 | 60996800 | + | int | 930 |
| 3 | 61241600 | 61243000 | + | int | 931 |
| 3 | 61883600 | 61884800 | + | int | 932 |
| 3 | 62302800 | 62304200 | − | Dhx36 | 933 |
| 3 | 62626400 | 62627400 | + | int | 934 |
| 3 | 63229400 | 63230400 | + | int | 935 |
| 3 | 63251400 | 63252400 | + | int | 936 |
| 3 | 63315200 | 63317000 | + | int | 937 |
| 3 | 64203000 | 64204000 | − | Vmn2r4 | 938 |
| 3 | 64493200 | 64494200 | − | Vmn2r-ps11 | 939 |
| 3 | 64819600 | 64820800 | + | int | 940 |
| 3 | 64980400 | 64981800 | + | Kcnab1 | 941 |
| 3 | 66857700 | 66858600 | + | Rsrc1 | 942 |
| 3 | 67403600 | 67404600 | + | Mfsd1 | 943 |
| 3 | 68722600 | 68723600 | − | Ift80 | 944 |
| 3 | 68735600 | 68736800 | − | Ift80 | 945 |
| 3 | 69468200 | 69469200 | + | int | 946 |
| 3 | 69767800 | 69768800 | + | int | 947 |
| 3 | 70586800 | 70588200 | + | int | 948 |
| 3 | 71094800 | 71095800 | + | int | 949 |
| 3 | 71204600 | 71205800 | + | int | 950 |
| 3 | 71287200 | 71288800 | + | int | 951 |
| 3 | 71321800 | 71323200 | + | int | 952 |
| 3 | 71327600 | 71329000 | + | int | 953 |
| 3 | 71586600 | 71588000 | + | int | 954 |
| 3 | 71601400 | 71602400 | + | int | 955 |
| 3 | 72005400 | 72007000 | + | int | 956 |
| 3 | 72054000 | 72055200 | + | int | 957 |
| 3 | 72163000 | 72164700 | + | int | 958 |
| 3 | 72253400 | 72254800 | + | int | 959 |
| 3 | 72317200 | 72318400 | + | int | 960 |
| 3 | 72330200 | 72331800 | + | int | 961 |
| 3 | 72376600 | 72377600 | + | int | 962 |
| 3 | 72520800 | 72522000 | + | int | 963 |
| 3 | 72658000 | 72659200 | + | int | 964 |
| 3 | 72797600 | 72798600 | + | int | 965 |
| 3 | 72967400 | 72968800 | + | int | 966 |
| 3 | 73122800 | 73124200 | + | int | 967 |
| 3 | 73188000 | 73189200 | + | int | 968 |
| 3 | 73647600 | 73648600 | + | int | 969 |
| 3 | 73755200 | 73756200 | + | int | 970 |
| 3 | 74455600 | 74457000 | + | int | 971 |
| 3 | 74509400 | 74510600 | + | int | 972 |
| 3 | 74513400 | 74514600 | + | int | 973 |
| 3 | 74930400 | 74931400 | − | Zbbx | 974 |
| 3 | 75249400 | 75250600 | + | int | 975 |
| 3 | 76467200 | 76468400 | + | Fstl5 | 976 |
| 3 | 76868200 | 76869800 | + | int | 977 |
| 3 | 76957200 | 76958400 | + | int | 978 |
| 3 | 76975600 | 76977000 | + | int | 979 |
| 3 | 77836200 | 77837400 | + | int | 980 |
| 3 | 77852600 | 77854000 | + | int | 981 |
| 3 | 78143800 | 78145000 | + | int | 982 |
| 3 | 78150800 | 78152000 | + | int | 983 |
| 3 | 78353200 | 78354200 | + | int | 984 |
| 3 | 78413600 | 78414800 | + | int | 985 |
| 3 | 78474800 | 78475800 | + | int | 986 |
| 3 | 79947600 | 79948600 | + | int | 987 |
| 3 | 79989200 | 79990400 | + | int | 988 |
| 3 | 80033200 | 80034200 | + | int | 989 |
| 3 | 80354600 | 80355800 | + | int | 990 |
| 3 | 80390400 | 80391600 | + | int | 991 |
| 3 | 80724200 | 80725800 | + | int | 992 |
| 3 | 80804800 | 80806000 | + | int | 993 |
| 3 | 81118400 | 81119400 | + | int | 994 |
| 3 | 81184600 | 81185600 | + | int | 995 |
| 3 | 81440200 | 81441200 | + | int | 996 |
| 3 | 82344400 | 82345400 | − | Npy2r | 997 |
| 3 | 86318200 | 86321400 | + | Lrba | 998 |
| 3 | 86318200 | 86321400 | + | Lrba | 999 |
| 3 | 86318200 | 86321400 | + | Lrba | 1000 |
| 3 | 86360400 | 86361400 | + | Lrba | 1001 |
| 3 | 86360400 | 86361400 | + | Lrba | 1002 |
| 3 | 86360400 | 86361400 | + | Lrba | 1003 |
| 3 | 86481000 | 86482000 | + | Lrba | 1004 |
| 3 | 86481000 | 86482000 | + | Lrba | 1005 |
| 3 | 86481000 | 86482000 | + | Lrba | 1006 |
| 3 | 86540200 | 86541400 | + | Lrba | 1007 |
| 3 | 86540200 | 86541400 | + | Lrba | 1008 |
| 3 | 86540200 | 86541400 | + | Lrba | 1009 |
| 3 | 86584800 | 86585800 | + | Lrba | 1010 |
| 3 | 87137400 | 87138400 | + | int | 1011 |
| 3 | 88256000 | 88258000 | − | Sema4a | 1012 |
| 3 | 88256000 | 88258000 | − | Sema4a | 1013 |
| 3 | 88256000 | 88258000 | − | Sema4a | 1014 |
| 3 | 88256000 | 88258000 | − | Sema4a | 1015 |
| 3 | 90613400 | 90614400 | + | int | 1016 |
| 3 | 90680000 | 90681200 | + | int | 1017 |
| 3 | 90754200 | 90755400 | + | int | 1018 |
| 3 | 91016600 | 91017600 | + | int | 1019 |
| 3 | 91067400 | 91068400 | + | int | 1020 |
| 3 | 91072000 | 91073200 | + | int | 1021 |
| 3 | 91229600 | 91231000 | + | int | 1022 |
| 3 | 91354600 | 91356000 | + | int | 1023 |
| 3 | 91696400 | 91697400 | + | int | 1024 |
| 3 | 91735400 | 91737000 | + | int | 1025 |
| 3 | 91752800 | 91753800 | + | int | 1026 |
| 3 | 91867800 | 91869200 | + | int | 1027 |
| 3 | 92199400 | 92200400 | + | int | 1028 |
| 3 | 93251000 | 93252200 | + | Tchh | 1029 |
| 3 | 93471200 | 93472600 | + | int | 1030 |
| 3 | 95306000 | 95307000 | + | Ctsk | 1031 |
| 3 | 95326600 | 95327600 | + | int | 1032 |
| 3 | 96601200 | 96602200 | + | int | 1033 |
| 3 | 98191400 | 98192400 | + | Zfp697 | 1034 |
| 3 | 98637200 | 98638600 | + | int | 1035 |
| 3 | 98824600 | 98825600 | + | int | 1036 |
| 3 | 99230800 | 99232000 | + | int | 1037 |
| 3 | 99422800 | 99424200 | + | int | 1038 |
| 3 | 99483400 | 99484600 | + | int | 1039 |
| 3 | 99520200 | 99521400 | + | int | 1040 |
| 3 | 99531600 | 99532800 | + | int | 1041 |
| 3 | 100529800 | 100530800 | + | int | 1042 |
| 3 | 101128600 | 101129800 | + | int | 1043 |
| 3 | 101328400 | 101329400 | + | int | 1044 |
| 3 | 102649600 | 102650600 | − | Sycp1 | 1045 |
| 3 | 102812200 | 102813600 | + | int | 1046 |
| 3 | 103964000 | 103965200 | − | Magi3 | 1047 |
| 3 | 103967200 | 103968200 | − | Magi3 | 1048 |
| 3 | 104251800 | 104252800 | + | int | 1049 |
| 3 | 104686400 | 104687600 | + | St7l | 1050 |
| 3 | 104833600 | 104834600 | − | Cttnbp2nl | 1051 |
| 3 | 104833600 | 104834600 | − | Cttnbp2nl | 1052 |
| 3 | 105896200 | 105897200 | + | int | 1053 |
| 3 | 105948200 | 105949200 | + | int | 1054 |
| 3 | 106028000 | 106029200 | + | int | 1055 |
| 3 | 106068400 | 106069400 | + | int | 1056 |
| 3 | 106168400 | 106169600 | + | int | 1057 |
| 3 | 106725200 | 106726600 | + | int | 1058 |
| 3 | 107182000 | 107183000 | + | int | 1059 |
| 3 | 107762800 | 107764200 | + | int | 1060 |
| 3 | 108595000 | 108596000 | + | int | 1061 |
| 3 | 108849200 | 108850400 | + | int | 1062 |
| 3 | 108907000 | 108908000 | + | 4930443G12Rik | 1063 |
| 3 | 109117200 | 109118200 | + | int | 1064 |
| 3 | 110869200 | 110870200 | + | int | 1065 |
| 3 | 110977200 | 110978400 | + | int | 1066 |
| 3 | 111236000 | 111237000 | + | int | 1067 |
| 3 | 111459000 | 111460600 | + | int | 1068 |
| 3 | 111545200 | 111546200 | + | int | 1069 |
| 3 | 111609800 | 111610800 | + | int | 1070 |
| 3 | 112178400 | 112179400 | + | int | 1071 |
| 3 | 112435800 | 112436800 | + | int | 1072 |
| 3 | 112675600 | 112677200 | + | int | 1073 |
| 3 | 112965600 | 112966600 | + | int | 1074 |
| 3 | 113043200 | 113044200 | + | int | 1075 |
| 3 | 113314400 | 113315400 | − | Rnpc3 | 1076 |
| 3 | 113350000 | 113351200 | + | int | 1077 |
| 3 | 113414800 | 113416000 | + | int | 1078 |

TABLE 1-continued

| chromosome | start | stop | strand | nearest gene | ID |
|---|---|---|---|---|---|
| 3 | 113444000 | 113445000 | + | int | 1079 |
| 3 | 113474200 | 113475400 | + | int | 1080 |
| 3 | 114039800 | 114041000 | + | int | 1081 |
| 3 | 114132200 | 114133800 | + | int | 1082 |
| 3 | 114143400 | 114144400 | + | int | 1083 |
| 3 | 114251600 | 114252600 | + | int | 1084 |
| 3 | 114333200 | 114334600 | + | int | 1085 |
| 3 | 114456800 | 114458000 | + | int | 1086 |
| 3 | 114566200 | 114568000 | + | int | 1087 |
| 3 | 114789200 | 114790200 | + | Olfm3 | 1088 |
| 3 | 114789200 | 114790200 | + | Olfm3 | 1089 |
| 3 | 115115200 | 115116400 | + | int | 1090 |
| 3 | 115382000 | 115383000 | + | int | 1091 |
| 3 | 115908600 | 115909800 | + | int | 1092 |
| 3 | 117176400 | 117177400 | + | int | 1093 |
| 3 | 118428200 | 118429600 | + | Dpyd | 1094 |
| 3 | 118535800 | 118537000 | + | Dpyd | 1095 |
| 3 | 118553400 | 118554600 | + | Dpyd | 1096 |
| 3 | 118677800 | 118679000 | + | Dpyd | 1097 |
| 3 | 119370400 | 119371400 | + | int | 1098 |
| 3 | 120026400 | 120027600 | + | int | 1099 |
| 3 | 120526200 | 120527200 | + | int | 1100 |
| 3 | 120679400 | 120680400 | + | int | 1101 |
| 3 | 120856600 | 120857800 | + | int | 1102 |
| 3 | 122383400 | 122384400 | + | int | 1103 |
| 3 | 122788200 | 122789800 | − | Synpo2 | 1104 |
| 3 | 123812000 | 123813200 | + | int | 1105 |
| 3 | 124251200 | 124252400 | + | int | 1106 |
| 3 | 124588400 | 124589400 | + | int | 1107 |
| 3 | 124745000 | 124746000 | + | int | 1108 |
| 3 | 124898000 | 124899000 | + | int | 1109 |
| 3 | 124918400 | 124919400 | + | int | 1110 |
| 3 | 126642600 | 126643600 | − | Ank2 | 1111 |
| 3 | 126642600 | 126643600 | − | Ank2 | 1112 |
| 3 | 128445800 | 128446800 | + | int | 1113 |
| 3 | 129593200 | 129594400 | + | Pla2g12a | 1114 |
| 3 | 129593200 | 129594400 | + | Pla2g12a | 1115 |
| 3 | 131697800 | 131698800 | + | int | 1116 |
| 3 | 133748800 | 133750400 | + | int | 1117 |
| 3 | 133814400 | 133815600 | + | int | 1118 |
| 3 | 134082000 | 134083200 | + | int | 1119 |
| 3 | 134236200 | 134237200 | + | int | 1120 |
| 3 | 134558400 | 134559800 | + | Tacr3 | 1121 |
| 3 | 135809400 | 135810600 | − | Bank1 | 1122 |
| 3 | 136020000 | 136021200 | + | int | 1123 |
| 3 | 136149200 | 136150400 | + | int | 1124 |
| 3 | 136890800 | 136892200 | + | int | 1125 |
| 3 | 137046400 | 137047400 | + | Emcn | 1126 |
| 3 | 137773800 | 137775000 | − | Mttp | 1127 |
| 3 | 137773800 | 137775000 | − | Mttp | 1128 |
| 3 | 137878400 | 137879400 | + | Adh7 | 1129 |
| 3 | 138665200 | 138666200 | − | Rap1gds1 | 1130 |
| 3 | 139141000 | 139142200 | + | B930007M17Rik | 1131 |
| 3 | 139200200 | 139201200 | + | B930007M17Rik | 1132 |
| 3 | 139476200 | 139477400 | + | int | 1133 |
| 3 | 139572000 | 139573000 | + | int | 1134 |
| 3 | 140406800 | 140408000 | + | int | 1135 |
| 3 | 140470600 | 140471600 | + | int | 1136 |
| 3 | 140954600 | 140956000 | + | int | 1137 |
| 3 | 141034200 | 141035400 | + | int | 1138 |
| 3 | 141063000 | 141064000 | + | int | 1139 |
| 3 | 142279000 | 142280000 | + | Gbp1 | 1140 |
| 3 | 142491200 | 142492200 | − | Pkn2 | 1141 |
| 3 | 143995800 | 143996800 | + | int | 1142 |
| 3 | 144506800 | 144507800 | − | Clca4 | 1143 |
| 3 | 144542800 | 144543800 | − | Gm6289 | 1144 |
| 3 | 144955800 | 144956800 | + | Col24a1 | 1145 |
| 3 | 146992800 | 146994400 | + | int | 1146 |
| 3 | 147026600 | 147027600 | + | int | 1147 |
| 3 | 147357400 | 147358800 | + | int | 1148 |
| 3 | 147441000 | 147442000 | + | int | 1149 |
| 3 | 147751200 | 147752200 | + | int | 1150 |
| 3 | 148380000 | 148381000 | + | int | 1151 |
| 3 | 148585200 | 148586200 | − | Lphn2 | 1152 |
| 3 | 149352800 | 149353800 | + | int | 1153 |
| 3 | 149669600 | 149670600 | + | int | 1154 |
| 3 | 150284000 | 150285200 | + | int | 1155 |
| 3 | 151264000 | 151265200 | + | int | 1156 |
| 3 | 151285600 | 151286600 | + | int | 1157 |
| 3 | 151789400 | 151790400 | − | Gipc2 | 1158 |
| 3 | 152620600 | 152622000 | − | St6galnac5 | 1159 |
| 3 | 153175400 | 153176400 | − | St6galnac3 | 1160 |
| 3 | 153494200 | 153495800 | + | int | 1161 |
| 3 | 154325600 | 154326600 | + | int | 1162 |
| 3 | 155135000 | 155136200 | + | int | 1163 |
| 3 | 155426800 | 155428000 | + | int | 1164 |
| 3 | 155503000 | 155504200 | + | int | 1165 |
| 3 | 155625400 | 155626400 | + | int | 1166 |
| 3 | 155660000 | 155661400 | + | int | 1167 |
| 3 | 155706800 | 155707800 | + | int | 1168 |
| 3 | 157490600 | 157491600 | + | int | 1169 |
| 3 | 157985400 | 157986400 | − | Lrrc7 | 1170 |
| 3 | 158808000 | 158809000 | + | int | 1171 |
| 3 | 158943000 | 158944000 | + | int | 1172 |
| 4 | 3808400 | 3809400 | + | int | 1173 |
| 4 | 4169200 | 4170200 | + | int | 1174 |
| 4 | 4478400 | 4479400 | + | int | 1175 |
| 4 | 4772000 | 4773000 | + | int | 1176 |
| 4 | 4789800 | 4790800 | + | int | 1177 |
| 4 | 5994600 | 5995600 | + | int | 1178 |
| 4 | 6072200 | 6073200 | + | int | 1179 |
| 4 | 6504600 | 6505800 | + | int | 1180 |
| 4 | 8657000 | 8658000 | + | Chd7 | 1181 |
| 4 | 10044200 | 10045200 | + | int | 1182 |
| 4 | 10404800 | 10405800 | + | int | 1183 |
| 4 | 11960600 | 11961600 | + | int | 1184 |
| 4 | 12868200 | 12869400 | + | Gm11818 | 1185 |
| 4 | 12920600 | 12921600 | + | int | 1186 |
| 4 | 13111200 | 13112200 | + | int | 1187 |
| 4 | 14063600 | 14065000 | + | int | 1188 |
| 4 | 14494800 | 14495800 | − | Slc26a7 | 1189 |
| 4 | 14716800 | 14718000 | − | Lrrc69 | 1190 |
| 4 | 14737400 | 14738800 | − | Otud6b | 1191 |
| 4 | 15099000 | 15100200 | + | int | 1192 |
| 4 | 15662000 | 15663400 | + | int | 1193 |
| 4 | 16119200 | 16120200 | + | int | 1194 |
| 4 | 16192200 | 16193200 | + | int | 1195 |
| 4 | 16252800 | 16254400 | + | int | 1196 |
| 4 | 16372800 | 16374200 | + | int | 1197 |
| 4 | 16456700 | 16457400 | + | int | 1198 |
| 4 | 16685200 | 16686400 | + | int | 1199 |
| 4 | 16781800 | 16782800 | + | int | 1200 |
| 4 | 17139400 | 17140400 | + | int | 1201 |
| 4 | 17283800 | 17284800 | + | int | 1202 |
| 4 | 17344600 | 17346000 | + | int | 1203 |
| 4 | 17421600 | 17422600 | + | int | 1204 |
| 4 | 17553600 | 17556800 | + | int | 1205 |
| 4 | 17899200 | 17900200 | + | Mmp16 | 1206 |
| 4 | 18112800 | 18114400 | + | int | 1207 |
| 4 | 18144000 | 18145600 | + | int | 1208 |
| 4 | 18521600 | 18522600 | + | int | 1209 |
| 4 | 18849000 | 18850200 | + | int | 1210 |
| 4 | 20249800 | 20251000 | − | Nkain3 | 1211 |
| 4 | 20494200 | 20495400 | − | Nkain3 | 1212 |
| 4 | 20595000 | 20596000 | − | Nkain3 | 1213 |
| 4 | 21527200 | 21528000 | + | int | 1214 |
| 4 | 22458800 | 22459800 | + | int | 1215 |
| 4 | 23006000 | 23007400 | + | int | 1216 |
| 4 | 23304000 | 23305000 | + | int | 1217 |
| 4 | 23338600 | 23340000 | + | int | 1218 |
| 4 | 23572000 | 23573200 | + | int | 1219 |
| 4 | 23869200 | 23870200 | + | int | 1220 |
| 4 | 24385800 | 24386800 | + | int | 1221 |
| 4 | 24398200 | 24399200 | + | int | 1222 |
| 4 | 25547000 | 25548200 | − | Fut9 | 1223 |
| 4 | 25581400 | 25582400 | − | Fut9 | 1224 |
| 4 | 25742600 | 25743600 | + | int | 1225 |
| 4 | 25847800 | 25849000 | + | int | 1226 |
| 4 | 26329200 | 26330400 | + | int | 1227 |
| 4 | 26520400 | 26521400 | + | int | 1228 |
| 4 | 26593400 | 26594600 | + | int | 1229 |
| 4 | 26747200 | 26748200 | + | int | 1230 |
| 4 | 28208400 | 28209400 | + | int | 1231 |
| 4 | 28280800 | 28282200 | + | int | 1232 |

TABLE 1-continued

| chromosome | start | stop | strand | nearest gene | ID |
|---|---|---|---|---|---|
| 4 | 28742000 | 28743000 | + | Epha7 | 1233 |
| 4 | 28742000 | 28743000 | + | Epha7 | 1234 |
| 4 | 28839200 | 28840600 | + | Epha7 | 1235 |
| 4 | 28839200 | 28840600 | + | Epha7 | 1236 |
| 4 | 29286400 | 29287400 | + | int | 1237 |
| 4 | 29293400 | 29294400 | + | int | 1238 |
| 4 | 29800400 | 29801800 | + | int | 1239 |
| 4 | 30466000 | 30467400 | + | int | 1240 |
| 4 | 31373600 | 31375000 | + | int | 1241 |
| 4 | 32068200 | 32069600 | + | Map3k7 | 1242 |
| 4 | 33807600 | 33808600 | + | int | 1243 |
| 4 | 34283200 | 34284200 | + | int | 1244 |
| 4 | 34296400 | 34298000 | + | int | 1245 |
| 4 | 34301000 | 34302400 | + | int | 1246 |
| 4 | 35533800 | 35535400 | + | int | 1247 |
| 4 | 36101800 | 36102800 | − | Lingo2 | 1248 |
| 4 | 36101800 | 36102800 | − | Lingo2 | 1249 |
| 4 | 36313400 | 36314600 | − | Lingo2 | 1250 |
| 4 | 36313400 | 36314600 | − | Lingo2 | 1251 |
| 4 | 36405000 | 36406000 | − | Lingo2 | 1252 |
| 4 | 36405000 | 36406000 | − | Lingo2 | 1253 |
| 4 | 36566200 | 36567200 | − | Lingo2 | 1254 |
| 4 | 36566200 | 36567200 | − | Lingo2 | 1255 |
| 4 | 36846000 | 36847000 | − | Lingo2 | 1256 |
| 4 | 37023800 | 37025000 | + | int | 1257 |
| 4 | 37157400 | 37158800 | + | int | 1258 |
| 4 | 37338600 | 37339800 | + | int | 1259 |
| 4 | 37367800 | 37369000 | + | int | 1260 |
| 4 | 37416600 | 37417600 | + | int | 1261 |
| 4 | 37556000 | 37557000 | + | int | 1262 |
| 4 | 37753600 | 37754600 | + | int | 1263 |
| 4 | 37756400 | 37757600 | + | int | 1264 |
| 4 | 37889400 | 37890600 | + | int | 1265 |
| 4 | 38191800 | 38192800 | + | int | 1266 |
| 4 | 38210600 | 38211600 | + | int | 1267 |
| 4 | 38361000 | 38362400 | + | int | 1268 |
| 4 | 38710600 | 38711600 | + | int | 1269 |
| 4 | 38795600 | 38796600 | + | int | 1270 |
| 4 | 38897800 | 38899200 | + | int | 1271 |
| 4 | 38951000 | 38952000 | + | int | 1272 |
| 4 | 39010200 | 39011600 | + | int | 1273 |
| 4 | 39022000 | 39023400 | + | int | 1274 |
| 4 | 39121400 | 39122400 | + | int | 1275 |
| 4 | 41065600 | 41066600 | − | Nol6 | 1276 |
| 4 | 42169400 | 42170400 | + | int | 1277 |
| 4 | 42847400 | 42848600 | + | int | 1278 |
| 4 | 44362800 | 44364800 | + | Melk | 1279 |
| 4 | 47380000 | 47381200 | + | Tgfbr1 | 1280 |
| 4 | 47471600 | 47473200 | + | int | 1281 |
| 4 | 48459000 | 48460400 | − | Tex10 | 1282 |
| 4 | 49953600 | 49954600 | + | int | 1283 |
| 4 | 50339400 | 50340800 | + | int | 1284 |
| 4 | 50522200 | 50523200 | + | int | 1285 |
| 4 | 50646000 | 50647400 | + | int | 1286 |
| 4 | 51324500 | 51325600 | + | int | 1287 |
| 4 | 51439200 | 51440600 | + | int | 1288 |
| 4 | 51935400 | 51936600 | + | int | 1289 |
| 4 | 52100600 | 52101600 | + | int | 1290 |
| 4 | 52215200 | 52216200 | + | int | 1291 |
| 4 | 52528000 | 52529000 | + | int | 1292 |
| 4 | 52850200 | 52851200 | + | int | 1293 |
| 4 | 53340000 | 53341000 | + | int | 1294 |
| 4 | 53548400 | 53549600 | + | Slc44a1 | 1295 |
| 4 | 53548400 | 53549600 | + | Slc44a1 | 1296 |
| 4 | 59145200 | 59146200 | + | int | 1297 |
| 4 | 60032800 | 60034200 | + | int | 1298 |
| 4 | 60604800 | 60606600 | − | LOC100048885 | 1299 |
| 4 | 60604800 | 60606600 | − | Mup2 | 1300 |
| 4 | 61241400 | 61242400 | + | int | 1301 |
| 4 | 61379600 | 61380600 | + | int | 1302 |
| 4 | 64140000 | 64141000 | + | int | 1303 |
| 4 | 64401000 | 64402400 | + | int | 1304 |
| 4 | 64413000 | 64414000 | + | int | 1305 |
| 4 | 65176600 | 65178000 | − | Astn2 | 1306 |
| 4 | 66365000 | 66366000 | + | int | 1307 |
| 4 | 67233400 | 67234400 | + | int | 1308 |
| 4 | 67313400 | 67315000 | + | int | 1309 |
| 4 | 67626600 | 67627600 | + | int | 1310 |
| 4 | 67781400 | 67782600 | + | int | 1311 |
| 4 | 68062400 | 68063400 | + | int | 1312 |
| 4 | 68149000 | 68150200 | + | int | 1313 |
| 4 | 69016800 | 69017800 | + | int | 1314 |
| 4 | 70332000 | 70333000 | + | int | 1315 |
| 4 | 71130200 | 71131400 | + | int | 1316 |
| 4 | 71238800 | 71240000 | + | int | 1317 |
| 4 | 72546400 | 72548000 | + | int | 1318 |
| 4 | 72780600 | 72782000 | + | int | 1319 |
| 4 | 72894200 | 72895200 | + | int | 1320 |
| 4 | 73089000 | 73090200 | + | int | 1321 |
| 4 | 74031000 | 74032000 | + | Kdm4c | 1322 |
| 4 | 74031000 | 74032000 | + | Kdm4c | 1323 |
| 4 | 74484600 | 74485600 | + | int | 1324 |
| 4 | 74619400 | 74620600 | + | int | 1325 |
| 4 | 74739800 | 74741600 | + | int | 1326 |
| 4 | 74776000 | 74777200 | + | int | 1327 |
| 4 | 75030400 | 75031600 | + | int | 1328 |
| 4 | 75271800 | 75272800 | + | int | 1329 |
| 4 | 75550200 | 75551200 | + | int | 1330 |
| 4 | 76342400 | 76343800 | + | int | 1331 |
| 4 | 76457000 | 76458400 | + | int | 1332 |
| 4 | 77249400 | 77250600 | + | int | 1333 |
| 4 | 77345800 | 77347000 | + | int | 1334 |
| 4 | 77386400 | 77387400 | + | int | 1335 |
| 4 | 77557000 | 77558000 | + | int | 1336 |
| 4 | 77918600 | 77919600 | + | int | 1337 |
| 4 | 78037800 | 78039200 | + | int | 1338 |
| 4 | 78241200 | 78242400 | + | int | 1339 |
| 4 | 78341200 | 78342400 | + | int | 1340 |
| 4 | 78706200 | 78707200 | + | int | 1341 |
| 4 | 78748400 | 78749400 | + | int | 1342 |
| 4 | 78991200 | 78992400 | + | int | 1343 |
| 4 | 79015000 | 79016000 | + | int | 1344 |
| 4 | 79336000 | 79337000 | + | int | 1345 |
| 4 | 79444400 | 79445400 | + | int | 1346 |
| 4 | 79464400 | 79465400 | + | int | 1347 |
| 4 | 80049400 | 80050400 | + | int | 1348 |
| 4 | 80076200 | 80077600 | + | int | 1349 |
| 4 | 80302600 | 80303600 | + | int | 1350 |
| 4 | 81962200 | 81963200 | − | Nfib | 1351 |
| 4 | 82366200 | 82367200 | + | int | 1352 |
| 4 | 82451800 | 82452800 | − | Zdhhc21 | 1353 |
| 4 | 82719600 | 82720800 | + | int | 1354 |
| 4 | 83522400 | 83523400 | + | int | 1355 |
| 4 | 84220400 | 84221600 | − | Bnc2 | 1356 |
| 4 | 84457000 | 84458000 | + | int | 1357 |
| 4 | 85432800 | 85434200 | + | int | 1358 |
| 4 | 88407000 | 88408800 | + | int | 1359 |
| 4 | 90961400 | 90962600 | − | Elavl2 | 1360 |
| 4 | 90961400 | 90962600 | − | Elavl2 | 1361 |
| 4 | 90961400 | 90962600 | − | Elavl2 | 1362 |
| 4 | 91050200 | 91051200 | − | Elavl2 | 1363 |
| 4 | 91435600 | 91437200 | + | int | 1364 |
| 4 | 91460000 | 91461000 | + | int | 1365 |
| 4 | 91540800 | 91542000 | + | int | 1366 |
| 4 | 91777800 | 91778800 | + | int | 1367 |
| 4 | 92088800 | 92090000 | + | int | 1368 |
| 4 | 92156800 | 92158000 | + | int | 1369 |
| 4 | 92456800 | 92457800 | + | int | 1370 |
| 4 | 92517200 | 92518400 | + | int | 1371 |
| 4 | 92528200 | 92529600 | + | int | 1372 |
| 4 | 92587600 | 92588600 | + | int | 1373 |
| 4 | 92738000 | 92739000 | + | int | 1374 |
| 4 | 93245800 | 93246800 | + | int | 1375 |
| 4 | 93292000 | 93293000 | + | int | 1376 |
| 4 | 93965800 | 93967000 | + | int | 1377 |
| 4 | 95030600 | 95031800 | + | int | 1378 |
| 4 | 95885800 | 95886800 | − | Cyp2j7-ps | 1379 |
| 4 | 96290400 | 96291400 | + | int | 1380 |
| 4 | 98691200 | 98692200 | + | Dock7 | 1381 |
| 4 | 99989200 | 99990600 | + | Ror1 | 1382 |
| 4 | 100655400 | 100656600 | + | Cachd1 | 1383 |
| 4 | 101618000 | 101619000 | + | int | 1384 |
| 4 | 102944800 | 102945800 | − | 4921539E11Rik | 1385 |
| 4 | 103117000 | 103118000 | + | int | 1386 |

TABLE 1-continued

| chromosome | start | stop | strand | nearest gene | ID |
|---|---|---|---|---|---|
| 4 | 110122000 | 110123400 | + | Agbl4 | 1387 |
| 4 | 110134200 | 110135200 | + | Agbl4 | 1388 |
| 4 | 110750400 | 110751800 | + | Agbl4 | 1389 |
| 4 | 111071800 | 111073000 | + | Agbl4 | 1390 |
| 4 | 117675600 | 117676600 | − | St3gal3 | 1391 |
| 4 | 117675600 | 117676600 | − | St3gal3 | 1392 |
| 4 | 118329200 | 118330200 | + | int | 1393 |
| 4 | 119369600 | 119370600 | + | int | 1394 |
| 4 | 120168000 | 120169000 | + | Scmh1 | 1395 |
| 4 | 120350400 | 120351400 | + | int | 1396 |
| 4 | 121129200 | 121130200 | + | int | 1397 |
| 4 | 123522400 | 123523400 | + | int | 1398 |
| 4 | 123776400 | 123777400 | + | int | 1399 |
| 4 | 126425000 | 126426200 | − | Ncdn | 1400 |
| 4 | 127658200 | 127659200 | + | int | 1401 |
| 4 | 128554200 | 128555600 | + | int | 1402 |
| 4 | 129024400 | 129025400 | + | int | 1403 |
| 4 | 129755600 | 129756600 | + | Col16a1 | 1404 |
| 4 | 133130200 | 133131200 | + | Gpatch3 | 1405 |
| 4 | 133473800 | 133475000 | + | int | 1406 |
| 4 | 134096200 | 134097800 | − | Sepn1 | 1407 |
| 4 | 134128400 | 134129400 | − | Man1c1 | 1408 |
| 4 | 134150000 | 134151800 | − | Man1c1 | 1409 |
| 4 | 135631400 | 135632600 | + | int | 1410 |
| 4 | 135811400 | 135812400 | + | Tcea3 | 1411 |
| 4 | 138547200 | 138548800 | + | Tmco4 | 1412 |
| 4 | 139652000 | 139653000 | − | Igsf21 | 1413 |
| 4 | 140179000 | 140180000 | − | Arhgef10l | 1414 |
| 4 | 140179000 | 140180000 | − | Arhgef10l | 1415 |
| 4 | 140600600 | 140601600 | − | Crocc | 1416 |
| 4 | 140600600 | 140601600 | − | Crocc | 1417 |
| 4 | 140951600 | 140953000 | − | Clcnka | 1418 |
| 4 | 140951600 | 140953000 | − | Clcnka | 1419 |
| 4 | 141514200 | 141515200 | − | Fhad1 | 1420 |
| 4 | 142583200 | 142584400 | + | int | 1421 |
| 4 | 142814800 | 142816200 | + | int | 1422 |
| 4 | 142831600 | 142832600 | + | int | 1423 |
| 4 | 143573200 | 143575000 | + | int | 1424 |
| 4 | 143577600 | 143579000 | + | int | 1425 |
| 4 | 144914000 | 144915200 | + | int | 1426 |
| 4 | 145042600 | 145044000 | + | int | 1427 |
| 4 | 145421200 | 145422600 | + | int | 1428 |
| 4 | 145664600 | 145665600 | + | int | 1429 |
| 4 | 146134600 | 146135600 | + | Zfp600 | 1430 |
| 4 | 146134600 | 146135600 | + | Zfp600 | 1431 |
| 4 | 146556000 | 146557400 | + | 1700029I01Rik | 1432 |
| 4 | 146556000 | 146557400 | + | Gm13152 | 1433 |
| 4 | 146717000 | 146718200 | + | Gm13152 | 1434 |
| 4 | 146810600 | 146811600 | + | Gm13152 | 1435 |
| 4 | 147135600 | 147136600 | − | Gm13157 | 1436 |
| 4 | 147299400 | 147300400 | − | Plod1 | 1437 |
| 4 | 148703800 | 148705200 | + | Ube4b | 1438 |
| 4 | 150008800 | 150009800 | − | Slc45a1 | 1439 |
| 4 | 150199000 | 150200000 | + | int | 1440 |
| 4 | 150554600 | 150555600 | − | Camta1 | 1441 |
| 4 | 151351600 | 151352800 | + | Dnajc11 | 1442 |
| 4 | 151809000 | 151810000 | − | Kcnab2 | 1443 |
| 4 | 152277600 | 152280600 | + | int | 1444 |
| 4 | 154362400 | 154364200 | − | Plch2 | 1445 |
| 4 | 154428200 | 154429400 | + | int | 1446 |
| 4 | 155233600 | 155235000 | − | Tas1r3 | 1447 |
| 5 | 3292200 | 3293200 | + | int | 1448 |
| 5 | 3612000 | 3613200 | + | Pex1 | 1449 |
| 5 | 4361600 | 4362600 | + | int | 1450 |
| 5 | 4423400 | 4424400 | + | int | 1451 |
| 5 | 5948400 | 5949800 | + | int | 1452 |
| 5 | 6357200 | 6358400 | + | int | 1453 |
| 5 | 6428400 | 6429400 | + | int | 1454 |
| 5 | 8276200 | 8277200 | − | Adam22 | 1455 |
| 5 | 8276200 | 8277200 | − | Adam22 | 1456 |
| 5 | 8276200 | 8277200 | − | Adam22 | 1457 |
| 5 | 8487600 | 8488600 | + | int | 1458 |
| 5 | 8728600 | 8729600 | + | Abcb1a | 1459 |
| 5 | 10565000 | 10566200 | + | int | 1460 |
| 5 | 10642800 | 10644000 | + | int | 1461 |
| 5 | 11945600 | 11947200 | + | int | 1462 |
| 5 | 13094400 | 13095800 | + | int | 1463 |
| 5 | 13203200 | 13204200 | + | int | 1464 |
| 5 | 13319000 | 13320600 | + | int | 1465 |
| 5 | 13542000 | 13543000 | + | Sema3a | 1466 |
| 5 | 13599000 | 13600000 | + | Sema3a | 1467 |
| 5 | 13807600 | 13808600 | + | int | 1468 |
| 5 | 14933200 | 14934800 | − | Speer4e | 1469 |
| 5 | 14974200 | 14975200 | + | Speer8-ps1 | 1470 |
| 5 | 15194600 | 15195600 | + | Speer7-ps1 | 1471 |
| 5 | 15613600 | 15615400 | + | Cacna2d1 | 1472 |
| 5 | 15984600 | 15985600 | + | int | 1473 |
| 5 | 16589400 | 16590400 | + | int | 1474 |
| 5 | 17204400 | 17205600 | + | Sema3c | 1475 |
| 5 | 17406200 | 17407200 | + | int | 1476 |
| 5 | 17626400 | 17628000 | + | int | 1477 |
| 5 | 17703600 | 17704800 | + | int | 1478 |
| 5 | 19124400 | 19125600 | + | Magi2 | 1479 |
| 5 | 19148600 | 19149600 | + | Magi2 | 1480 |
| 5 | 21254600 | 21255600 | + | Pmpcb | 1481 |
| 5 | 21597000 | 21598000 | − | Reln | 1482 |
| 5 | 22608400 | 22609400 | + | Lhfpl3 | 1483 |
| 5 | 22685400 | 22686800 | + | Lhfpl3 | 1484 |
| 5 | 28488200 | 28489200 | + | int | 1485 |
| 5 | 28822400 | 28823400 | + | 9530036O11Rik | 1486 |
| 5 | 29326000 | 29327200 | + | int | 1487 |
| 5 | 33072000 | 33073200 | + | int | 1488 |
| 5 | 33075800 | 33077200 | + | int | 1489 |
| 5 | 33081000 | 33084800 | − | Pisd | 1490 |
| 5 | 35588800 | 35590400 | + | int | 1491 |
| 5 | 39681200 | 39682400 | + | int | 1492 |
| 5 | 40825800 | 40826800 | + | int | 1493 |
| 5 | 41358400 | 41359400 | + | int | 1494 |
| 5 | 42036600 | 42037800 | − | Rab28 | 1495 |
| 5 | 42288600 | 42289600 | + | int | 1496 |
| 5 | 43178400 | 43179400 | + | int | 1497 |
| 5 | 43327000 | 43328000 | + | int | 1498 |
| 5 | 46996800 | 46997800 | + | int | 1499 |
| 5 | 47249800 | 47251000 | + | int | 1500 |
| 5 | 47267200 | 47268400 | + | int | 1501 |
| 5 | 47939200 | 47940200 | + | int | 1502 |
| 5 | 48281600 | 48283000 | + | int | 1503 |
| 5 | 49764400 | 49765400 | + | int | 1504 |
| 5 | 49989200 | 49990200 | + | int | 1505 |
| 5 | 50510600 | 50511600 | + | int | 1506 |
| 5 | 50667200 | 50668800 | + | int | 1507 |
| 5 | 52144600 | 52145600 | + | int | 1508 |
| 5 | 52889600 | 52890600 | + | int | 1509 |
| 5 | 53327600 | 53328600 | + | int | 1510 |
| 5 | 53456000 | 53457200 | + | Slc34a2 | 1511 |
| 5 | 54183600 | 54185000 | + | int | 1512 |
| 5 | 54195600 | 54196600 | + | int | 1513 |
| 5 | 54485200 | 54486200 | + | Stim2 | 1514 |
| 5 | 54534000 | 54535200 | + | int | 1515 |
| 5 | 54941800 | 54942800 | + | int | 1516 |
| 5 | 54945000 | 54946200 | + | int | 1517 |
| 5 | 55224800 | 55226000 | + | int | 1518 |
| 5 | 55788200 | 55789600 | + | int | 1519 |
| 5 | 55793800 | 55795000 | + | int | 1520 |
| 5 | 55965600 | 55966600 | + | int | 1521 |
| 5 | 56106800 | 56107800 | + | int | 1522 |
| 5 | 56137400 | 56138400 | + | int | 1523 |
| 5 | 56440800 | 56442600 | + | int | 1524 |
| 5 | 56521400 | 56522600 | + | int | 1525 |
| 5 | 57202600 | 57203800 | + | int | 1526 |
| 5 | 58412000 | 58413000 | + | Pcdh7 | 1527 |
| 5 | 59003600 | 59004600 | + | int | 1528 |
| 5 | 59028800 | 59029800 | + | int | 1529 |
| 5 | 59093000 | 59094200 | + | int | 1530 |
| 5 | 59142600 | 59144000 | + | int | 1531 |
| 5 | 59237800 | 59239000 | + | int | 1532 |
| 5 | 59278800 | 59279800 | + | int | 1533 |
| 5 | 59303600 | 59305200 | + | int | 1534 |
| 5 | 59336200 | 59337200 | + | int | 1535 |
| 5 | 59682600 | 59684000 | + | int | 1536 |
| 5 | 59801200 | 59802400 | + | int | 1537 |
| 5 | 59940200 | 59941600 | + | int | 1538 |
| 5 | 60437800 | 60439200 | + | int | 1539 |
| 5 | 60743000 | 60744200 | + | int | 1540 |

TABLE 1-continued

| chromosome | start | stop | strand | nearest gene | ID |
|---|---|---|---|---|---|
| 5 | 60881800 | 60882800 | + | int | 1541 |
| 5 | 61190600 | 61191600 | + | int | 1542 |
| 5 | 61212800 | 61214000 | + | int | 1543 |
| 5 | 61291200 | 61292200 | + | int | 1544 |
| 5 | 61302800 | 61304200 | + | int | 1545 |
| 5 | 61497600 | 61498800 | + | int | 1546 |
| 5 | 61592400 | 61593400 | + | int | 1547 |
| 5 | 61649600 | 61650600 | + | int | 1548 |
| 5 | 61868800 | 61870200 | + | int | 1549 |
| 5 | 61951800 | 61953200 | + | int | 1550 |
| 5 | 62003800 | 62005000 | + | int | 1551 |
| 5 | 62195000 | 62196000 | + | int | 1552 |
| 5 | 62472800 | 62473800 | + | int | 1553 |
| 5 | 62564200 | 62565400 | + | int | 1554 |
| 5 | 62692000 | 62693000 | + | int | 1555 |
| 5 | 62730800 | 62731800 | + | int | 1556 |
| 5 | 63515600 | 63516600 | + | int | 1557 |
| 5 | 63536800 | 63537800 | + | int | 1558 |
| 5 | 68779400 | 68780400 | + | int | 1559 |
| 5 | 69210600 | 69211800 | + | int | 1560 |
| 5 | 69959000 | 69960000 | + | Gufl | 1561 |
| 5 | 70008200 | 70009600 | + | int | 1562 |
| 5 | 70279200 | 70280200 | + | int | 1563 |
| 5 | 70346000 | 70347400 | + | int | 1564 |
| 5 | 70995800 | 70997000 | + | int | 1565 |
| 5 | 71141400 | 71142600 | − | Gabrg1 | 1566 |
| 5 | 71269200 | 71270200 | + | int | 1567 |
| 5 | 71985600 | 71986800 | − | Gabra4 | 1568 |
| 5 | 73834400 | 73835600 | + | Cwh43 | 1569 |
| 5 | 74310400 | 74311400 | + | int | 1570 |
| 5 | 79128400 | 79129400 | + | int | 1571 |
| 5 | 79261400 | 79262600 | + | int | 1572 |
| 5 | 79391400 | 79392400 | + | int | 1573 |
| 5 | 79412800 | 79414200 | + | int | 1574 |
| 5 | 79583000 | 79584200 | + | int | 1575 |
| 5 | 79670400 | 79671600 | + | int | 1576 |
| 5 | 80360000 | 80361200 | + | int | 1577 |
| 5 | 80660000 | 80661600 | + | int | 1578 |
| 5 | 80722800 | 80723800 | + | int | 1579 |
| 5 | 81194800 | 81195800 | + | int | 1580 |
| 5 | 81633600 | 81634600 | + | Lphn3 | 1581 |
| 5 | 81735600 | 81736600 | + | Lphn3 | 1582 |
| 5 | 82594800 | 82595800 | + | int | 1583 |
| 5 | 82871600 | 82872600 | + | int | 1584 |
| 5 | 83023800 | 83025000 | + | int | 1585 |
| 5 | 83154200 | 83155800 | + | int | 1586 |
| 5 | 83233200 | 83234400 | + | int | 1587 |
| 5 | 83577600 | 83578800 | + | int | 1588 |
| 5 | 83662800 | 83663800 | + | int | 1589 |
| 5 | 83897200 | 83898200 | + | int | 1590 |
| 5 | 83905600 | 83906400 | + | int | 1591 |
| 5 | 84352600 | 84353600 | + | int | 1592 |
| 5 | 84625800 | 84627200 | − | Epha5 | 1593 |
| 5 | 84862000 | 84863600 | + | int | 1594 |
| 5 | 84901200 | 84902600 | + | int | 1595 |
| 5 | 85465800 | 85466800 | + | int | 1596 |
| 5 | 85563000 | 85564000 | + | int | 1597 |
| 5 | 86162000 | 86163000 | + | int | 1598 |
| 5 | 86760600 | 86761800 | − | Tmprss11d | 1599 |
| 5 | 87020400 | 87021400 | − | Tmprss11f | 1600 |
| 5 | 87310800 | 87312200 | + | int | 1601 |
| 5 | 87529200 | 87530400 | + | int | 1602 |
| 5 | 88087200 | 88088600 | + | int | 1603 |
| 5 | 88472400 | 88473200 | + | int | 1604 |
| 5 | 90264000 | 90265000 | − | Adamts3 | 1605 |
| 5 | 91633000 | 91634000 | + | int | 1606 |
| 5 | 92115600 | 92117000 | + | int | 1607 |
| 5 | 94177000 | 94178000 | + | int | 1608 |
| 5 | 96519400 | 96520800 | − | Cnot6l | 1609 |
| 5 | 96519400 | 96520800 | − | Cnot6l | 1610 |
| 5 | 96942000 | 96943000 | + | Fras1 | 1611 |
| 5 | 98046000 | 98047000 | + | int | 1612 |
| 5 | 98151800 | 98153000 | + | int | 1613 |
| 5 | 98955200 | 98956400 | + | 1700007G11Rik | 1614 |
| 5 | 99155000 | 99156000 | + | 1700007G11Rik | 1615 |
| 5 | 99195800 | 99196800 | + | 1700007G11Rik | 1616 |
| 5 | 102262800 | 102263800 | − | Wdfy3 | 1617 |
| 5 | 102434800 | 102435800 | − | Wdfy3 | 1618 |
| 5 | 103134200 | 103135200 | + | Arhgap24 | 1619 |
| 5 | 104357600 | 104358600 | + | int | 1620 |
| 5 | 109166400 | 109167400 | + | int | 1621 |
| 5 | 109332200 | 109333200 | + | int | 1622 |
| 5 | 109623000 | 109624000 | − | Vmn2r13 | 1623 |
| 5 | 109669400 | 109670400 | + | int | 1624 |
| 5 | 109831200 | 109832600 | + | int | 1625 |
| 5 | 110362400 | 110363600 | + | int | 1626 |
| 5 | 110936400 | 110937400 | + | int | 1627 |
| 5 | 111690800 | 111691800 | + | Ttc28 | 1628 |
| 5 | 111905000 | 111906000 | + | int | 1629 |
| 5 | 113490400 | 113491400 | − | Crybb2 | 1630 |
| 5 | 114571000 | 114572000 | + | Usp30 | 1631 |
| 5 | 116666800 | 116667800 | − | Ccdc60 | 1632 |
| 5 | 122055400 | 122056600 | − | 9330129D05Rik | 1633 |
| 5 | 125744600 | 125745600 | + | int | 1634 |
| 5 | 126231400 | 126233000 | + | Tmem132b | 1635 |
| 5 | 126426800 | 126427800 | + | int | 1636 |
| 5 | 126541000 | 126542400 | + | int | 1637 |
| 5 | 127984600 | 127985600 | + | Tmem132c | 1638 |
| 5 | 130577400 | 130578600 | + | Tpst1 | 1639 |
| 5 | 130577400 | 130578600 | + | Tpst1 | 1640 |
| 5 | 133197600 | 133198800 | + | int | 1641 |
| 5 | 134482400 | 134483400 | + | int | 1642 |
| 5 | 134490200 | 134491400 | + | int | 1643 |
| 5 | 135262400 | 135263600 | + | int | 1644 |
| 5 | 137639400 | 137640400 | + | int | 1645 |
| 5 | 137711200 | 137712200 | + | int | 1646 |
| 5 | 137934800 | 137935800 | + | int | 1647 |
| 5 | 138713600 | 138714800 | − | Gal3st4 | 1648 |
| 5 | 138975200 | 138976200 | + | int | 1649 |
| 5 | 141760800 | 141761800 | + | Sdk1 | 1650 |
| 5 | 145294600 | 145295600 | + | int | 1651 |
| 5 | 145807600 | 145808600 | + | int | 1652 |
| 5 | 146827200 | 146828200 | + | int | 1653 |
| 5 | 147071800 | 147073600 | + | Cdk8 | 1654 |
| 5 | 147360200 | 147361400 | + | int | 1655 |
| 5 | 147692000 | 147693200 | + | int | 1656 |
| 5 | 149146800 | 149147800 | − | Slc7a1 | 1657 |
| 5 | 150800000 | 150801400 | + | int | 1658 |
| 5 | 152408000 | 152409000 | + | int | 1659 |
| 6 | 3000000 | 3001400 | + | int | 1660 |
| 6 | 3150400 | 3152000 | + | int | 1661 |
| 6 | 3166400 | 3167600 | + | int | 1662 |
| 6 | 3511600 | 3512600 | + | Ccdc132 | 1663 |
| 6 | 3511600 | 3512600 | + | Ccdc132 | 1664 |
| 6 | 3632600 | 3633600 | + | int | 1665 |
| 6 | 4550200 | 4551200 | + | Casd1 | 1666 |
| 6 | 4560000 | 4561000 | + | Casd1 | 1667 |
| 6 | 4841800 | 4842800 | + | int | 1668 |
| 6 | 5675600 | 5676600 | + | Dync1i1 | 1669 |
| 6 | 7615600 | 7617000 | + | int | 1670 |
| 6 | 9224000 | 9225400 | + | int | 1671 |
| 6 | 9236000 | 9237600 | + | int | 1672 |
| 6 | 9269600 | 9270600 | + | int | 1673 |
| 6 | 9389800 | 9391200 | + | int | 1674 |
| 6 | 9430800 | 9432400 | + | int | 1675 |
| 6 | 9685600 | 9686600 | + | int | 1676 |
| 6 | 9719400 | 9721000 | + | int | 1677 |
| 6 | 9756400 | 9757800 | + | int | 1678 |
| 6 | 10121600 | 10123200 | + | int | 1679 |
| 6 | 10666800 | 10668000 | + | int | 1680 |
| 6 | 10761400 | 10762600 | + | int | 1681 |
| 6 | 11055400 | 11056600 | + | int | 1682 |
| 6 | 11249000 | 11250000 | + | int | 1683 |
| 6 | 11670400 | 11671400 | + | int | 1684 |
| 6 | 12363200 | 12364200 | − | Thsd7a | 1685 |
| 6 | 13864200 | 13865200 | + | int | 1686 |
| 6 | 14216400 | 14217400 | + | int | 1687 |
| 6 | 14538800 | 14540000 | + | int | 1688 |
| 6 | 14983200 | 14984400 | + | Foxp2 | 1689 |
| 6 | 15103000 | 15104200 | + | Foxp2 | 1690 |
| 6 | 15414800 | 15415800 | + | int | 1691 |
| 6 | 15557400 | 15558400 | + | int | 1692 |
| 6 | 15946400 | 15947800 | + | int | 1693 |
| 6 | 16727000 | 16728200 | + | int | 1694 |

TABLE 1-continued

| chromosome | start | stop | strand | nearest gene | ID |
|---|---|---|---|---|---|
| 6 | 16983800 | 16985200 | + | int | 1695 |
| 6 | 17181800 | 17183000 | + | int | 1696 |
| 6 | 17852800 | 17853800 | + | St7 | 1697 |
| 6 | 18613600 | 18614600 | + | int | 1698 |
| 6 | 18917800 | 18919200 | + | int | 1699 |
| 6 | 19162600 | 19163600 | + | int | 1700 |
| 6 | 19870600 | 19871800 | + | int | 1701 |
| 6 | 20128000 | 20129200 | + | int | 1702 |
| 6 | 20518600 | 20520000 | + | int | 1703 |
| 6 | 20759800 | 20761000 | + | int | 1704 |
| 6 | 20899200 | 20900400 | + | int | 1705 |
| 6 | 21030800 | 21032000 | + | int | 1706 |
| 6 | 21181000 | 21182000 | + | Kcnd2 | 1707 |
| 6 | 21195000 | 21196000 | + | Kcnd2 | 1708 |
| 6 | 21235200 | 21236400 | + | Kcnd2 | 1709 |
| 6 | 22204000 | 22205000 | + | A430107O13Rik | 1710 |
| 6 | 22546200 | 22547600 | + | int | 1711 |
| 6 | 22582800 | 22584400 | + | int | 1712 |
| 6 | 23906800 | 23908000 | + | int | 1713 |
| 6 | 24915400 | 24916600 | + | int | 1714 |
| 6 | 24983000 | 24984200 | + | int | 1715 |
| 6 | 25811200 | 25812400 | + | int | 1716 |
| 6 | 26157400 | 26158400 | + | int | 1717 |
| 6 | 26420800 | 26422000 | + | int | 1718 |
| 6 | 26752800 | 26753800 | + | int | 1719 |
| 6 | 26927600 | 26928800 | + | int | 1720 |
| 6 | 27838600 | 27839600 | − | Grm8 | 1721 |
| 6 | 28164600 | 28165800 | + | int | 1722 |
| 6 | 28487400 | 28488400 | + | Snd1 | 1723 |
| 6 | 29184000 | 29185200 | + | int | 1724 |
| 6 | 31446000 | 31447000 | + | Mkln1 | 1725 |
| 6 | 32117200 | 32118200 | − | Plxna4 | 1726 |
| 6 | 33269600 | 33270800 | + | Exoc4 | 1727 |
| 6 | 33316000 | 33317000 | + | Exoc4 | 1728 |
| 6 | 33830000 | 33831000 | + | Exoc4 | 1729 |
| 6 | 34151000 | 34152200 | + | int | 1730 |
| 6 | 35338200 | 35339400 | + | int | 1731 |
| 6 | 35673800 | 35674800 | + | int | 1732 |
| 6 | 35861800 | 35862800 | + | int | 1733 |
| 6 | 37290200 | 37291400 | − | Creb3l2 | 1734 |
| 6 | 39093000 | 39094000 | − | Jhdm1d | 1735 |
| 6 | 41074000 | 41075200 | + | int | 1736 |
| 6 | 41465000 | 41466200 | + | int | 1737 |
| 6 | 42436200 | 42437200 | − | Olfr456 | 1738 |
| 6 | 43081400 | 43082400 | + | int | 1739 |
| 6 | 43819000 | 43821800 | + | int | 1740 |
| 6 | 44019000 | 44020200 | + | int | 1741 |
| 6 | 44182200 | 44183200 | + | int | 1742 |
| 6 | 44745800 | 44747000 | + | int | 1743 |
| 6 | 44778800 | 44780400 | + | int | 1744 |
| 6 | 44840400 | 44841600 | + | int | 1745 |
| 6 | 44932200 | 44933400 | + | int | 1746 |
| 6 | 45148600 | 45149600 | + | Cntnap2 | 1747 |
| 6 | 45536000 | 45537000 | + | Cntnap2 | 1748 |
| 6 | 45841600 | 45842600 | + | Cntnap2 | 1749 |
| 6 | 45882000 | 45883000 | + | Cntnap2 | 1750 |
| 6 | 45954400 | 45955400 | + | Cntnap2 | 1751 |
| 6 | 46014200 | 46015200 | + | Cntnap2 | 1752 |
| 6 | 46016400 | 46017600 | + | Cntnap2 | 1753 |
| 6 | 46505000 | 46506200 | + | Cntnap2 | 1754 |
| 6 | 49167400 | 49168800 | − | Igf2bp3 | 1755 |
| 6 | 49378800 | 49379800 | + | Stk31 | 1756 |
| 6 | 49417600 | 49418600 | + | Stk31 | 1757 |
| 6 | 50882000 | 50883000 | + | int | 1758 |
| 6 | 51035600 | 51036600 | + | int | 1759 |
| 6 | 51715600 | 51716800 | + | int | 1760 |
| 6 | 54116800 | 54117800 | + | Chn2 | 1761 |
| 6 | 54425800 | 54426800 | + | Wipf3 | 1762 |
| 6 | 55917800 | 55919200 | + | Ccdc129 | 1763 |
| 6 | 56181800 | 56182800 | − | Pde1c | 1764 |
| 6 | 56181800 | 56182800 | − | Pde1c | 1765 |
| 6 | 56181800 | 56182800 | − | Pde1c | 1766 |
| 6 | 56181800 | 56182800 | − | Pde1c | 1767 |
| 6 | 56181800 | 56182800 | − | Pde1c | 1768 |
| 6 | 56181800 | 56182800 | − | Pde1c | 1769 |
| 6 | 56267400 | 56269000 | − | Pde1c | 1770 |
| 6 | 56267400 | 56269000 | − | Pde1c | 1771 |
| 6 | 56267400 | 56269000 | − | Pde1c | 1772 |
| 6 | 56267400 | 56269000 | − | Pde1c | 1773 |
| 6 | 56267400 | 56269000 | − | Pde1c | 1774 |
| 6 | 56267400 | 56269000 | − | Pde1c | 1775 |
| 6 | 58517600 | 58519000 | + | int | 1776 |
| 6 | 58759200 | 58760800 | + | int | 1777 |
| 6 | 58911800 | 58913000 | − | Fam13a | 1778 |
| 6 | 59170000 | 59171200 | + | int | 1779 |
| 6 | 59390200 | 59391200 | + | int | 1780 |
| 6 | 59499000 | 59500000 | + | int | 1781 |
| 6 | 59593200 | 59594600 | + | int | 1782 |
| 6 | 59849400 | 59852800 | + | int | 1783 |
| 6 | 60078000 | 60079200 | + | int | 1784 |
| 6 | 60423000 | 60424000 | + | int | 1785 |
| 6 | 61614600 | 61615600 | + | Fam190a | 1786 |
| 6 | 62114000 | 62115000 | + | Fam190a | 1787 |
| 6 | 62229400 | 62230400 | + | Fam190a | 1788 |
| 6 | 62431600 | 62432800 | + | int | 1789 |
| 6 | 62471000 | 62472200 | + | int | 1790 |
| 6 | 62721000 | 62722000 | + | int | 1791 |
| 6 | 63714400 | 63715600 | + | Grid2 | 1792 |
| 6 | 64266400 | 64267800 | + | Grid2 | 1793 |
| 6 | 65058800 | 65059800 | + | Smarcad1 | 1794 |
| 6 | 66253800 | 66255200 | + | int | 1795 |
| 6 | 66790400 | 66791600 | + | int | 1796 |
| 6 | 67605200 | 67606400 | + | int | 1797 |
| 6 | 67640800 | 67641800 | + | int | 1798 |
| 6 | 67850800 | 67851800 | + | int | 1799 |
| 6 | 68437000 | 68438200 | + | int | 1800 |
| 6 | 68618000 | 68619000 | + | int | 1801 |
| 6 | 68686200 | 68687200 | + | int | 1802 |
| 6 | 68821000 | 68822000 | + | int | 1803 |
| 6 | 69120600 | 69122000 | + | int | 1804 |
| 6 | 69450000 | 69451000 | + | int | 1805 |
| 6 | 69681600 | 69683200 | + | int | 1806 |
| 6 | 70105200 | 70106600 | + | int | 1807 |
| 6 | 70194600 | 70195800 | + | int | 1808 |
| 6 | 70340800 | 70341800 | + | int | 1809 |
| 6 | 71484600 | 71485600 | + | int | 1810 |
| 6 | 72285200 | 72286200 | − | Usp39 | 1811 |
| 6 | 74162400 | 74163400 | + | int | 1812 |
| 6 | 74176400 | 74177600 | + | int | 1813 |
| 6 | 74212600 | 74213600 | + | int | 1814 |
| 6 | 74260000 | 74261000 | + | int | 1815 |
| 6 | 74416000 | 74417000 | + | int | 1816 |
| 6 | 74714000 | 74715400 | + | int | 1817 |
| 6 | 74764200 | 74765800 | + | int | 1818 |
| 6 | 75034400 | 75035800 | + | int | 1819 |
| 6 | 75271800 | 75272800 | + | int | 1820 |
| 6 | 75613400 | 75615000 | + | int | 1821 |
| 6 | 76479600 | 76480600 | + | int | 1822 |
| 6 | 77758800 | 77759800 | − | Ctnna2 | 1823 |
| 6 | 78421600 | 78423200 | − | Reg3g | 1824 |
| 6 | 78533800 | 78535000 | + | int | 1825 |
| 6 | 79043000 | 79044000 | + | int | 1826 |
| 6 | 79281600 | 79282600 | + | int | 1827 |
| 6 | 79652000 | 79653000 | + | int | 1828 |
| 6 | 80624600 | 80625800 | + | int | 1829 |
| 6 | 82187200 | 82188200 | + | int | 1830 |
| 6 | 83306200 | 83307400 | + | Bola3 | 1831 |
| 6 | 83737600 | 83738600 | + | int | 1832 |
| 6 | 87777200 | 87778200 | − | Isy1 | 1833 |
| 6 | 87829600 | 87830600 | + | int | 1834 |
| 6 | 87859200 | 87860200 | + | Copg | 1835 |
| 6 | 89785400 | 89787000 | + | int | 1836 |
| 6 | 90130800 | 90132000 | + | int | 1837 |
| 6 | 92736800 | 92737800 | − | Adamts9 | 1838 |
| 6 | 94432800 | 94433800 | + | int | 1839 |
| 6 | 95353200 | 95354600 | + | int | 1840 |
| 6 | 96835000 | 96836000 | − | Fam19a4 | 1841 |
| 6 | 101645400 | 101646400 | + | int | 1842 |
| 6 | 102445400 | 102446400 | + | int | 1843 |
| 6 | 102669400 | 102670400 | + | int | 1844 |
| 6 | 103002000 | 103003200 | + | int | 1845 |
| 6 | 103598200 | 103600000 | + | Chl1 | 1846 |
| 6 | 104189800 | 104191000 | + | int | 1847 |
| 6 | 104356600 | 104357600 | + | int | 1848 |

TABLE 1-continued

| chromo-some | start | stop | strand | nearest gene | ID |
|---|---|---|---|---|---|
| 6 | 104453000 | 104454000 | + | Cntn6 | 1849 |
| 6 | 104521000 | 104522200 | + | Cntn6 | 1850 |
| 6 | 104986400 | 104987600 | + | int | 1851 |
| 6 | 105151000 | 105152200 | + | int | 1852 |
| 6 | 105196200 | 105197200 | + | int | 1853 |
| 6 | 106508800 | 106509800 | + | Cntn4 | 1854 |
| 6 | 106508800 | 106509800 | + | Cntn4 | 1855 |
| 6 | 106508800 | 106509800 | + | Cntn4 | 1856 |
| 6 | 107101200 | 107102800 | + | int | 1857 |
| 6 | 107953400 | 107954400 | + | int | 1858 |
| 6 | 109509800 | 109510800 | + | int | 1859 |
| 6 | 109863400 | 109864400 | + | int | 1860 |
| 6 | 111174600 | 111175600 | + | Grm7 | 1861 |
| 6 | 111705800 | 111706800 | + | int | 1862 |
| 6 | 112074800 | 112075800 | + | int | 1863 |
| 6 | 112327800 | 112329200 | − | D630042P16Rik | 1864 |
| 6 | 112382600 | 112383600 | + | int | 1865 |
| 6 | 113859200 | 113860600 | − | Atp2b2 | 1866 |
| 6 | 113935200 | 113937000 | − | Atp2b2 | 1867 |
| 6 | 114081000 | 114082000 | + | Slc6a11 | 1868 |
| 6 | 116478200 | 116479200 | + | int | 1869 |
| 6 | 116576200 | 116577400 | − | Zfp422 | 1870 |
| 6 | 117290200 | 117291400 | + | int | 1871 |
| 6 | 118233000 | 118234200 | + | int | 1872 |
| 6 | 118965200 | 118966200 | − | Cacna1c | 1873 |
| 6 | 118965200 | 118966200 | − | Cacna1c | 1874 |
| 6 | 119295000 | 119296000 | + | Cacna2d4 | 1875 |
| 6 | 119301800 | 119303000 | + | Cacna2d4 | 1876 |
| 6 | 119646600 | 119647600 | − | Erc1 | 1877 |
| 6 | 120439000 | 120440000 | − | Cecr6 | 1878 |
| 6 | 121246800 | 121247800 | + | Slc6a13 | 1879 |
| 6 | 122353600 | 122354800 | + | int | 1880 |
| 6 | 122405600 | 122406800 | − | Rimklb | 1881 |
| 6 | 123243600 | 123244000 | + | int | 1882 |
| 6 | 123425200 | 123426200 | + | int | 1883 |
| 6 | 123445600 | 123446800 | − | Vmn2r21 | 1884 |
| 6 | 123456600 | 123457800 | − | Vmn2r21 | 1885 |
| 6 | 123540600 | 123541600 | + | int | 1886 |
| 6 | 123562800 | 123564200 | − | Vmn2r22 | 1887 |
| 6 | 123573800 | 123575000 | − | Vmn2r22 | 1888 |
| 6 | 123646600 | 123647600 | + | int | 1889 |
| 6 | 124247200 | 124248400 | + | int | 1890 |
| 6 | 126200800 | 126202200 | + | int | 1891 |
| 6 | 127044000 | 127045000 | − | 9630033F20Rik | 1892 |
| 6 | 127963200 | 127964400 | − | Tspan9 | 1893 |
| 6 | 128595800 | 128597200 | + | int | 1894 |
| 6 | 128651600 | 128653200 | + | int | 1895 |
| 6 | 129199600 | 129201000 | + | int | 1896 |
| 6 | 129695400 | 129696400 | + | int | 1897 |
| 6 | 129879200 | 129880600 | + | int | 1898 |
| 6 | 130631800 | 130632800 | + | int | 1899 |
| 6 | 130818200 | 130819600 | + | int | 1900 |
| 6 | 131554800 | 131555800 | + | int | 1901 |
| 6 | 131965800 | 131966800 | + | int | 1902 |
| 6 | 132268200 | 132269200 | − | Gm4736 | 1903 |
| 6 | 132545600 | 132546600 | + | Prp2 | 1904 |
| 6 | 133348200 | 133349600 | + | int | 1905 |
| 6 | 133592000 | 133593400 | + | int | 1906 |
| 6 | 133594800 | 133595800 | + | int | 1907 |
| 6 | 133725000 | 133726000 | + | int | 1908 |
| 6 | 134139600 | 134140600 | + | Etv6 | 1909 |
| 6 | 135259800 | 135260800 | − | Pbp2 | 1910 |
| 6 | 136272400 | 136273800 | + | int | 1911 |
| 6 | 136674700 | 136675200 | − | Gucy2c | 1912 |
| 6 | 137077800 | 137079200 | + | Rerg | 1913 |
| 6 | 137077800 | 137079200 | + | Rerg | 1914 |
| 6 | 137440000 | 137441800 | − | Eps8 | 1915 |
| 6 | 137500400 | 137501800 | − | Eps8 | 1916 |
| 6 | 137780800 | 137782000 | + | Dera | 1917 |
| 6 | 138518200 | 138519600 | − | Lmo3 | 1918 |
| 6 | 138953800 | 138955200 | + | int | 1919 |
| 6 | 139239000 | 139240000 | + | int | 1920 |
| 6 | 139342600 | 139343800 | + | int | 1921 |
| 6 | 141023400 | 141024400 | + | int | 1922 |
| 6 | 141241200 | 141242200 | + | Pde3a | 1923 |
| 6 | 141474200 | 141475200 | + | Slco1c1 | 1924 |
| 6 | 142173000 | 142174000 | + | int | 1925 |
| 6 | 145046400 | 145047400 | + | int | 1926 |
| 6 | 145415600 | 145416600 | + | int | 1927 |
| 6 | 145605400 | 145607000 | + | int | 1928 |
| 6 | 145786400 | 145787800 | + | int | 1929 |
| 6 | 146469800 | 146470800 | + | int | 1930 |
| 6 | 147252000 | 147253400 | + | int | 1931 |
| 6 | 148303200 | 148304200 | + | Rps4y2 | 1932 |
| 6 | 148303200 | 148304200 | − | Tmtc1 | 1933 |
| 7 | 3089000 | 3090400 | + | int | 1934 |
| 7 | 3110600 | 3112000 | + | int | 1935 |
| 7 | 7230200 | 7231400 | − | Vmn2r29 | 1936 |
| 7 | 7251600 | 7253200 | − | Clcn4-2 | 1937 |
| 7 | 7326600 | 7327600 | + | int | 1938 |
| 7 | 7493400 | 7494800 | + | int | 1939 |
| 7 | 9112200 | 9113200 | + | int | 1940 |
| 7 | 10685200 | 10686400 | − | Vmn2r51 | 1941 |
| 7 | 11201000 | 11202200 | + | int | 1942 |
| 7 | 11580400 | 11581400 | + | int | 1943 |
| 7 | 12081200 | 12082400 | + | int | 1944 |
| 7 | 13751600 | 13753200 | + | int | 1945 |
| 7 | 14150000 | 14151200 | − | 9230107M04Rik | 1946 |
| 7 | 14620200 | 14621200 | + | int | 1947 |
| 7 | 14962400 | 14963400 | + | int | 1948 |
| 7 | 15909000 | 15910400 | + | int | 1949 |
| 7 | 15983800 | 15985600 | + | Obox2 | 1950 |
| 7 | 16052600 | 16053600 | + | int | 1951 |
| 7 | 16139400 | 16140400 | + | Obox1 | 1952 |
| 7 | 18413400 | 18414800 | + | int | 1953 |
| 7 | 18701800 | 18702800 | + | int | 1954 |
| 7 | 19820000 | 19821000 | + | Opa3 | 1955 |
| 7 | 20025200 | 20026400 | − | Mark4 | 1956 |
| 7 | 24135600 | 24137800 | + | Nlrp4e | 1957 |
| 7 | 24154600 | 24155800 | + | int | 1958 |
| 7 | 25281000 | 25282000 | + | Cadm4 | 1959 |
| 7 | 26855200 | 26856400 | + | Cyp2b13 | 1960 |
| 7 | 27281200 | 27282400 | + | int | 1961 |
| 7 | 28703800 | 28704800 | − | 1700049G17Rik | 1962 |
| 7 | 28717400 | 28718400 | − | 1700049G17Rik | 1963 |
| 7 | 28905200 | 28906000 | + | Fcgbp | 1964 |
| 7 | 29983000 | 29984000 | − | Catsperg1 | 1965 |
| 7 | 30077800 | 30078800 | + | Ppp1r14a | 1966 |
| 7 | 30184600 | 30185600 | − | Sipa1l3 | 1967 |
| 7 | 31256600 | 31257600 | + | Nphs1 | 1968 |
| 7 | 31496600 | 31498000 | + | Atp4a | 1969 |
| 7 | 32139800 | 32141000 | + | int | 1970 |
| 7 | 33253600 | 33255000 | + | int | 1971 |
| 7 | 33262400 | 33263600 | + | int | 1972 |
| 7 | 34085000 | 34086000 | + | int | 1973 |
| 7 | 34338600 | 34339600 | + | int | 1974 |
| 7 | 36382800 | 36383800 | + | Ankrd27 | 1975 |
| 7 | 36382800 | 36383800 | + | Ankrd27 | 1976 |
| 7 | 36558800 | 36560200 | − | Zfp507 | 1977 |
| 7 | 37977800 | 37979000 | + | int | 1978 |
| 7 | 38467400 | 38468400 | − | Zfp536 | 1979 |
| 7 | 38581000 | 38582200 | + | int | 1980 |
| 7 | 38852600 | 38853600 | + | int | 1981 |
| 7 | 39348200 | 39349200 | + | int | 1982 |
| 7 | 47855200 | 47856800 | + | int | 1983 |
| 7 | 48169800 | 48171000 | + | Vstm2b | 1984 |
| 7 | 48348400 | 48349600 | + | int | 1985 |
| 7 | 48542800 | 48543800 | + | Gm5592 | 1986 |
| 7 | 49447000 | 49448000 | + | Vmn2r60 | 1987 |
| 7 | 50134400 | 50135400 | + | int | 1988 |
| 7 | 50622400 | 50623800 | + | int | 1989 |
| 7 | 53357200 | 53358400 | − | Kcnj11 | 1990 |
| 7 | 53719600 | 53720800 | − | Sergef | 1991 |
| 7 | 54757000 | 54758800 | + | int | 1992 |
| 7 | 55026000 | 55027000 | + | int | 1993 |
| 7 | 55466800 | 55467800 | + | int | 1994 |
| 7 | 57611000 | 57612000 | + | Nell1 | 1995 |
| 7 | 57795600 | 57796800 | + | Nell1 | 1996 |
| 7 | 58108400 | 58109600 | + | Nell1 | 1997 |
| 7 | 58304200 | 58305400 | + | int | 1998 |
| 7 | 59401600 | 59402800 | + | int | 1999 |
| 7 | 59817000 | 59818000 | + | int | 2000 |
| 7 | 59861000 | 59862000 | + | int | 2001 |
| 7 | 60245800 | 60247000 | + | int | 2002 |

TABLE 1-continued

| chromosome | start | stop | strand | nearest gene | ID |
|---|---|---|---|---|---|
| 7 | 62011000 | 62012000 | + | int | 2003 |
| 7 | 62567000 | 62568000 | + | int | 2004 |
| 7 | 62729000 | 62730400 | + | int | 2005 |
| 7 | 63120800 | 63121800 | + | Cyfip1 | 2006 |
| 7 | 63865400 | 63866400 | + | int | 2007 |
| 7 | 64199200 | 64200400 | − | Gabrg3 | 2008 |
| 7 | 65244000 | 65245400 | + | int | 2009 |
| 7 | 65432800 | 65434600 | + | int | 2010 |
| 7 | 65646800 | 65648200 | + | int | 2011 |
| 7 | 65654200 | 65655400 | + | int | 2012 |
| 7 | 66346200 | 66347200 | + | int | 2013 |
| 7 | 67195000 | 67196000 | − | Snrpn | 2014 |
| 7 | 67195000 | 67196000 | − | Snrpn | 2015 |
| 7 | 67280800 | 67281800 | − | Snrpn | 2016 |
| 7 | 67292800 | 67293800 | + | int | 2017 |
| 7 | 67368600 | 67369600 | + | int | 2018 |
| 7 | 67626000 | 67627000 | + | int | 2019 |
| 7 | 67883400 | 67884400 | + | int | 2020 |
| 7 | 68087600 | 68089200 | + | int | 2021 |
| 7 | 68164400 | 68165400 | + | int | 2022 |
| 7 | 68480400 | 68482000 | + | int | 2023 |
| 7 | 69186200 | 69187200 | + | int | 2024 |
| 7 | 69480600 | 69481600 | + | int | 2025 |
| 7 | 69593200 | 69594200 | + | int | 2026 |
| 7 | 69631400 | 69632600 | + | int | 2027 |
| 7 | 70768200 | 70769000 | + | Otud7a | 2028 |
| 7 | 71650200 | 71651200 | + | Apba2 | 2029 |
| 7 | 73351200 | 73352400 | + | int | 2030 |
| 7 | 74458000 | 74459400 | − | Mef2a | 2031 |
| 7 | 75570600 | 75571600 | + | int | 2032 |
| 7 | 76015800 | 76016800 | + | int | 2033 |
| 7 | 76319000 | 76320000 | + | int | 2034 |
| 7 | 76595400 | 76596400 | + | int | 2035 |
| 7 | 78979000 | 78980000 | + | int | 2036 |
| 7 | 79987600 | 79988600 | + | int | 2037 |
| 7 | 80985200 | 80986200 | + | int | 2038 |
| 7 | 82743200 | 82744400 | + | Akap13 | 2039 |
| 7 | 84006800 | 84008400 | + | int | 2040 |
| 7 | 86027400 | 86028400 | + | int | 2041 |
| 7 | 88780600 | 88782200 | − | Homer2 | 2042 |
| 7 | 88780600 | 88782200 | − | Homer2 | 2043 |
| 7 | 89896600 | 89897600 | + | Eftud1 | 2044 |
| 7 | 92543800 | 92544800 | + | int | 2045 |
| 7 | 92722600 | 92724000 | + | int | 2046 |
| 7 | 93340600 | 93341600 | + | int | 2047 |
| 7 | 93385000 | 93386800 | − | Vmn2r76 | 2048 |
| 7 | 93464600 | 93465200 | + | int | 2049 |
| 7 | 93517400 | 93519000 | + | int | 2050 |
| 7 | 93752000 | 93753000 | + | int | 2051 |
| 7 | 94280800 | 94282000 | + | int | 2052 |
| 7 | 94814000 | 94815000 | + | Grm5 | 2053 |
| 7 | 94882600 | 94884000 | + | Grm5 | 2054 |
| 7 | 95230600 | 95231600 | + | Grm5 | 2055 |
| 7 | 95775200 | 95776200 | + | int | 2056 |
| 7 | 101332600 | 101333600 | + | int | 2057 |
| 7 | 102610200 | 102612000 | + | int | 2058 |
| 7 | 105289600 | 105291000 | − | Capn5 | 2059 |
| 7 | 106302000 | 106303400 | − | Dgat2 | 2060 |
| 7 | 106380600 | 106381600 | − | Mogat2 | 2061 |
| 7 | 106611000 | 106612800 | + | Klhl35 | 2062 |
| 7 | 107168600 | 107169800 | + | Chrdl2 | 2063 |
| 7 | 108711800 | 108713000 | − | Art2a-ps | 2064 |
| 7 | 109861600 | 109863200 | − | Olfr33 | 2065 |
| 7 | 109872000 | 109873200 | − | Olfr559 | 2066 |
| 7 | 110035400 | 110036600 | − | Olfr569 | 2067 |
| 7 | 110189800 | 110191000 | + | Olfr582 | 2068 |
| 7 | 110818600 | 110819800 | − | Olfr624 | 2069 |
| 7 | 110929600 | 110930800 | − | Olfr68 | 2070 |
| 7 | 111029800 | 111030800 | − | Olfr66 | 2071 |
| 7 | 111127600 | 111128800 | + | Olfr635 | 2072 |
| 7 | 112291800 | 112292800 | − | Olfr683 | 2073 |
| 7 | 112347600 | 112349200 | + | int | 2074 |
| 7 | 112715400 | 112716600 | − | Apbb1 | 2075 |
| 7 | 113539400 | 113540600 | + | int | 2076 |
| 7 | 113989800 | 113990800 | + | int | 2077 |
| 7 | 114142200 | 114145600 | − | Olfr2 | 2078 |
| 7 | 114229000 | 114230000 | + | int | 2079 |
| 7 | 114345200 | 114346200 | + | int | 2080 |
| 7 | 115094800 | 115096000 | + | Olfr474 | 2081 |
| 7 | 115466400 | 115467400 | − | Olfr492 | 2082 |
| 7 | 115826200 | 115827200 | + | int | 2083 |
| 7 | 115898000 | 115899400 | + | Olfr513 | 2084 |
| 7 | 116267400 | 116268800 | + | int | 2085 |
| 7 | 116271000 | 116272800 | + | int | 2086 |
| 7 | 116741600 | 116742600 | − | St5 | 2087 |
| 7 | 117635800 | 117637000 | − | Sbf2 | 2088 |
| 7 | 118129000 | 118130000 | + | int | 2089 |
| 7 | 120621200 | 120622600 | + | int | 2090 |
| 7 | 121554200 | 121555400 | − | 4933406I18Rik | 2091 |
| 7 | 121554200 | 121555400 | − | 4933406I18Rik | 2092 |
| 7 | 122072400 | 122073400 | + | int | 2093 |
| 7 | 123447800 | 123449000 | + | int | 2094 |
| 7 | 126896000 | 126897000 | + | int | 2095 |
| 7 | 127424200 | 127425600 | + | Abca14 | 2096 |
| 7 | 128303200 | 128304400 | + | Otoa | 2097 |
| 7 | 129446800 | 129448000 | + | Prkcb | 2098 |
| 7 | 130410600 | 130411600 | + | Slc5a11 | 2099 |
| 7 | 131239800 | 131241000 | + | int | 2100 |
| 7 | 137902400 | 137903600 | + | Tacc2 | 2101 |
| 7 | 137902400 | 137903600 | + | Tacc2 | 2102 |
| 7 | 137902400 | 137903600 | + | Tacc2 | 2103 |
| 7 | 137977200 | 137979000 | + | int | 2104 |
| 7 | 138533200 | 138534200 | − | Ikzf5 | 2105 |
| 7 | 138899800 | 138901000 | + | int | 2106 |
| 7 | 139354400 | 139355600 | + | int | 2107 |
| 7 | 140328600 | 140329800 | + | int | 2108 |
| 7 | 143849000 | 143850000 | + | int | 2109 |
| 7 | 144674800 | 144675800 | + | int | 2110 |
| 7 | 145191600 | 145192600 | + | int | 2111 |
| 7 | 146385400 | 146386400 | − | Stk32c | 2112 |
| 7 | 146920000 | 146921000 | + | int | 2113 |
| 7 | 148529200 | 148530200 | + | Eps8l2 | 2114 |
| 7 | 148824200 | 148825600 | − | Muc6 | 2115 |
| 7 | 148998200 | 148999400 | + | Muc5ac | 2116 |
| 7 | 149186400 | 149187400 | + | Brsk2 | 2117 |
| 7 | 149186400 | 149187400 | + | Brsk2 | 2118 |
| 7 | 149511800 | 149512800 | − | 6330512M04Rik | 2119 |
| 7 | 150018200 | 150019600 | + | int | 2120 |
| 7 | 150888600 | 150889800 | − | Osbpl5 | 2121 |
| 7 | 151497000 | 151498000 | + | Shank2 | 2122 |
| 7 | 151497000 | 151498000 | + | Shank2 | 2123 |
| 8 | 3161200 | 3162200 | − | Insr | 2124 |
| 8 | 3445400 | 3446400 | + | Arhgef18 | 2125 |
| 8 | 3998200 | 3999200 | + | int | 2126 |
| 8 | 4987200 | 4988200 | + | int | 2127 |
| 8 | 5568000 | 5569800 | + | int | 2128 |
| 8 | 5922400 | 5923400 | + | int | 2129 |
| 8 | 6061800 | 6063200 | + | int | 2130 |
| 8 | 6336200 | 6337200 | + | int | 2131 |
| 8 | 6343000 | 6344000 | + | int | 2132 |
| 8 | 6436400 | 6437400 | + | int | 2133 |
| 8 | 6875800 | 6877000 | + | int | 2134 |
| 8 | 6977000 | 6978000 | + | int | 2135 |
| 8 | 7452800 | 7453800 | + | int | 2136 |
| 8 | 7612800 | 7614400 | + | int | 2137 |
| 8 | 9668600 | 9669600 | − | Fam155a | 2138 |
| 8 | 11530000 | 11531000 | − | Cars2 | 2139 |
| 8 | 11972800 | 11973800 | + | int | 2140 |
| 8 | 12287600 | 12288600 | + | int | 2141 |
| 8 | 13508600 | 13509800 | + | int | 2142 |
| 8 | 13859600 | 13860800 | + | int | 2143 |
| 8 | 14194800 | 14195800 | + | Dlgap2 | 2144 |
| 8 | 14361200 | 14362600 | + | Dlgap2 | 2145 |
| 8 | 14906200 | 14907200 | + | int | 2146 |
| 8 | 15065400 | 15066400 | + | Myom2 | 2147 |
| 8 | 15386600 | 15387600 | + | int | 2148 |
| 8 | 15506200 | 15507200 | + | int | 2149 |
| 8 | 16230800 | 16231800 | − | Csmd1 | 2150 |
| 8 | 16697200 | 16698200 | − | Csmd1 | 2151 |
| 8 | 17874600 | 17875600 | + | int | 2152 |
| 8 | 17985600 | 17987200 | + | int | 2153 |
| 8 | 18439200 | 18440200 | + | int | 2154 |
| 8 | 19203600 | 19204600 | + | int | 2155 |
| 8 | 19679800 | 19680800 | + | int | 2156 |

TABLE 1-continued

| chromosome | start | stop | strand | nearest gene | ID |
|---|---|---|---|---|---|
| 8 | 19697400 | 19698600 | + | int | 2157 |
| 8 | 19702800 | 19703800 | + | int | 2158 |
| 8 | 19724600 | 19725600 | + | int | 2159 |
| 8 | 19756200 | 19757200 | + | int | 2160 |
| 8 | 19779200 | 19780000 | + | int | 2161 |
| 8 | 19857200 | 19858200 | + | int | 2162 |
| 8 | 19862800 | 19864000 | − | 6820431F20Rik | 2163 |
| 8 | 19878400 | 19879600 | − | 6820431F20Rik | 2164 |
| 8 | 19931600 | 19932600 | + | int | 2165 |
| 8 | 19935200 | 19936600 | − | Gm15319 | 2166 |
| 8 | 19940000 | 19941400 | − | Gm15319 | 2167 |
| 8 | 19962800 | 19963800 | + | int | 2168 |
| 8 | 19990000 | 19991400 | − | 2610005L07Rik | 2169 |
| 8 | 19990000 | 19991400 | − | 6820431F20Rik | 2170 |
| 8 | 20005600 | 20007000 | − | 2610005L07Rik | 2171 |
| 8 | 20005600 | 20007000 | − | 6820431F20Rik | 2172 |
| 8 | 22133400 | 22134800 | + | int | 2173 |
| 8 | 22149600 | 22151000 | + | int | 2174 |
| 8 | 22392800 | 22393800 | + | int | 2175 |
| 8 | 24131200 | 24132200 | + | Ank1 | 2176 |
| 8 | 25985000 | 25986200 | − | Adam32 | 2177 |
| 8 | 26000600 | 26001600 | − | Adam32 | 2178 |
| 8 | 30506000 | 30507000 | + | int | 2179 |
| 8 | 31219600 | 31221000 | + | int | 2180 |
| 8 | 31301000 | 31302000 | + | int | 2181 |
| 8 | 31487400 | 31489200 | + | int | 2182 |
| 8 | 32338400 | 32339600 | + | Fut10 | 2183 |
| 8 | 32338400 | 32339600 | + | Fut10 | 2184 |
| 8 | 34035200 | 34036200 | − | Gm3985 | 2185 |
| 8 | 35580400 | 35581800 | + | int | 2186 |
| 8 | 36659600 | 36660600 | + | Mfhas1 | 2187 |
| 8 | 39001800 | 39002800 | − | Sgcz | 2188 |
| 8 | 39570400 | 39572000 | − | Sgcz | 2189 |
| 8 | 40023600 | 40024600 | + | int | 2190 |
| 8 | 41357600 | 41358600 | + | int | 2191 |
| 8 | 41792800 | 41794200 | + | int | 2192 |
| 8 | 42859400 | 42860400 | + | int | 2193 |
| 8 | 42872400 | 42873600 | + | int | 2194 |
| 8 | 43332000 | 43333400 | + | int | 2195 |
| 8 | 43476000 | 43477200 | + | int | 2196 |
| 8 | 43645600 | 43646600 | + | int | 2197 |
| 8 | 43730800 | 43731800 | + | int | 2198 |
| 8 | 43800000 | 43801000 | + | int | 2199 |
| 8 | 43881200 | 43882200 | + | int | 2200 |
| 8 | 45031400 | 45032600 | + | int | 2201 |
| 8 | 45384400 | 45385600 | + | 1700029J07Rik | 2202 |
| 8 | 47046000 | 47048200 | − | 1700029J07Rik | 2203 |
| 8 | 48796400 | 48797600 | + | Cdkn2aip | 2204 |
| 8 | 50597600 | 50598800 | + | int | 2205 |
| 8 | 50938800 | 50939800 | + | int | 2206 |
| 8 | 51013800 | 51015000 | + | int | 2207 |
| 8 | 51316800 | 51318200 | + | int | 2208 |
| 8 | 51327800 | 51328800 | + | int | 2209 |
| 8 | 51585400 | 51588400 | + | int | 2210 |
| 8 | 51828000 | 51829000 | + | int | 2211 |
| 8 | 52309200 | 52310600 | + | int | 2212 |
| 8 | 52363200 | 52364400 | + | int | 2213 |
| 8 | 52749400 | 52750400 | + | int | 2214 |
| 8 | 53143400 | 53144800 | + | int | 2215 |
| 8 | 53208000 | 53209000 | + | int | 2216 |
| 8 | 53216600 | 53217600 | + | int | 2217 |
| 8 | 53356000 | 53357000 | + | int | 2218 |
| 8 | 53489600 | 53491000 | + | int | 2219 |
| 8 | 53690800 | 53692200 | + | int | 2220 |
| 8 | 53978800 | 53980200 | + | int | 2221 |
| 8 | 54082400 | 54083400 | + | int | 2222 |
| 8 | 54409600 | 54411000 | + | int | 2223 |
| 8 | 54904800 | 54905800 | + | int | 2224 |
| 8 | 55982400 | 55983600 | + | int | 2225 |
| 8 | 56199400 | 56201000 | + | int | 2226 |
| 8 | 58030800 | 58032400 | + | int | 2227 |
| 8 | 58683400 | 58684700 | + | int | 2228 |
| 8 | 58750400 | 58751400 | + | int | 2229 |
| 8 | 59091000 | 59092000 | + | int | 2230 |
| 8 | 59610600 | 59611800 | + | int | 2231 |
| 8 | 60555600 | 60556600 | − | Galntl6 | 2232 |
| 8 | 60704600 | 60706000 | − | Galntl6 | 2233 |
| 8 | 61308400 | 61309800 | − | Galntl6 | 2234 |
| 8 | 61349600 | 61350600 | − | Galntl6 | 2235 |
| 8 | 62073600 | 62074600 | + | int | 2236 |
| 8 | 62194000 | 62195200 | + | int | 2237 |
| 8 | 62324800 | 62325800 | + | int | 2238 |
| 8 | 62358800 | 62360400 | + | int | 2239 |
| 8 | 62677200 | 62678400 | + | int | 2240 |
| 8 | 64805600 | 64806600 | + | int | 2241 |
| 8 | 65681400 | 65682400 | + | Spock3 | 2242 |
| 8 | 65698800 | 65700400 | + | Spock3 | 2243 |
| 8 | 65751400 | 65752400 | + | Spock3 | 2244 |
| 8 | 66290000 | 66291200 | + | int | 2245 |
| 8 | 67053200 | 67054200 | + | int | 2246 |
| 8 | 67829400 | 67830600 | + | int | 2247 |
| 8 | 68609200 | 68610200 | + | 1-Mar | 2248 |
| 8 | 68609200 | 68610200 | + | 1-Mar | 2249 |
| 8 | 68768200 | 68769200 | + | 1-Mar | 2250 |
| 8 | 68768200 | 68769200 | + | 1-Mar | 2251 |
| 8 | 68876400 | 68877600 | + | 1-Mar | 2252 |
| 8 | 68876400 | 68877600 | + | 1-Mar | 2253 |
| 8 | 68951800 | 68952800 | + | 1-Mar | 2254 |
| 8 | 68951800 | 68952800 | + | 1-Mar | 2255 |
| 8 | 68951800 | 68952800 | + | 1-Mar | 2256 |
| 8 | 69814600 | 69815600 | + | int | 2257 |
| 8 | 69899400 | 69900400 | + | int | 2258 |
| 8 | 72718400 | 72719600 | − | Slc25a42 | 2259 |
| 8 | 73434800 | 73436000 | − | Mtap1s | 2260 |
| 8 | 74601200 | 74602600 | + | int | 2261 |
| 8 | 74647200 | 74648600 | + | int | 2262 |
| 8 | 76084000 | 76085200 | + | int | 2263 |
| 8 | 77770600 | 77771800 | + | int | 2264 |
| 8 | 78455400 | 78456600 | + | 1700007B14Rik | 2265 |
| 8 | 78462600 | 78463800 | + | 1700007B14Rik | 2266 |
| 8 | 78818000 | 78819000 | + | int | 2267 |
| 8 | 79194600 | 79195800 | + | int | 2268 |
| 8 | 79337800 | 79338800 | − | Gm10649 | 2269 |
| 8 | 82496000 | 82497000 | − | Hhip | 2270 |
| 8 | 82868600 | 82869600 | + | int | 2271 |
| 8 | 83168000 | 83169400 | + | Frem3 | 2272 |
| 8 | 83776400 | 83777400 | + | int | 2273 |
| 8 | 84980400 | 84981600 | + | int | 2274 |
| 8 | 85108200 | 85109200 | + | int | 2275 |
| 8 | 85147800 | 85149000 | + | int | 2276 |
| 8 | 85543000 | 85544200 | + | Rnf150 | 2277 |
| 8 | 85801800 | 85802800 | + | int | 2278 |
| 8 | 86406000 | 86407000 | + | int | 2279 |
| 8 | 86500400 | 86501400 | + | Prkaca | 2280 |
| 8 | 87117800 | 87118800 | + | Cacna1a | 2281 |
| 8 | 87716000 | 87717000 | + | int | 2282 |
| 8 | 88638000 | 88639000 | + | int | 2283 |
| 8 | 88665400 | 88666400 | + | int | 2284 |
| 8 | 89850400 | 89851800 | + | int | 2285 |
| 8 | 90572200 | 90573400 | + | int | 2286 |
| 8 | 90897200 | 90898200 | + | int | 2287 |
| 8 | 91329000 | 91330400 | + | int | 2288 |
| 8 | 93368200 | 93369200 | + | Chd9 | 2289 |
| 8 | 93575000 | 93576000 | + | Chd9 | 2290 |
| 8 | 95250800 | 95252000 | + | int | 2291 |
| 8 | 95969800 | 95970800 | + | int | 2292 |
| 8 | 97478200 | 97479200 | + | int | 2293 |
| 8 | 99298000 | 99299000 | + | int | 2294 |
| 8 | 99697200 | 99698600 | + | int | 2295 |
| 8 | 100440400 | 100441400 | + | int | 2296 |
| 8 | 100790200 | 100791200 | + | int | 2297 |
| 8 | 100887000 | 100888000 | + | int | 2298 |
| 8 | 101223000 | 101224600 | + | int | 2299 |
| 8 | 101521600 | 101522800 | + | int | 2300 |
| 8 | 101642000 | 101643000 | − | Cdh8 | 2301 |
| 8 | 101642000 | 101643000 | − | Cdh8 | 2302 |
| 8 | 102228400 | 102229400 | + | int | 2303 |
| 8 | 102506800 | 102508600 | + | int | 2304 |
| 8 | 102725600 | 102726600 | + | int | 2305 |
| 8 | 103025800 | 103026800 | + | int | 2306 |
| 8 | 103113400 | 103114800 | + | int | 2307 |
| 8 | 103228400 | 103229400 | + | int | 2308 |
| 8 | 103532800 | 103534200 | + | int | 2309 |
| 8 | 103567200 | 103568400 | + | int | 2310 |

TABLE 1-continued

| chromo-some | start | stop | strand | nearest gene | ID |
|---|---|---|---|---|---|
| 8 | 104096200 | 104098200 | + | int | 2311 |
| 8 | 104192200 | 104193400 | + | int | 2312 |
| 8 | 104502200 | 104503200 | + | int | 2313 |
| 8 | 105158200 | 105159200 | − | Cdh11 | 2314 |
| 8 | 107237800 | 107238800 | + | int | 2315 |
| 8 | 108631800 | 108633200 | + | Nfatc3 | 2316 |
| 8 | 110922200 | 110923400 | + | int | 2317 |
| 8 | 111060200 | 111061200 | + | int | 2318 |
| 8 | 111693000 | 111694000 | + | int | 2319 |
| 8 | 115377600 | 115378800 | + | Cntnap4 | 2320 |
| 8 | 115717800 | 115718800 | + | int | 2321 |
| 8 | 123527000 | 123528000 | + | int | 2322 |
| 8 | 126030600 | 126032000 | − | Dbndd1 | 2323 |
| 8 | 126030600 | 126032000 | − | Dbndd1 | 2324 |
| 8 | 127108600 | 127110000 | + | Capn9 | 2325 |
| 8 | 128152200 | 128153200 | + | int | 2326 |
| 8 | 128305600 | 128306800 | − | Pcnxl2 | 2327 |
| 8 | 129038200 | 129039400 | + | int | 2328 |
| 8 | 131364600 | 131365600 | + | int | 2329 |
| 8 | 131387400 | 131388400 | + | int | 2330 |
| 8 | 131525000 | 131526000 | − | Ccdc7 | 2331 |
| 8 | 131689600 | 131690400 | + | 1700008F21Rik | 2332 |
| 9 | 3006200 | 3007600 | + | int | 2333 |
| 9 | 3012400 | 3013400 | + | int | 2334 |
| 9 | 3015400 | 3016400 | + | int | 2335 |
| 9 | 3031800 | 3032800 | + | int | 2336 |
| 9 | 3447400 | 3448400 | + | Cwf19l2 | 2337 |
| 9 | 3537800 | 3539600 | + | Gucy1a2 | 2338 |
| 9 | 3763400 | 3764600 | + | Gucy1a2 | 2339 |
| 9 | 5124800 | 5125400 | + | int | 2340 |
| 9 | 5146400 | 5147600 | + | int | 2341 |
| 9 | 5174600 | 5176000 | + | int | 2342 |
| 9 | 5421200 | 5422200 | + | int | 2343 |
| 9 | 5482000 | 5483200 | + | int | 2344 |
| 9 | 5779000 | 5780000 | + | int | 2345 |
| 9 | 5798000 | 5799000 | + | int | 2346 |
| 9 | 5808400 | 5809400 | + | int | 2347 |
| 9 | 5834800 | 5835800 | + | int | 2348 |
| 9 | 5861400 | 5862000 | + | int | 2349 |
| 9 | 5958200 | 5959200 | + | int | 2350 |
| 9 | 6307800 | 6308800 | + | Pdgfd | 2351 |
| 9 | 8291800 | 8293400 | + | int | 2352 |
| 9 | 9640400 | 9641600 | + | int | 2353 |
| 9 | 9752600 | 9753800 | − | Cntn5 | 2354 |
| 9 | 9752600 | 9753800 | − | Cntn5 | 2355 |
| 9 | 10497600 | 10498600 | − | Cntn5 | 2356 |
| 9 | 10497600 | 10498600 | − | Cntn5 | 2357 |
| 9 | 10569200 | 10570200 | − | Cntn5 | 2358 |
| 9 | 10569200 | 10570200 | − | Cntn5 | 2359 |
| 9 | 10668600 | 10669600 | − | Cntn5 | 2360 |
| 9 | 10668600 | 10669600 | − | Cntn5 | 2361 |
| 9 | 10831400 | 10832400 | − | Cntn5 | 2362 |
| 9 | 10831400 | 10832400 | − | Cntn5 | 2363 |
| 9 | 12233600 | 12234600 | + | int | 2364 |
| 9 | 12287600 | 12288400 | + | int | 2365 |
| 9 | 12366000 | 12367600 | + | int | 2366 |
| 9 | 12732600 | 12733600 | + | int | 2367 |
| 9 | 12764000 | 12765000 | + | int | 2368 |
| 9 | 14718800 | 14719800 | + | int | 2369 |
| 9 | 16726400 | 16728000 | + | int | 2370 |
| 9 | 17167800 | 17169000 | + | int | 2371 |
| 9 | 17201600 | 17202600 | + | int | 2372 |
| 9 | 17525200 | 17526800 | + | int | 2373 |
| 9 | 18035400 | 18036400 | + | int | 2374 |
| 9 | 18649200 | 18650600 | + | int | 2375 |
| 9 | 19043800 | 19045400 | + | int | 2376 |
| 9 | 19200600 | 19201600 | + | int | 2377 |
| 9 | 19487600 | 19488600 | + | int | 2378 |
| 9 | 19512000 | 19513200 | + | int | 2379 |
| 9 | 19519400 | 19520800 | + | int | 2380 |
| 9 | 19536800 | 19538400 | + | int | 2381 |
| 9 | 19582800 | 19583800 | + | Olfr58 | 2382 |
| 9 | 19800800 | 19801800 | + | int | 2383 |
| 9 | 20165600 | 20166800 | − | Zfp560 | 2384 |
| 9 | 20643000 | 20644200 | + | int | 2385 |
| 9 | 21546200 | 21547400 | + | Ldlr | 2386 |
| 9 | 22407400 | 22408400 | + | Bbs9 | 2387 |
| 9 | 24345600 | 24347400 | + | int | 2388 |
| 9 | 24424400 | 24425400 | − | Dpy19l2 | 2389 |
| 9 | 24792000 | 24793000 | + | int | 2390 |
| 9 | 27193400 | 27194800 | + | int | 2391 |
| 9 | 27534000 | 27535200 | + | int | 2392 |
| 9 | 27737400 | 27738600 | + | Opcml | 2393 |
| 9 | 28490800 | 28492000 | + | Opcml | 2394 |
| 9 | 30360200 | 30361600 | + | int | 2395 |
| 9 | 31664200 | 31665200 | − | Barx2 | 2396 |
| 9 | 32352800 | 32353800 | + | int | 2397 |
| 9 | 33453000 | 33454200 | + | int | 2398 |
| 9 | 34636800 | 34637800 | + | Kirrel3 | 2399 |
| 9 | 34636800 | 34637800 | + | Kirrel3 | 2400 |
| 9 | 35112200 | 35113800 | + | int | 2401 |
| 9 | 36271200 | 36272200 | + | int | 2402 |
| 9 | 37507600 | 37508800 | + | int | 2403 |
| 9 | 38014200 | 38015400 | + | Olfr893 | 2404 |
| 9 | 38163600 | 38165200 | + | int | 2405 |
| 9 | 38662400 | 38663800 | + | Olfr26 | 2406 |
| 9 | 38687800 | 38689400 | + | int | 2407 |
| 9 | 38783000 | 38784400 | + | Olfr933 | 2408 |
| 9 | 38949400 | 38950800 | + | Olfr242 | 2409 |
| 9 | 38949400 | 38950800 | + | Olfr27 | 2410 |
| 9 | 39189600 | 39190800 | + | int | 2411 |
| 9 | 39235800 | 39237200 | − | Olfr952 | 2412 |
| 9 | 39281200 | 39282800 | − | Olfr955 | 2413 |
| 9 | 39430600 | 39431600 | + | Olfr960 | 2414 |
| 9 | 39454200 | 39455200 | + | Olfr961 | 2415 |
| 9 | 39493600 | 39494600 | + | int | 2416 |
| 9 | 39646800 | 39648000 | + | Olfr971 | 2417 |
| 9 | 39801200 | 39802600 | + | Olfr978 | 2418 |
| 9 | 40350000 | 40351200 | + | int | 2419 |
| 9 | 41936000 | 41937000 | + | int | 2420 |
| 9 | 43370200 | 43371600 | + | int | 2421 |
| 9 | 44432400 | 44433400 | + | Ddx6 | 2422 |
| 9 | 44499400 | 44500600 | − | Phldb1 | 2423 |
| 9 | 47469000 | 47470000 | + | Cadm1 | 2424 |
| 9 | 47659200 | 47660200 | + | Cadm1 | 2425 |
| 9 | 47818600 | 47819600 | + | int | 2426 |
| 9 | 48849200 | 48850200 | + | Usp28 | 2427 |
| 9 | 51106000 | 51107200 | − | 1810046K07Rik | 2428 |
| 9 | 52207000 | 52208600 | + | int | 2429 |
| 9 | 53853000 | 53854000 | + | int | 2430 |
| 9 | 53886400 | 53888200 | − | Tnfaip8l3 | 2431 |
| 9 | 56070800 | 56072400 | − | C230081A13Rik | 2432 |
| 9 | 57731800 | 57732800 | + | int | 2433 |
| 9 | 58707600 | 58708800 | + | Hcn4 | 2434 |
| 9 | 61365600 | 61366600 | + | int | 2435 |
| 9 | 61807600 | 61808600 | − | Paqr5 | 2436 |
| 9 | 63462000 | 63463200 | + | Aagab | 2437 |
| 9 | 63938600 | 63939600 | + | int | 2438 |
| 9 | 66401600 | 66403200 | − | Usp3 | 2439 |
| 9 | 73142800 | 73143800 | + | int | 2440 |
| 9 | 75740000 | 75741400 | + | Bmp5 | 2441 |
| 9 | 76231000 | 76232000 | + | int | 2442 |
| 9 | 76342600 | 76343600 | − | Fam83b | 2443 |
| 9 | 76567800 | 76568800 | + | int | 2444 |
| 9 | 76935400 | 76936600 | + | int | 2445 |
| 9 | 77097000 | 77098000 | − | 2310046A06Rik | 2446 |
| 9 | 79331600 | 79332600 | + | int | 2447 |
| 9 | 79562200 | 79563200 | − | Col12a1 | 2448 |
| 9 | 80540400 | 80541600 | + | int | 2449 |
| 9 | 80950600 | 80951600 | + | int | 2450 |
| 9 | 81336800 | 81337800 | + | int | 2451 |
| 9 | 81403800 | 81404800 | + | int | 2452 |
| 9 | 84306200 | 84307200 | + | int | 2453 |
| 9 | 84429200 | 84430400 | + | int | 2454 |
| 9 | 84638800 | 84640200 | + | int | 2455 |
| 9 | 84703800 | 84704800 | + | int | 2456 |
| 9 | 86793200 | 86794200 | + | int | 2457 |
| 9 | 87023000 | 87024000 | + | int | 2458 |
| 9 | 88023600 | 88024200 | + | int | 2459 |
| 9 | 88181000 | 88182200 | + | int | 2460 |
| 9 | 88682600 | 88683800 | + | int | 2461 |
| 9 | 88723400 | 88724400 | + | int | 2462 |
| 9 | 88784400 | 88785600 | + | int | 2463 |
| 9 | 88794200 | 88795400 | + | int | 2464 |

TABLE 1-continued

| chromo-some | start | stop | strand | nearest gene | ID |
|---|---|---|---|---|---|
| 9 | 89385800 | 89387200 | + | int | 2465 |
| 9 | 90254200 | 90255200 | + | int | 2466 |
| 9 | 90466400 | 90467400 | + | int | 2467 |
| 9 | 90723000 | 90724400 | + | int | 2468 |
| 9 | 90748400 | 90749400 | + | int | 2469 |
| 9 | 91067000 | 91068000 | + | int | 2470 |
| 9 | 91331000 | 91332000 | + | int | 2471 |
| 9 | 91376400 | 91378200 | + | int | 2472 |
| 9 | 91595600 | 91597000 | + | int | 2473 |
| 9 | 92200000 | 92201000 | + | int | 2474 |
| 9 | 93713600 | 93715000 | + | int | 2475 |
| 9 | 96719000 | 96720200 | + | int | 2476 |
| 9 | 99464000 | 99465200 | − | Armc8 | 2477 |
| 9 | 99464000 | 99465200 | − | Armc8 | 2478 |
| 9 | 99966400 | 99967800 | + | int | 2479 |
| 9 | 100325200 | 100326200 | + | int | 2480 |
| 9 | 102758600 | 102759600 | + | Ryk | 2481 |
| 9 | 105372200 | 105373200 | − | Atp2c1 | 2482 |
| 9 | 105720800 | 105722600 | + | Col6a6 | 2483 |
| 9 | 106285400 | 106287200 | + | int | 2484 |
| 9 | 109610200 | 109611600 | + | int | 2485 |
| 9 | 110537400 | 110538400 | − | Nbeal2 | 2486 |
| 9 | 111861000 | 111862000 | + | int | 2487 |
| 9 | 112067000 | 112068200 | − | Arpp21 | 2488 |
| 9 | 112067000 | 112068200 | − | Arpp21 | 2489 |
| 9 | 112067000 | 112068200 | − | Arpp21 | 2490 |
| 9 | 112067000 | 112068200 | − | Arpp21 | 2491 |
| 9 | 112067000 | 112068200 | − | Arpp21 | 2492 |
| 9 | 112067000 | 112068200 | − | Arpp21 | 2493 |
| 9 | 112857800 | 112858800 | + | int | 2494 |
| 9 | 113290800 | 113292000 | + | int | 2495 |
| 9 | 114980400 | 114981400 | + | Osbpl10 | 2496 |
| 9 | 115950400 | 115951400 | + | Gad1l | 2497 |
| 9 | 119131600 | 119132600 | − | 9330176C04Rik | 2498 |
| 9 | 123370200 | 123372000 | + | Lars2 | 2499 |
| 10 | 4232800 | 4234000 | + | int | 2500 |
| 10 | 4883000 | 4884000 | + | Syne1 | 2501 |
| 10 | 5514800 | 5516000 | − | Esr1 | 2502 |
| 10 | 6234400 | 6235400 | − | Mthfd1l | 2503 |
| 10 | 6234400 | 6235400 | − | Mthfd1l | 2504 |
| 10 | 7872600 | 7873800 | + | int | 2505 |
| 10 | 8275600 | 8277200 | + | int | 2506 |
| 10 | 9978400 | 9979800 | + | int | 2507 |
| 10 | 11250400 | 11251600 | + | int | 2508 |
| 10 | 11495600 | 11497000 | + | int | 2509 |
| 10 | 11881400 | 11882800 | + | int | 2510 |
| 10 | 14497800 | 14498800 | + | int | 2511 |
| 10 | 14842000 | 14843000 | + | int | 2512 |
| 10 | 15156000 | 15157400 | + | int | 2513 |
| 10 | 15253400 | 15254800 | + | int | 2514 |
| 10 | 15266000 | 15267400 | + | int | 2515 |
| 10 | 15278200 | 15279400 | + | int | 2516 |
| 10 | 15328600 | 15330000 | + | int | 2517 |
| 10 | 15420000 | 15421400 | + | int | 2518 |
| 10 | 15437600 | 15438600 | + | int | 2519 |
| 10 | 15486000 | 15487000 | + | int | 2520 |
| 10 | 15511000 | 15512400 | + | int | 2521 |
| 10 | 15536800 | 15537800 | + | int | 2522 |
| 10 | 15734600 | 15736000 | + | int | 2523 |
| 10 | 15894800 | 15895800 | + | int | 2524 |
| 10 | 15950400 | 15951800 | + | int | 2525 |
| 10 | 16036000 | 16037400 | + | int | 2526 |
| 10 | 16094600 | 16095600 | + | int | 2527 |
| 10 | 16119200 | 16120200 | + | int | 2528 |
| 10 | 16455800 | 16457000 | + | int | 2529 |
| 10 | 16461600 | 16463000 | + | int | 2530 |
| 10 | 16635600 | 16636800 | + | int | 2531 |
| 10 | 17026200 | 17027600 | + | int | 2532 |
| 10 | 19880800 | 19881800 | + | Mtap7 | 2533 |
| 10 | 20508400 | 20509600 | + | int | 2534 |
| 10 | 21861800 | 21863400 | + | int | 2535 |
| 10 | 22087400 | 22088800 | + | Raet1a | 2536 |
| 10 | 22087400 | 22088800 | + | Raet1b | 2537 |
| 10 | 22087400 | 22088800 | + | Raet1c | 2538 |
| 10 | 22087400 | 22088800 | + | Raet1d | 2539 |
| 10 | 22249200 | 22250800 | + | int | 2540 |
| 10 | 22919200 | 22920600 | − | Eya4 | 2541 |

TABLE 1-continued

| chromo-some | start | stop | strand | nearest gene | ID |
|---|---|---|---|---|---|
| 10 | 23458400 | 23459600 | + | int | 2542 |
| 10 | 23493200 | 23494200 | + | int | 2543 |
| 10 | 23673600 | 23674800 | + | int | 2544 |
| 10 | 23884000 | 23885000 | + | Stx7 | 2545 |
| 10 | 24145000 | 24146000 | + | int | 2546 |
| 10 | 25713200 | 25714200 | − | Tmem200a | 2547 |
| 10 | 26343000 | 26344200 | + | int | 2548 |
| 10 | 27039200 | 27040400 | − | Lama2 | 2549 |
| 10 | 27137200 | 27138600 | − | Lama2 | 2550 |
| 10 | 28885800 | 28886800 | + | 6330407J23Rik | 2551 |
| 10 | 29103600 | 29104600 | + | int | 2552 |
| 10 | 29282200 | 29283400 | + | int | 2553 |
| 10 | 29346800 | 29348600 | + | int | 2554 |
| 10 | 29501200 | 29502200 | + | int | 2555 |
| 10 | 29819400 | 29820400 | + | int | 2556 |
| 10 | 29862600 | 29863600 | + | int | 2557 |
| 10 | 29932400 | 29933800 | + | int | 2558 |
| 10 | 30043600 | 30044600 | + | int | 2559 |
| 10 | 30986000 | 30987000 | + | int | 2560 |
| 10 | 31394000 | 31395000 | + | int | 2561 |
| 10 | 31844800 | 31846000 | − | Nkain2 | 2562 |
| 10 | 31844800 | 31846000 | − | Nkain2 | 2563 |
| 10 | 31945800 | 31946800 | − | Nkain2 | 2564 |
| 10 | 31945800 | 31946800 | − | Nkain2 | 2565 |
| 10 | 32041200 | 32042600 | − | Nkain2 | 2566 |
| 10 | 32041200 | 32042600 | − | Nkain2 | 2567 |
| 10 | 32553600 | 32554800 | − | Nkain2 | 2568 |
| 10 | 32553600 | 32554800 | − | Nkain2 | 2569 |
| 10 | 33006200 | 33007200 | + | Trdn | 2570 |
| 10 | 33324200 | 33326000 | − | Clvs2 | 2571 |
| 10 | 33364200 | 33365200 | + | int | 2572 |
| 10 | 33540400 | 33541600 | + | int | 2573 |
| 10 | 33692600 | 33693600 | + | int | 2574 |
| 10 | 34275200 | 34276600 | + | Frk | 2575 |
| 10 | 34573600 | 34575200 | + | int | 2576 |
| 10 | 34712800 | 34713800 | + | int | 2577 |
| 10 | 34879000 | 34880000 | + | int | 2578 |
| 10 | 35130800 | 35131800 | + | int | 2579 |
| 10 | 35185400 | 35186800 | + | int | 2580 |
| 10 | 35369200 | 35370200 | + | int | 2581 |
| 10 | 35541400 | 35542600 | + | int | 2582 |
| 10 | 35622600 | 35623800 | + | int | 2583 |
| 10 | 35734400 | 35735400 | + | int | 2584 |
| 10 | 35887000 | 35888000 | + | int | 2585 |
| 10 | 36539400 | 36541000 | + | Hs3st5 | 2586 |
| 10 | 37609200 | 37610400 | + | int | 2587 |
| 10 | 37717400 | 37718400 | + | int | 2588 |
| 10 | 37738800 | 37740000 | + | int | 2589 |
| 10 | 37910400 | 37911400 | + | int | 2590 |
| 10 | 37949200 | 37950200 | + | int | 2591 |
| 10 | 39000400 | 39001600 | + | int | 2592 |
| 10 | 39616000 | 39617000 | − | AA474331 | 2593 |
| 10 | 39641000 | 39642000 | − | 2010001E11Rik | 2594 |
| 10 | 39730800 | 39731800 | − | AI317395 | 2595 |
| 10 | 40428400 | 40429400 | + | 9030224M15Rik | 2596 |
| 10 | 40548200 | 40549200 | + | int | 2597 |
| 10 | 44312200 | 44313200 | + | int | 2598 |
| 10 | 45205200 | 45206400 | + | int | 2599 |
| 10 | 45666800 | 45668400 | + | int | 2600 |
| 10 | 45888800 | 45890200 | + | int | 2601 |
| 10 | 46186200 | 46187400 | + | int | 2602 |
| 10 | 46524200 | 46525200 | + | int | 2603 |
| 10 | 46652600 | 46653800 | + | int | 2604 |
| 10 | 46753800 | 46754800 | + | int | 2605 |
| 10 | 47048400 | 47049400 | + | int | 2606 |
| 10 | 47099600 | 47100600 | + | int | 2607 |
| 10 | 47418800 | 47420000 | + | int | 2608 |
| 10 | 47461400 | 47462600 | + | int | 2609 |
| 10 | 47560200 | 47561400 | + | int | 2610 |
| 10 | 47630800 | 47632000 | + | int | 2611 |
| 10 | 48015800 | 48016800 | + | int | 2612 |
| 10 | 48131600 | 48132800 | + | int | 2613 |
| 10 | 48142600 | 48144000 | + | int | 2614 |
| 10 | 48198200 | 48199400 | + | int | 2615 |
| 10 | 48284200 | 48285200 | + | int | 2616 |
| 10 | 48367200 | 48368600 | + | int | 2617 |
| 10 | 48511800 | 48512800 | + | int | 2618 |

TABLE 1-continued

| chromosome | start | stop | strand | nearest gene | ID |
|---|---|---|---|---|---|
| 10 | 48552600 | 48553600 | + | int | 2619 |
| 10 | 48822400 | 48823400 | − | Grik2 | 2620 |
| 10 | 49071600 | 49073200 | − | Grik2 | 2621 |
| 10 | 49124200 | 49125400 | − | Grik2 | 2622 |
| 10 | 49261600 | 49263000 | − | Grik2 | 2623 |
| 10 | 49286000 | 49287400 | − | Grik2 | 2624 |
| 10 | 49290400 | 49291400 | − | Grik2 | 2625 |
| 10 | 49293000 | 49294600 | − | Grik2 | 2626 |
| 10 | 49315400 | 49316400 | − | Grik2 | 2627 |
| 10 | 50187200 | 50188200 | + | int | 2628 |
| 10 | 50494800 | 50496000 | + | Ascc3 | 2629 |
| 10 | 50533800 | 50535000 | + | Ascc3 | 2630 |
| 10 | 50703000 | 50704400 | + | Sim1 | 2631 |
| 10 | 50852600 | 50853600 | + | int | 2632 |
| 10 | 50921200 | 50922600 | + | int | 2633 |
| 10 | 50942000 | 50943200 | + | int | 2634 |
| 10 | 51056000 | 51057600 | + | int | 2635 |
| 10 | 51268400 | 51269800 | + | int | 2636 |
| 10 | 51358400 | 51359600 | + | int | 2637 |
| 10 | 51619000 | 51620600 | + | int | 2638 |
| 10 | 52742200 | 52745400 | + | Slc35f1 | 2639 |
| 10 | 53545200 | 53546200 | + | int | 2640 |
| 10 | 54218800 | 54220000 | + | int | 2641 |
| 10 | 54287400 | 54288400 | + | int | 2642 |
| 10 | 54535800 | 54537000 | + | int | 2643 |
| 10 | 54937800 | 54938800 | + | int | 2644 |
| 10 | 54963200 | 54964200 | + | int | 2645 |
| 10 | 55127000 | 55128600 | + | int | 2646 |
| 10 | 55224200 | 55225400 | + | int | 2647 |
| 10 | 55856400 | 55857400 | − | D630037F22Rik | 2648 |
| 10 | 55899200 | 55900200 | − | D630037F22Rik | 2649 |
| 10 | 56293400 | 56294400 | + | int | 2650 |
| 10 | 56738400 | 56739800 | + | int | 2651 |
| 10 | 56903600 | 56904800 | + | int | 2652 |
| 10 | 56968800 | 56970200 | + | int | 2653 |
| 10 | 57024600 | 57026000 | + | int | 2654 |
| 10 | 57157400 | 57158600 | + | int | 2655 |
| 10 | 57681600 | 57682600 | + | int | 2656 |
| 10 | 57686400 | 57688200 | + | int | 2657 |
| 10 | 57690400 | 57692000 | + | int | 2658 |
| 10 | 57694200 | 57695800 | − | 4933403O03Rik | 2659 |
| 10 | 57694200 | 57695800 | − | Dux | 2660 |
| 10 | 57884600 | 57885600 | + | Lims1 | 2661 |
| 10 | 57884600 | 57885600 | + | Lims1 | 2662 |
| 10 | 57884600 | 57885600 | + | Lims1 | 2663 |
| 10 | 58367800 | 58368800 | + | Sh3rf3 | 2664 |
| 10 | 58860000 | 58861000 | + | int | 2665 |
| 10 | 60986400 | 60987400 | + | Lrrc20 | 2666 |
| 10 | 60989600 | 60990600 | + | Lrrc20 | 2667 |
| 10 | 63621200 | 63622200 | + | Ctnna3 | 2668 |
| 10 | 63621200 | 63622200 | + | Ctnna3 | 2669 |
| 10 | 63621200 | 63622200 | + | Ctnna3 | 2670 |
| 10 | 64127400 | 64128400 | + | Ctnna3 | 2671 |
| 10 | 64127400 | 64128400 | + | Ctnna3 | 2672 |
| 10 | 64127400 | 64128400 | + | Ctnna3 | 2673 |
| 10 | 64206600 | 64207600 | + | Ctnna3 | 2674 |
| 10 | 64206600 | 64207600 | + | Ctnna3 | 2675 |
| 10 | 64206600 | 64207600 | + | Ctnna3 | 2676 |
| 10 | 64217400 | 64218600 | + | Ctnna3 | 2677 |
| 10 | 64217400 | 64218600 | + | Ctnna3 | 2678 |
| 10 | 64217400 | 64218600 | + | Ctnna3 | 2679 |
| 10 | 64465400 | 64466400 | + | Ctnna3 | 2680 |
| 10 | 64465400 | 64466400 | + | Ctnna3 | 2681 |
| 10 | 64465400 | 64466400 | + | Ctnna3 | 2682 |
| 10 | 64717000 | 64718200 | + | int | 2683 |
| 10 | 65097400 | 65098400 | + | int | 2684 |
| 10 | 65268000 | 65269000 | + | int | 2685 |
| 10 | 65877800 | 65879000 | + | int | 2686 |
| 10 | 67910600 | 67911800 | − | 1700040L02Rik | 2687 |
| 10 | 67932600 | 67933600 | − | 1700040L02Rik | 2688 |
| 10 | 68495600 | 68496800 | + | int | 2689 |
| 10 | 68607200 | 68608200 | + | int | 2690 |
| 10 | 68699200 | 68700200 | + | Rhobtb1 | 2691 |
| 10 | 71354600 | 71355800 | + | int | 2692 |
| 10 | 71661400 | 71662600 | + | int | 2693 |
| 10 | 71741800 | 71742800 | + | int | 2694 |
| 10 | 71758800 | 71759800 | + | int | 2695 |
| 10 | 71767800 | 71769000 | + | int | 2696 |
| 10 | 71990200 | 71991400 | + | int | 2697 |
| 10 | 72520000 | 72521000 | + | int | 2698 |
| 10 | 72525600 | 72527000 | + | int | 2699 |
| 10 | 72587000 | 72588200 | + | int | 2700 |
| 10 | 72643400 | 72644400 | + | int | 2701 |
| 10 | 73144400 | 73145400 | + | int | 2702 |
| 10 | 74213600 | 74214800 | + | int | 2703 |
| 10 | 76140000 | 76141200 | + | int | 2704 |
| 10 | 76407800 | 76408800 | − | Pcbp3 | 2705 |
| 10 | 77850800 | 77851800 | + | int | 2706 |
| 10 | 78461400 | 78463000 | + | int | 2707 |
| 10 | 80443800 | 80444800 | − | Gng7 | 2708 |
| 10 | 80443800 | 80444800 | − | Gng7 | 2709 |
| 10 | 80640600 | 80642200 | + | Eef2 | 2710 |
| 10 | 80640600 | 80642200 | + | Snord37 | 2711 |
| 10 | 81466600 | 81468000 | + | int | 2712 |
| 10 | 81530600 | 81531600 | + | int | 2713 |
| 10 | 81545200 | 81546600 | + | int | 2714 |
| 10 | 81685400 | 81686600 | + | int | 2715 |
| 10 | 81868800 | 81869800 | + | int | 2716 |
| 10 | 81916200 | 81917400 | + | int | 2717 |
| 10 | 81934200 | 81935400 | + | int | 2718 |
| 10 | 82061200 | 82062200 | + | int | 2719 |
| 10 | 82417200 | 82418800 | + | int | 2720 |
| 10 | 85369600 | 85370800 | − | Prdm4 | 2721 |
| 10 | 86733000 | 86734200 | + | int | 2722 |
| 10 | 89670200 | 89671200 | + | Anks1b | 2723 |
| 10 | 90012600 | 90014000 | + | Anks1b | 2724 |
| 10 | 90907400 | 90908400 | + | int | 2725 |
| 10 | 91379600 | 91380800 | + | int | 2726 |
| 10 | 92445400 | 92446400 | + | int | 2727 |
| 10 | 92892000 | 92893000 | + | int | 2728 |
| 10 | 93083200 | 93084000 | + | int | 2729 |
| 10 | 93135000 | 93136000 | + | Ntn4 | 2730 |
| 10 | 95590800 | 95592000 | + | int | 2731 |
| 10 | 96356800 | 96358000 | + | int | 2732 |
| 10 | 96635400 | 96636400 | + | int | 2733 |
| 10 | 96782200 | 96783600 | + | int | 2734 |
| 10 | 96975600 | 96976600 | + | Dcn | 2735 |
| 10 | 96975600 | 96976600 | + | Dcn | 2736 |
| 10 | 97065800 | 97066800 | + | int | 2737 |
| 10 | 97434200 | 97435200 | + | int | 2738 |
| 10 | 97733400 | 97734800 | + | int | 2739 |
| 10 | 97885800 | 97886800 | + | int | 2740 |
| 10 | 98416800 | 98417800 | + | Atp2b1 | 2741 |
| 10 | 98830400 | 98831400 | + | int | 2742 |
| 10 | 99233400 | 99234400 | + | int | 2743 |
| 10 | 99461800 | 99462800 | + | int | 2744 |
| 10 | 99759800 | 99761200 | + | int | 2745 |
| 10 | 99928800 | 99929800 | − | Tmtc3 | 2746 |
| 10 | 99928800 | 99929800 | − | Tmtc3 | 2747 |
| 10 | 100446600 | 100447800 | + | int | 2748 |
| 10 | 100541600 | 100542800 | + | int | 2749 |
| 10 | 100651200 | 100652600 | + | int | 2750 |
| 10 | 100984400 | 100985400 | + | int | 2751 |
| 10 | 101047600 | 101048800 | + | int | 2752 |
| 10 | 101108600 | 101109800 | + | int | 2753 |
| 10 | 101127400 | 101128400 | + | int | 2754 |
| 10 | 101238600 | 101239800 | + | int | 2755 |
| 10 | 101382200 | 101383200 | + | int | 2756 |
| 10 | 101482600 | 101484000 | + | int | 2757 |
| 10 | 101609000 | 101610400 | + | int | 2758 |
| 10 | 101710000 | 101711000 | + | Mgat4c | 2759 |
| 10 | 101710000 | 101711000 | + | Mgat4c | 2760 |
| 10 | 101763600 | 101764600 | + | Mgat4c | 2761 |
| 10 | 101763600 | 101764600 | + | Mgat4c | 2762 |
| 10 | 101836400 | 101837600 | + | Mgat4c | 2763 |
| 10 | 101836400 | 101837600 | + | Mgat4c | 2764 |
| 10 | 101836400 | 101837600 | + | Mgat4c | 2765 |
| 10 | 102100000 | 102101600 | + | int | 2766 |
| 10 | 102170800 | 102172200 | + | int | 2767 |
| 10 | 102184200 | 102185600 | + | int | 2768 |
| 10 | 102740000 | 102741000 | + | int | 2769 |
| 10 | 102831000 | 102832400 | + | Slc6a15 | 2770 |
| 10 | 102838800 | 102839800 | + | Slc6a15 | 2771 |
| 10 | 103376400 | 103378000 | + | int | 2772 |

TABLE 1-continued

| chromo-some | start | stop | strand | nearest gene | ID |
|---|---|---|---|---|---|
| 10 | 103514000 | 103515600 | + | int | 2773 |
| 10 | 103780400 | 103781400 | + | int | 2774 |
| 10 | 103827400 | 103828400 | + | int | 2775 |
| 10 | 104001600 | 104002600 | + | int | 2776 |
| 10 | 104058600 | 104059800 | + | int | 2777 |
| 10 | 104087600 | 104089000 | + | int | 2778 |
| 10 | 104171600 | 104173000 | + | int | 2779 |
| 10 | 104280800 | 104281800 | + | int | 2780 |
| 10 | 104517000 | 104518800 | + | int | 2781 |
| 10 | 104543400 | 104544400 | + | int | 2782 |
| 10 | 105255000 | 105256200 | − | BC067068 | 2783 |
| 10 | 105452800 | 105454200 | + | int | 2784 |
| 10 | 105513600 | 105514800 | + | int | 2785 |
| 10 | 105625000 | 105626200 | + | int | 2786 |
| 10 | 105721000 | 105722000 | + | int | 2787 |
| 10 | 105939200 | 105940200 | + | Ppfia2 | 2788 |
| 10 | 105955600 | 105956600 | + | Ppfia2 | 2789 |
| 10 | 106060000 | 106061200 | + | Ppfia2 | 2790 |
| 10 | 106206400 | 106207400 | + | Ppfia2 | 2791 |
| 10 | 106479400 | 106480400 | − | Acss3 | 2792 |
| 10 | 106479400 | 106480400 | − | Acss3 | 2793 |
| 10 | 106943400 | 106944400 | + | int | 2794 |
| 10 | 106953400 | 106954400 | + | int | 2795 |
| 10 | 107019200 | 107020200 | − | Ptprq | 2796 |
| 10 | 108319200 | 108320200 | − | Syt1 | 2797 |
| 10 | 108414600 | 108415600 | − | Syt1 | 2798 |
| 10 | 111611800 | 111613000 | + | Caps2 | 2799 |
| 10 | 111658600 | 111659800 | + | int | 2800 |
| 10 | 112041800 | 112045000 | + | int | 2801 |
| 10 | 112124200 | 112125200 | + | int | 2802 |
| 10 | 112764200 | 112765200 | + | int | 2803 |
| 10 | 112798600 | 112800000 | + | int | 2804 |
| 10 | 112959000 | 112962000 | + | int | 2805 |
| 10 | 113013600 | 113014600 | + | int | 2806 |
| 10 | 113085400 | 113086800 | + | int | 2807 |
| 10 | 113135800 | 113137200 | + | int | 2808 |
| 10 | 113450600 | 113451600 | + | int | 2809 |
| 10 | 113483000 | 113484000 | + | int | 2810 |
| 10 | 113569200 | 113570200 | + | int | 2811 |
| 10 | 113892800 | 113893800 | − | Trhde | 2812 |
| 10 | 114253400 | 114254400 | + | int | 2813 |
| 10 | 115200600 | 115201600 | + | int | 2814 |
| 10 | 115550200 | 115551200 | + | Ptprr | 2815 |
| 10 | 115550200 | 115551200 | − | 4933416C03Rik | 2816 |
| 10 | 115580800 | 115581800 | + | Ptprr | 2817 |
| 10 | 116198200 | 116199400 | + | int | 2818 |
| 10 | 117507200 | 117508200 | + | int | 2819 |
| 10 | 117593600 | 117594600 | + | Mdm1 | 2820 |
| 10 | 117949200 | 117950200 | + | int | 2821 |
| 10 | 120579800 | 120581200 | + | int | 2822 |
| 10 | 121663400 | 121664400 | + | int | 2823 |
| 10 | 122890200 | 122891200 | + | Fam19a2 | 2824 |
| 10 | 123125800 | 123126800 | + | Fam19a2 | 2825 |
| 10 | 123382000 | 123383000 | + | int | 2826 |
| 10 | 124000600 | 124001600 | + | int | 2827 |
| 10 | 124030400 | 124031600 | + | int | 2828 |
| 10 | 124116800 | 124118000 | + | int | 2829 |
| 10 | 125721800 | 125722800 | + | int | 2830 |
| 10 | 125947600 | 125949600 | + | int | 2831 |
| 10 | 126665400 | 126666400 | − | Kif5a | 2832 |
| 10 | 126665400 | 126666400 | − | Kif5a | 2833 |
| 10 | 126734200 | 126735400 | − | Mars | 2834 |
| 10 | 128848800 | 128850400 | + | int | 2835 |
| 10 | 128868400 | 128869400 | + | int | 2836 |
| 10 | 128923800 | 128925000 | + | int | 2837 |
| 10 | 129068200 | 129069400 | + | int | 2838 |
| 10 | 129077000 | 129078000 | + | int | 2839 |
| 10 | 129084000 | 129087200 | + | Olfr799 | 2840 |
| 10 | 129133600 | 129134600 | + | int | 2841 |
| 10 | 129207600 | 129209000 | + | int | 2842 |
| 10 | 129219600 | 129220600 | + | int | 2843 |
| 10 | 129340600 | 129342000 | − | Olfr815 | 2844 |
| 10 | 129563200 | 129564200 | − | Olfr824 | 2845 |
| 10 | 129607600 | 129608600 | + | int | 2846 |
| 10 | 129690400 | 129691400 | + | int | 2847 |
| 10 | 129695800 | 129697200 | + | int | 2848 |
| 10 | 129850200 | 129851200 | + | int | 2849 |
| 11 | 3025400 | 3026600 | + | Pisd-ps1 | 2850 |
| 11 | 3025400 | 3026600 | + | Pisd-ps3 | 2851 |
| 11 | 3528800 | 3529800 | + | int | 2852 |
| 11 | 3544400 | 3545400 | − | Tug1 | 2853 |
| 11 | 3544400 | 3545400 | − | Tug1 | 2854 |
| 11 | 3970600 | 3971600 | + | Sec14l3 | 2855 |
| 11 | 5911000 | 5912600 | − | Camk2b | 2856 |
| 11 | 8948400 | 8949400 | + | Gm11992 | 2857 |
| 11 | 8948400 | 8949400 | − | Sun3 | 2858 |
| 11 | 8984000 | 8985600 | + | int | 2859 |
| 11 | 10692800 | 10694200 | + | int | 2860 |
| 11 | 11325600 | 11326800 | − | Zpbp | 2861 |
| 11 | 12406000 | 12407200 | + | int | 2862 |
| 11 | 12677800 | 12679200 | + | int | 2863 |
| 11 | 12882800 | 12884000 | + | int | 2864 |
| 11 | 13792800 | 13793800 | + | int | 2865 |
| 11 | 13907200 | 13908200 | + | int | 2866 |
| 11 | 14208400 | 14209600 | + | int | 2867 |
| 11 | 14295200 | 14296200 | + | int | 2868 |
| 11 | 14483400 | 14484400 | + | int | 2869 |
| 11 | 14639200 | 14641000 | + | int | 2870 |
| 11 | 15441200 | 15442200 | + | int | 2871 |
| 11 | 15473600 | 15475000 | + | int | 2872 |
| 11 | 15524400 | 15525800 | + | int | 2873 |
| 11 | 15555000 | 15556000 | + | int | 2874 |
| 11 | 15572000 | 15573000 | + | int | 2875 |
| 11 | 15589800 | 15591400 | + | int | 2876 |
| 11 | 16160600 | 16161600 | + | Vstm2a | 2877 |
| 11 | 16260800 | 16262000 | + | int | 2878 |
| 11 | 16325200 | 16326200 | + | int | 2879 |
| 11 | 16575400 | 16576400 | + | int | 2880 |
| 11 | 16627800 | 16629600 | + | int | 2881 |
| 11 | 16913800 | 16915000 | + | int | 2882 |
| 11 | 17051000 | 17052200 | + | int | 2883 |
| 11 | 17138200 | 17139200 | + | int | 2884 |
| 11 | 17996800 | 17997800 | + | int | 2885 |
| 11 | 18186800 | 18187800 | + | int | 2886 |
| 11 | 18421400 | 18422400 | + | int | 2887 |
| 11 | 19485200 | 19486600 | + | int | 2888 |
| 11 | 21291600 | 21292600 | + | int | 2889 |
| 11 | 21352600 | 21353600 | + | int | 2890 |
| 11 | 21758800 | 21759800 | + | AV249152 | 2891 |
| 11 | 25253200 | 25254400 | + | int | 2892 |
| 11 | 25496400 | 25497400 | + | int | 2893 |
| 11 | 26908200 | 26909400 | + | int | 2894 |
| 11 | 27186000 | 27187000 | + | int | 2895 |
| 11 | 27218000 | 27219000 | + | int | 2896 |
| 11 | 27246800 | 27248000 | + | int | 2897 |
| 11 | 28060200 | 28061200 | + | int | 2898 |
| 11 | 28437600 | 28438600 | − | Ccdc85a | 2899 |
| 11 | 28678600 | 28679200 | + | int | 2900 |
| 11 | 29363000 | 29364000 | + | Ccdc88a | 2901 |
| 11 | 30888400 | 30889400 | + | Asb3 | 2902 |
| 11 | 30888400 | 30889400 | − | Chac2 | 2903 |
| 11 | 31056800 | 31057800 | + | int | 2904 |
| 11 | 32525800 | 32526800 | + | int | 2905 |
| 11 | 33450800 | 33451800 | − | Gabrp | 2906 |
| 11 | 33506800 | 33508200 | + | int | 2907 |
| 11 | 37066000 | 37067000 | + | int | 2908 |
| 11 | 37075000 | 37076200 | + | int | 2909 |
| 11 | 37547400 | 37548400 | + | int | 2910 |
| 11 | 37791000 | 37792000 | + | int | 2911 |
| 11 | 38180000 | 38181000 | + | int | 2912 |
| 11 | 38306000 | 38307000 | + | int | 2913 |
| 11 | 38991400 | 38993000 | + | int | 2914 |
| 11 | 39269600 | 39270600 | + | int | 2915 |
| 11 | 39639000 | 39640000 | + | int | 2916 |
| 11 | 39785800 | 39787200 | + | int | 2917 |
| 11 | 40460400 | 40461600 | + | int | 2918 |
| 11 | 40653000 | 40654000 | + | int | 2919 |
| 11 | 40732600 | 40733600 | + | int | 2920 |
| 11 | 40903200 | 40904800 | + | int | 2921 |
| 11 | 41458400 | 41459400 | + | int | 2922 |
| 11 | 41663000 | 41664000 | + | int | 2923 |
| 11 | 44223600 | 44224600 | + | Il12b | 2924 |
| 11 | 46873200 | 46874200 | − | Sgcd | 2925 |
| 11 | 47700200 | 47701200 | + | int | 2926 |

TABLE 1-continued

| chromosome | start | stop | strand | nearest gene | ID |
|---|---|---|---|---|---|
| 11 | 47888600 | 47889600 | + | int | 2927 |
| 11 | 48041000 | 48042200 | + | int | 2928 |
| 11 | 48525800 | 48526800 | + | int | 2929 |
| 11 | 49380600 | 49381800 | + | int | 2930 |
| 11 | 50595000 | 50596000 | + | Adamts2 | 2931 |
| 11 | 50953000 | 50954000 | + | int | 2932 |
| 11 | 51250200 | 51251200 | + | Col23a1 | 2933 |
| 11 | 52732800 | 52733800 | + | Fstl4 | 2934 |
| 11 | 55865800 | 55866800 | + | int | 2935 |
| 11 | 57369000 | 57370400 | + | int | 2936 |
| 11 | 57372200 | 57373200 | + | int | 2937 |
| 11 | 58332400 | 58333400 | + | int | 2938 |
| 11 | 58663800 | 58664800 | + | int | 2939 |
| 11 | 58666000 | 58667000 | + | int | 2940 |
| 11 | 58858000 | 58859000 | − | Obscn | 2941 |
| 11 | 58858000 | 58859000 | − | Obscn | 2942 |
| 11 | 61004400 | 61005400 | + | int | 2943 |
| 11 | 62049300 | 62050400 | + | int | 2944 |
| 11 | 73388200 | 73389200 | + | int | 2945 |
| 11 | 73419400 | 73420400 | + | int | 2946 |
| 11 | 74019200 | 74020600 | − | Olfr43 | 2947 |
| 11 | 81386000 | 81387200 | − | 1700071K01Rik | 2948 |
| 11 | 81386000 | 81387200 | − | Accn1 | 2949 |
| 11 | 85255000 | 85256000 | + | Bcas3 | 2950 |
| 11 | 85271200 | 85272400 | + | Bcas3 | 2951 |
| 11 | 85936400 | 85937400 | − | Brip1 | 2952 |
| 11 | 90349000 | 90350000 | − | Stxbp4 | 2953 |
| 11 | 91489200 | 91490200 | + | int | 2954 |
| 11 | 91846800 | 91847800 | + | int | 2955 |
| 11 | 91999200 | 92000800 | + | int | 2956 |
| 11 | 92354000 | 92355000 | + | int | 2957 |
| 11 | 92548000 | 92549200 | + | int | 2958 |
| 11 | 92641000 | 92642000 | + | int | 2959 |
| 11 | 92689200 | 92690200 | + | int | 2960 |
| 11 | 92807600 | 92808600 | + | int | 2961 |
| 11 | 93843800 | 93844800 | + | int | 2962 |
| 11 | 95042400 | 95043600 | + | int | 2963 |
| 11 | 100381200 | 100382200 | − | Acly | 2964 |
| 11 | 101854600 | 101855800 | + | int | 2965 |
| 11 | 103624600 | 103625600 | + | int | 2966 |
| 11 | 103933400 | 103935200 | + | int | 2967 |
| 11 | 107644600 | 107645800 | − | Cacng4 | 2968 |
| 11 | 108543200 | 108544200 | + | Ccdc46 | 2969 |
| 11 | 108543200 | 108544200 | + | Ccdc46 | 2970 |
| 11 | 108543200 | 108544200 | + | Ccdc46 | 2971 |
| 11 | 108872400 | 108874000 | + | int | 2972 |
| 11 | 109054000 | 109055000 | + | int | 2973 |
| 11 | 113374000 | 113375200 | − | Slc39a11 | 2974 |
| 11 | 116199400 | 116200600 | − | Foxj1 | 2975 |
| 11 | 116199400 | 116200600 | − | Rnf157 | 2976 |
| 11 | 117026200 | 117027200 | + | int | 2977 |
| 11 | 117311600 | 117312800 | + | int | 2978 |
| 11 | 118253800 | 118254800 | − | Lgals3bp | 2979 |
| 11 | 118570600 | 118571800 | − | D11Bwg0517e | 2980 |
| 12 | 3021400 | 3022400 | + | int | 2981 |
| 12 | 3109000 | 3110800 | + | int | 2982 |
| 12 | 5435600 | 5436600 | + | int | 2983 |
| 12 | 6096400 | 6097400 | + | int | 2984 |
| 12 | 7445200 | 7446200 | + | int | 2985 |
| 12 | 8137400 | 8138200 | + | int | 2986 |
| 12 | 8379200 | 8380200 | + | int | 2987 |
| 12 | 9684800 | 9685800 | + | int | 2988 |
| 12 | 9868400 | 9869400 | + | int | 2989 |
| 12 | 10195800 | 10196800 | + | int | 2990 |
| 12 | 13854200 | 13856000 | + | int | 2991 |
| 12 | 14179000 | 14180000 | + | int | 2992 |
| 12 | 14907800 | 14909200 | + | int | 2993 |
| 12 | 15114400 | 15115000 | + | int | 2994 |
| 12 | 15451600 | 15452800 | + | int | 2995 |
| 12 | 16558600 | 16560200 | − | Lpin1 | 2996 |
| 12 | 17146000 | 17147000 | + | int | 2997 |
| 12 | 18179600 | 18180000 | + | int | 2998 |
| 12 | 18800800 | 18802400 | + | int | 2999 |
| 12 | 19146800 | 19148400 | + | int | 3000 |
| 12 | 19561600 | 19562600 | + | int | 3001 |
| 12 | 19856800 | 19857800 | + | int | 3002 |
| 12 | 20201600 | 20203000 | + | int | 3003 |
| 12 | 20515000 | 20516000 | + | int | 3004 |
| 12 | 20815000 | 20816200 | − | 1700030C10Rik | 3005 |
| 12 | 20926600 | 20927600 | + | int | 3006 |
| 12 | 21055200 | 21056200 | + | int | 3007 |
| 12 | 21582200 | 21583200 | + | int | 3008 |
| 12 | 22897600 | 22898600 | + | int | 3009 |
| 12 | 23080800 | 23081800 | + | int | 3010 |
| 12 | 23186200 | 23187600 | + | int | 3011 |
| 12 | 24442600 | 24443800 | + | int | 3012 |
| 12 | 24844200 | 24845600 | + | int | 3013 |
| 12 | 25109200 | 25110400 | + | int | 3014 |
| 12 | 26731200 | 26732200 | + | int | 3015 |
| 12 | 27529200 | 27530200 | + | int | 3016 |
| 12 | 28083400 | 28084600 | + | int | 3017 |
| 12 | 29079800 | 29080800 | + | int | 3018 |
| 12 | 29626800 | 29628200 | + | int | 3019 |
| 12 | 29843800 | 29844800 | + | int | 3020 |
| 12 | 30792000 | 30793200 | − | Tpo | 3021 |
| 12 | 34899400 | 34900800 | + | int | 3022 |
| 12 | 35835800 | 35836800 | + | int | 3023 |
| 12 | 35870600 | 35871600 | + | int | 3024 |
| 12 | 36112000 | 36113200 | + | int | 3025 |
| 12 | 37684600 | 37685800 | + | int | 3026 |
| 12 | 37904200 | 37905200 | + | Meox2 | 3027 |
| 12 | 38003600 | 38005400 | + | Tmem195 | 3028 |
| 12 | 38760000 | 38762000 | + | Dgkb | 3029 |
| 12 | 39042400 | 39043400 | + | Dgkb | 3030 |
| 12 | 39136400 | 39137400 | + | Dgkb | 3031 |
| 12 | 40223600 | 40224800 | + | int | 3032 |
| 12 | 42112000 | 42113400 | + | Immp2l | 3033 |
| 12 | 42811000 | 42812000 | + | Immp2l | 3034 |
| 12 | 43141600 | 43143000 | + | int | 3035 |
| 12 | 43628400 | 43629400 | + | int | 3036 |
| 12 | 43833200 | 43834200 | + | int | 3037 |
| 12 | 44162800 | 44163800 | + | int | 3038 |
| 12 | 44491000 | 44492000 | + | int | 3039 |
| 12 | 45542800 | 45544200 | + | Nrcam | 3040 |
| 12 | 45674400 | 45675400 | + | Nrcam | 3041 |
| 12 | 45872600 | 45874400 | + | int | 3042 |
| 12 | 46516000 | 46517000 | + | int | 3043 |
| 12 | 46644600 | 46645600 | + | int | 3044 |
| 12 | 46755600 | 46757400 | + | int | 3045 |
| 12 | 46774800 | 46776200 | + | int | 3046 |
| 12 | 46860200 | 46861200 | + | int | 3047 |
| 12 | 47045400 | 47046400 | + | int | 3048 |
| 12 | 47049600 | 47051400 | + | int | 3049 |
| 12 | 48059000 | 48060000 | + | int | 3050 |
| 12 | 48346400 | 48347800 | + | int | 3051 |
| 12 | 48582000 | 48583000 | + | int | 3052 |
| 12 | 48992600 | 48993600 | + | int | 3053 |
| 12 | 49195400 | 49196600 | + | int | 3054 |
| 12 | 49814000 | 49815000 | + | int | 3055 |
| 12 | 49887200 | 49888600 | + | int | 3056 |
| 12 | 50262200 | 50263800 | + | int | 3057 |
| 12 | 50530200 | 50531400 | + | int | 3058 |
| 12 | 51024000 | 51025400 | + | int | 3059 |
| 12 | 51174200 | 51175400 | + | int | 3060 |
| 12 | 51196800 | 51197800 | + | int | 3061 |
| 12 | 52020400 | 52021600 | + | int | 3062 |
| 12 | 52250000 | 52251000 | + | int | 3063 |
| 12 | 53361000 | 53362000 | + | Nubpl | 3064 |
| 12 | 53959000 | 53960000 | + | Akap6 | 3065 |
| 12 | 54051200 | 54052800 | + | Akap6 | 3066 |
| 12 | 54558600 | 54560000 | + | Npas3 | 3067 |
| 12 | 58315400 | 58316400 | + | int | 3068 |
| 12 | 58616200 | 58617800 | + | int | 3069 |
| 12 | 59072000 | 59073000 | + | int | 3070 |
| 12 | 59350000 | 59351000 | + | int | 3071 |
| 12 | 59361000 | 59362000 | + | int | 3072 |
| 12 | 61344600 | 61345600 | + | int | 3073 |
| 12 | 61368000 | 61369200 | + | int | 3074 |
| 12 | 61611400 | 61612400 | + | int | 3075 |
| 12 | 61690800 | 61692200 | + | int | 3076 |
| 12 | 61726800 | 61727800 | + | int | 3077 |
| 12 | 61731000 | 61732200 | + | int | 3078 |
| 12 | 61953400 | 61955000 | + | int | 3079 |
| 12 | 62705400 | 62706400 | + | Lrfn5 | 3080 |

TABLE 1-continued

| chromo-some | start | stop | strand | nearest gene | ID |
|---|---|---|---|---|---|
| 12 | 62825600 | 62826800 | + | Lrfn5 | 3081 |
| 12 | 63155000 | 63156200 | + | int | 3082 |
| 12 | 63333400 | 63335000 | + | int | 3083 |
| 12 | 63606200 | 63607400 | + | int | 3084 |
| 12 | 63692000 | 63693400 | + | int | 3085 |
| 12 | 64053400 | 64054400 | + | int | 3086 |
| 12 | 64554400 | 64555800 | + | int | 3087 |
| 12 | 65112600 | 65113600 | + | int | 3088 |
| 12 | 65187800 | 65189200 | + | int | 3089 |
| 12 | 66763800 | 66764800 | + | int | 3090 |
| 12 | 67134000 | 67135000 | + | int | 3091 |
| 12 | 67188000 | 67189200 | + | int | 3092 |
| 12 | 67384600 | 67385800 | − | Rpl10l | 3093 |
| 12 | 67628400 | 67630000 | − | Mdga2 | 3094 |
| 12 | 68165400 | 68166400 | − | Mdga2 | 3095 |
| 12 | 68343600 | 68344800 | + | int | 3096 |
| 12 | 68980600 | 68982000 | + | int | 3097 |
| 12 | 71342600 | 71343600 | + | int | 3098 |
| 12 | 71471600 | 71472600 | + | int | 3099 |
| 12 | 73370400 | 73371400 | − | Rtn1 | 3100 |
| 12 | 75731600 | 75733000 | + | int | 3101 |
| 12 | 78015600 | 78016200 | + | Fntb | 3102 |
| 12 | 79334800 | 79335800 | + | Gphn | 3103 |
| 12 | 79451200 | 79452800 | + | Gphn | 3104 |
| 12 | 80758800 | 80760400 | + | Rad51l1 | 3105 |
| 12 | 86225400 | 86226400 | + | int | 3106 |
| 12 | 89412600 | 89414000 | + | int | 3107 |
| 12 | 89536000 | 89537000 | + | int | 3108 |
| 12 | 89715200 | 89716200 | + | int | 3109 |
| 12 | 90412600 | 90413600 | + | Nrxn3 | 3110 |
| 12 | 91442600 | 91443600 | + | Nrxn3 | 3111 |
| 12 | 92037000 | 92038200 | + | int | 3112 |
| 12 | 92478000 | 92479200 | − | 4930534B04Rik | 3113 |
| 12 | 93445000 | 93446000 | + | int | 3114 |
| 12 | 93525200 | 93526200 | + | int | 3115 |
| 12 | 94564600 | 94565600 | + | int | 3116 |
| 12 | 95060600 | 95062200 | + | int | 3117 |
| 12 | 95166400 | 95167800 | + | int | 3118 |
| 12 | 95659800 | 95661000 | + | int | 3119 |
| 12 | 96206400 | 96207400 | + | int | 3120 |
| 12 | 96333600 | 96334800 | + | int | 3121 |
| 12 | 96493600 | 96494600 | + | int | 3122 |
| 12 | 97855400 | 97856600 | + | int | 3123 |
| 12 | 97913600 | 97915000 | + | int | 3124 |
| 12 | 98087400 | 98089000 | + | int | 3125 |
| 12 | 98700600 | 98701800 | + | int | 3126 |
| 12 | 98877000 | 98878000 | + | int | 3127 |
| 12 | 98926400 | 98927800 | + | int | 3128 |
| 12 | 99008200 | 99009400 | + | int | 3129 |
| 12 | 100882600 | 100884200 | + | int | 3130 |
| 12 | 101335400 | 101336400 | + | int | 3131 |
| 12 | 101340600 | 101341600 | + | int | 3132 |
| 12 | 101580000 | 101581000 | − | Ttc7b | 3133 |
| 12 | 102406800 | 102407800 | + | int | 3134 |
| 12 | 102438400 | 102440000 | + | int | 3135 |
| 12 | 102738400 | 102739400 | + | Catsperb | 3136 |
| 12 | 102910400 | 102911400 | − | Tc2n | 3137 |
| 12 | 102910400 | 102911400 | − | Tc2n | 3138 |
| 12 | 102915000 | 102916000 | − | Tc2n | 3139 |
| 12 | 102915000 | 102916000 | − | Tc2n | 3140 |
| 12 | 102943400 | 102944600 | − | Tc2n | 3141 |
| 12 | 102943400 | 102944600 | − | Tc2n | 3142 |
| 12 | 104721800 | 104723000 | + | int | 3143 |
| 12 | 104976400 | 104977000 | − | Serpina1b | 3144 |
| 12 | 105290200 | 105291200 | + | int | 3145 |
| 12 | 106858800 | 106859800 | − | Atg2b | 3146 |
| 12 | 107360800 | 107361800 | + | int | 3147 |
| 12 | 107454600 | 107455800 | + | int | 3148 |
| 12 | 107457000 | 107458000 | + | int | 3149 |
| 12 | 108543000 | 108544000 | + | int | 3150 |
| 12 | 109152000 | 109153000 | − | Bcl11b | 3151 |
| 12 | 110748000 | 110749200 | + | int | 3152 |
| 12 | 110996000 | 110997000 | + | int | 3153 |
| 12 | 111278400 | 111279400 | + | int | 3154 |
| 12 | 112535400 | 112536600 | − | Cdc42bpb | 3155 |
| 12 | 113299800 | 113300800 | + | Tdrd9 | 3156 |
| 12 | 115169600 | 115170800 | + | int | 3157 |
| 12 | 115212200 | 115213600 | + | int | 3158 |
| 12 | 115225800 | 115226800 | + | int | 3159 |
| 12 | 115460600 | 115461600 | + | int | 3160 |
| 12 | 115470200 | 115471800 | + | int | 3161 |
| 12 | 115575200 | 115576800 | + | int | 3162 |
| 12 | 115821400 | 115822600 | + | int | 3163 |
| 12 | 116088800 | 116090200 | + | int | 3164 |
| 12 | 119591400 | 119592400 | + | int | 3165 |
| 12 | 119798400 | 119799400 | + | int | 3166 |
| 12 | 120211000 | 120212600 | + | int | 3167 |
| 12 | 120743400 | 120745000 | + | int | 3168 |
| 12 | 120814600 | 120816200 | + | int | 3169 |
| 12 | 120870000 | 120871200 | + | int | 3170 |
| 12 | 120974800 | 120975800 | + | int | 3171 |
| 12 | 121170600 | 121172000 | + | int | 3172 |
| 13 | 3136600 | 3138200 | + | int | 3173 |
| 13 | 3298800 | 3300200 | + | int | 3174 |
| 13 | 3371800 | 3373400 | + | int | 3175 |
| 13 | 3469400 | 3470800 | + | int | 3176 |
| 13 | 3490400 | 3491400 | + | 2810429I04Rik | 3177 |
| 13 | 4090200 | 4091600 | + | int | 3178 |
| 13 | 4427200 | 4428400 | + | int | 3179 |
| 13 | 4838400 | 4839400 | + | int | 3180 |
| 13 | 5522400 | 5523400 | + | int | 3181 |
| 13 | 5691800 | 5694800 | + | int | 3182 |
| 13 | 6272000 | 6273000 | + | int | 3183 |
| 13 | 7510600 | 7511800 | + | int | 3184 |
| 13 | 9832800 | 9834600 | + | int | 3185 |
| 13 | 9865400 | 9866400 | + | int | 3186 |
| 13 | 10948600 | 10949600 | + | int | 3187 |
| 13 | 10997800 | 10998800 | + | int | 3188 |
| 13 | 12821600 | 12822600 | + | int | 3189 |
| 13 | 13029800 | 13030800 | + | int | 3190 |
| 13 | 13048200 | 13049200 | + | int | 3191 |
| 13 | 13102200 | 13103200 | + | int | 3192 |
| 13 | 13133600 | 13135000 | + | int | 3193 |
| 13 | 14351400 | 14352800 | − | Hecw1 | 3194 |
| 13 | 14421800 | 14422800 | − | Hecw1 | 3195 |
| 13 | 14630800 | 14632200 | + | int | 3196 |
| 13 | 14902200 | 14903200 | + | int | 3197 |
| 13 | 15389800 | 15393200 | + | int | 3198 |
| 13 | 16174600 | 16176000 | + | int | 3199 |
| 13 | 16610600 | 16611600 | + | int | 3200 |
| 13 | 18041800 | 18043000 | + | int | 3201 |
| 13 | 18540200 | 18541200 | + | int | 3202 |
| 13 | 19218800 | 19219800 | + | Amph | 3203 |
| 13 | 19857800 | 19858800 | − | Gpr141 | 3204 |
| 13 | 21160000 | 21161200 | + | int | 3205 |
| 13 | 21164000 | 21165000 | − | Olfr1370 | 3206 |
| 13 | 21215000 | 21216400 | + | int | 3207 |
| 13 | 22819000 | 22820200 | − | Vmn1r207-ps | 3208 |
| 13 | 23056200 | 23057200 | + | int | 3209 |
| 13 | 24383800 | 24384800 | + | int | 3210 |
| 13 | 25547400 | 25548600 | + | int | 3211 |
| 13 | 26451000 | 26452000 | + | int | 3212 |
| 13 | 26457200 | 26458200 | + | int | 3213 |
| 13 | 27105400 | 27106800 | + | int | 3214 |
| 13 | 27429200 | 27430600 | + | int | 3215 |
| 13 | 27622200 | 27623400 | + | int | 3216 |
| 13 | 27785600 | 27786600 | + | int | 3217 |
| 13 | 28471400 | 28472400 | + | int | 3218 |
| 13 | 28625800 | 28627200 | + | int | 3219 |
| 13 | 32653200 | 32654200 | + | int | 3220 |
| 13 | 33195000 | 33196200 | + | int | 3221 |
| 13 | 33463200 | 33464800 | + | int | 3222 |
| 13 | 34129000 | 34130000 | + | Bphl | 3223 |
| 13 | 36930600 | 36932200 | + | int | 3224 |
| 13 | 40169600 | 40171000 | − | Ofcc1 | 3225 |
| 13 | 41369000 | 41370000 | + | BC024659 | 3226 |
| 13 | 42205400 | 42206400 | + | Hivep1 | 3227 |
| 13 | 42234800 | 42236000 | + | Hivep1 | 3228 |
| 13 | 43098200 | 43099600 | + | Phactr1 | 3229 |
| 13 | 43098200 | 43099600 | + | Phactr1 | 3230 |
| 13 | 43380000 | 43381000 | − | Gfod1 | 3231 |
| 13 | 44935200 | 44936200 | + | Jarid2 | 3232 |
| 13 | 44964800 | 44965800 | + | Jarid2 | 3233 |
| 13 | 45841000 | 45842200 | − | Atxn1 | 3234 |

TABLE 1-continued

| chromo-some | start | stop | strand | nearest gene | ID |
|---|---|---|---|---|---|
| 13 | 47842600 | 47843600 | + | int | 3235 |
| 13 | 49795600 | 49796600 | + | Iars | 3236 |
| 13 | 49859600 | 49860600 | + | int | 3237 |
| 13 | 50121800 | 50123400 | + | int | 3238 |
| 13 | 50282400 | 50283400 | + | int | 3239 |
| 13 | 50718200 | 50719600 | + | int | 3240 |
| 13 | 50862400 | 50863600 | + | int | 3241 |
| 13 | 51414800 | 51415800 | + | int | 3242 |
| 13 | 52703800 | 52704800 | + | Sykb | 3243 |
| 13 | 55262400 | 55263400 | + | Fgfr4 | 3244 |
| 13 | 56473400 | 56474400 | + | int | 3245 |
| 13 | 57046200 | 57047200 | + | int | 3246 |
| 13 | 57541000 | 57542000 | − | Spock1 | 3247 |
| 13 | 57541000 | 57542000 | − | Spock1 | 3248 |
| 13 | 58151800 | 58152800 | + | int | 3249 |
| 13 | 60932800 | 60933800 | + | int | 3250 |
| 13 | 61246600 | 61250000 | + | int | 3251 |
| 13 | 61530100 | 61531100 | + | int | 3252 |
| 13 | 61761000 | 61762400 | + | int | 3253 |
| 13 | 61926800 | 61928200 | + | int | 3254 |
| 13 | 64836800 | 64837800 | + | int | 3255 |
| 13 | 65245600 | 65246600 | + | int | 3256 |
| 13 | 65253400 | 65254800 | + | Olfr466 | 3257 |
| 13 | 65628200 | 65629200 | + | int | 3258 |
| 13 | 65713000 | 65714400 | + | int | 3259 |
| 13 | 65760800 | 65761800 | + | int | 3260 |
| 13 | 65827200 | 65828200 | + | int | 3261 |
| 13 | 65858200 | 65859400 | + | int | 3262 |
| 13 | 66091200 | 66093000 | + | int | 3263 |
| 13 | 66565600 | 66567000 | + | int | 3264 |
| 13 | 66663800 | 66664800 | + | int | 3265 |
| 13 | 67069400 | 67070400 | + | Ptdss1 | 3266 |
| 13 | 67552200 | 67553200 | − | Zfp874 | 3267 |
| 13 | 69029200 | 69030200 | − | Adcy2 | 3268 |
| 13 | 69484600 | 69485600 | + | int | 3269 |
| 13 | 71807800 | 71808800 | + | int | 3270 |
| 13 | 73380800 | 73381800 | + | int | 3271 |
| 13 | 74330000 | 74331000 | − | Exoc3 | 3272 |
| 13 | 74370400 | 74371400 | − | Ahrr | 3273 |
| 13 | 76431400 | 76432600 | + | int | 3274 |
| 13 | 76645800 | 76647000 | + | Mctp1 | 3275 |
| 13 | 77099400 | 77100400 | + | Mctp1 | 3276 |
| 13 | 77937800 | 77939000 | + | Fam172a | 3277 |
| 13 | 78021400 | 78022400 | + | Fam172a | 3278 |
| 13 | 78096600 | 78097600 | + | Fam172a | 3279 |
| 13 | 78106800 | 78108000 | + | Fam172a | 3280 |
| 13 | 78170200 | 78171400 | + | Fam172a | 3281 |
| 13 | 78382800 | 78383800 | + | int | 3282 |
| 13 | 78941600 | 78942600 | + | int | 3283 |
| 13 | 79178400 | 79179800 | + | int | 3284 |
| 13 | 79201200 | 79202600 | + | int | 3285 |
| 13 | 79732000 | 79733000 | + | int | 3286 |
| 13 | 79743200 | 79744200 | + | int | 3287 |
| 13 | 79747800 | 79748800 | + | int | 3288 |
| 13 | 80068200 | 80070400 | + | int | 3289 |
| 13 | 80123000 | 80124200 | + | int | 3290 |
| 13 | 80246200 | 80247200 | + | int | 3291 |
| 13 | 81171800 | 81173200 | + | 9330111N05Rik | 3292 |
| 13 | 81206000 | 81207200 | + | 9330111N05Rik | 3293 |
| 13 | 81406200 | 81407200 | − | Gpr98 | 3294 |
| 13 | 81659400 | 81660600 | − | Gpr98 | 3295 |
| 13 | 82308200 | 82309400 | + | int | 3296 |
| 13 | 82501000 | 82502200 | + | int | 3297 |
| 13 | 82608200 | 82610200 | + | int | 3298 |
| 13 | 82836400 | 82837800 | + | int | 3299 |
| 13 | 83029400 | 83030400 | + | int | 3300 |
| 13 | 83654000 | 83655000 | + | Mef2c | 3301 |
| 13 | 83971800 | 83973000 | + | int | 3302 |
| 13 | 84305200 | 84306400 | + | int | 3303 |
| 13 | 84916400 | 84917600 | + | int | 3304 |
| 13 | 85006400 | 85007600 | + | int | 3305 |
| 13 | 85149200 | 85150200 | + | int | 3306 |
| 13 | 85760800 | 85761800 | + | int | 3307 |
| 13 | 86539400 | 86540400 | + | int | 3308 |
| 13 | 86544400 | 86545600 | + | int | 3309 |
| 13 | 86661000 | 86662000 | + | int | 3310 |
| 13 | 87544800 | 87546600 | + | int | 3311 |
| 13 | 87860600 | 87861800 | + | int | 3312 |
| 13 | 87920400 | 87921400 | + | int | 3313 |
| 13 | 88301400 | 88302600 | + | int | 3314 |
| 13 | 88315400 | 88316600 | + | int | 3315 |
| 13 | 88390600 | 88391600 | + | int | 3316 |
| 13 | 88400000 | 88401000 | + | int | 3317 |
| 13 | 88513600 | 88514600 | + | int | 3318 |
| 13 | 88761200 | 88762400 | + | int | 3319 |
| 13 | 89209400 | 89210600 | + | Edil3 | 3320 |
| 13 | 89603400 | 89604400 | + | int | 3321 |
| 13 | 89623600 | 89625200 | + | int | 3322 |
| 13 | 89753000 | 89754000 | + | int | 3323 |
| 13 | 89851200 | 89852400 | − | Vcan | 3324 |
| 13 | 89851200 | 89852400 | − | Vcan | 3325 |
| 13 | 89851200 | 89852400 | − | Vcan | 3326 |
| 13 | 90731800 | 90733200 | + | int | 3327 |
| 13 | 90851000 | 90852000 | + | int | 3328 |
| 13 | 91185000 | 91186200 | − | Atg10 | 3329 |
| 13 | 91241400 | 91242400 | − | Atg10 | 3330 |
| 13 | 91634400 | 91635400 | + | Ssbp2 | 3331 |
| 13 | 91766400 | 91769400 | + | Ssbp2 | 3332 |
| 13 | 92880600 | 92881600 | − | Rasgrf2 | 3333 |
| 13 | 93173800 | 93174800 | + | int | 3334 |
| 13 | 94394600 | 94395600 | − | Bhmt | 3335 |
| 13 | 94790800 | 94792000 | + | int | 3336 |
| 13 | 95371400 | 95372400 | + | int | 3337 |
| 13 | 95721400 | 95722800 | + | int | 3338 |
| 13 | 96853800 | 96855200 | − | Sv2c | 3339 |
| 13 | 98385400 | 98386400 | + | int | 3340 |
| 13 | 99050600 | 99051600 | + | int | 3341 |
| 13 | 100012400 | 100013400 | + | Zfp366 | 3342 |
| 13 | 100078200 | 100079600 | + | int | 3343 |
| 13 | 101033400 | 101034800 | + | int | 3344 |
| 13 | 101083200 | 101084400 | − | Naip6 | 3345 |
| 13 | 101083200 | 101084400 | − | Naip7 | 3346 |
| 13 | 101714000 | 101715400 | + | int | 3347 |
| 13 | 102178200 | 102179400 | + | int | 3348 |
| 13 | 102761200 | 102762200 | + | int | 3349 |
| 13 | 102812200 | 102813400 | + | int | 3350 |
| 13 | 102965000 | 102966000 | + | int | 3351 |
| 13 | 103027400 | 103028600 | + | int | 3352 |
| 13 | 103032800 | 103033800 | + | int | 3353 |
| 13 | 104190000 | 104191200 | + | int | 3354 |
| 13 | 104623800 | 104625000 | − | Erbb2ip | 3355 |
| 13 | 105081800 | 105083000 | + | Adamts6 | 3356 |
| 13 | 106039400 | 106040400 | − | Rnf180 | 3357 |
| 13 | 106448400 | 106449400 | + | int | 3358 |
| 13 | 107037400 | 107038600 | + | int | 3359 |
| 13 | 111534000 | 111535400 | + | int | 3360 |
| 13 | 111939200 | 111940200 | + | int | 3361 |
| 13 | 112678400 | 112679600 | + | int | 3362 |
| 13 | 112686200 | 112687200 | + | int | 3363 |
| 13 | 113524000 | 113525000 | + | Slc38a9 | 3364 |
| 13 | 114916600 | 114917600 | + | Arl15 | 3365 |
| 13 | 115458400 | 115459400 | + | int | 3366 |
| 13 | 116003200 | 116004400 | + | int | 3367 |
| 13 | 116097800 | 116098800 | + | int | 3368 |
| 13 | 116806400 | 116807400 | + | int | 3369 |
| 13 | 116887600 | 116888600 | + | int | 3370 |
| 13 | 117285400 | 117286600 | + | int | 3371 |
| 13 | 117304600 | 117305600 | + | int | 3372 |
| 13 | 117335200 | 117336200 | + | int | 3373 |
| 13 | 117418400 | 117419400 | + | int | 3374 |
| 13 | 117599600 | 117601200 | + | int | 3375 |
| 13 | 117932400 | 117933600 | + | int | 3376 |
| 13 | 118017600 | 118018600 | + | Emb | 3377 |
| 13 | 118305400 | 118306800 | + | int | 3378 |
| 13 | 119067400 | 119068400 | + | int | 3379 |
| 13 | 119402000 | 119403200 | + | int | 3380 |
| 13 | 119867600 | 119868600 | + | int | 3381 |
| 13 | 120260800 | 120261800 | + | 4833420G17Rik | 3382 |
| 14 | 3120400 | 3121400 | + | int | 3383 |
| 14 | 4285000 | 4286200 | + | int | 3384 |
| 14 | 5338600 | 5339800 | + | int | 3385 |
| 14 | 5377200 | 5378200 | + | int | 3386 |
| 14 | 6093600 | 6094600 | + | int | 3387 |
| 14 | 6169800 | 6171000 | + | int | 3388 |

TABLE 1-continued

| chromosome | start | stop | strand | nearest gene | ID |
|---|---|---|---|---|---|
| 14 | 7378400 | 7379400 | + | int | 3389 |
| 14 | 7820800 | 7821800 | + | int | 3390 |
| 14 | 8261600 | 8262800 | + | int | 3391 |
| 14 | 8490400 | 8491600 | + | int | 3392 |
| 14 | 9118400 | 9120200 | + | int | 3393 |
| 14 | 9124400 | 9125400 | + | int | 3394 |
| 14 | 10548400 | 10549400 | − | Fhit | 3395 |
| 14 | 11668200 | 11669200 | − | Fhit | 3396 |
| 14 | 12212000 | 12213000 | + | int | 3397 |
| 14 | 14458800 | 14460000 | + | int | 3398 |
| 14 | 14599200 | 14601000 | + | int | 3399 |
| 14 | 15022000 | 15023000 | + | int | 3400 |
| 14 | 15245600 | 15246800 | + | int | 3401 |
| 14 | 16190200 | 16191400 | − | Lrrc3b | 3402 |
| 14 | 16387600 | 16388600 | + | int | 3403 |
| 14 | 16433600 | 16434600 | + | int | 3404 |
| 14 | 16649400 | 16650400 | + | int | 3405 |
| 14 | 17739400 | 17740700 | + | int | 3406 |
| 14 | 19600000 | 19601600 | − | Ube2e2 | 3407 |
| 14 | 22819000 | 22820200 | + | int | 3408 |
| 14 | 22892600 | 22893800 | + | 1700112E06Rik | 3409 |
| 14 | 25568600 | 25569600 | + | int | 3410 |
| 14 | 28751600 | 28753000 | + | Erc2 | 3411 |
| 14 | 28774000 | 28775200 | + | Erc2 | 3412 |
| 14 | 29960600 | 29962200 | − | Cacna2d3 | 3413 |
| 14 | 32122300 | 32123300 | − | Dnahc1 | 3414 |
| 14 | 32134200 | 32135200 | − | Dnahc1 | 3415 |
| 14 | 33773200 | 33774200 | − | Wdfy4 | 3416 |
| 14 | 34378200 | 34379400 | + | int | 3417 |
| 14 | 35979600 | 35980600 | + | Grid1 | 3418 |
| 14 | 36831200 | 36832400 | + | int | 3419 |
| 14 | 37661800 | 37662800 | + | int | 3420 |
| 14 | 37683400 | 37685000 | + | int | 3421 |
| 14 | 37902600 | 37903600 | − | Cdhr1 | 3422 |
| 14 | 38389400 | 38390400 | + | int | 3423 |
| 14 | 38449000 | 38450000 | + | int | 3424 |
| 14 | 39302200 | 39303200 | − | Nrg3 | 3425 |
| 14 | 39909800 | 39910800 | − | Nrg3 | 3426 |
| 14 | 40501400 | 40502600 | + | int | 3427 |
| 14 | 40524600 | 40526200 | + | int | 3428 |
| 14 | 40670600 | 40671600 | + | int | 3429 |
| 14 | 40774400 | 40775800 | + | int | 3430 |
| 14 | 40903600 | 40904600 | + | int | 3431 |
| 14 | 40959200 | 40960200 | + | int | 3432 |
| 14 | 42962800 | 42964400 | + | int | 3433 |
| 14 | 43352600 | 43353600 | + | int | 3434 |
| 14 | 43928600 | 43929600 | + | int | 3435 |
| 14 | 43946800 | 43947800 | + | int | 3436 |
| 14 | 44074800 | 44075800 | + | int | 3437 |
| 14 | 44109000 | 44110600 | + | int | 3438 |
| 14 | 44745400 | 44746400 | − | 4930503E14Rik | 3439 |
| 14 | 45810800 | 45811800 | − | Txndc16 | 3440 |
| 14 | 46728000 | 46729800 | + | int | 3441 |
| 14 | 48396400 | 48397800 | + | int | 3442 |
| 14 | 48512600 | 48513600 | + | int | 3443 |
| 14 | 48641000 | 48642200 | + | int | 3444 |
| 14 | 48654600 | 48655600 | + | int | 3445 |
| 14 | 50314000 | 50315400 | − | 3632451O06Rik | 3446 |
| 14 | 50465200 | 50466400 | + | int | 3447 |
| 14 | 50693400 | 50695600 | + | int | 3448 |
| 14 | 51165200 | 51166200 | + | int | 3449 |
| 14 | 51618800 | 51619800 | + | int | 3450 |
| 14 | 53090800 | 53091800 | + | int | 3451 |
| 14 | 53605000 | 53606000 | + | int | 3452 |
| 14 | 53916200 | 53917800 | + | int | 3453 |
| 14 | 54028800 | 54029800 | + | int | 3454 |
| 14 | 54495600 | 54496600 | + | int | 3455 |
| 14 | 54554800 | 54556000 | + | int | 3456 |
| 14 | 54917800 | 54919200 | + | int | 3457 |
| 14 | 55668400 | 55669400 | + | int | 3458 |
| 14 | 56869200 | 56870200 | + | int | 3459 |
| 14 | 57068800 | 57069800 | + | Rnf17 | 3460 |
| 14 | 57897000 | 57898000 | + | Cryl1 | 3461 |
| 14 | 57899200 | 57900200 | + | Cryl1 | 3462 |
| 14 | 59704400 | 59705400 | + | int | 3463 |
| 14 | 61864600 | 61865600 | − | Sgcg | 3464 |
| 14 | 62008800 | 62009800 | − | Kpna3 | 3465 |
| 14 | 62540000 | 62541000 | + | int | 3466 |
| 14 | 62558800 | 62560200 | + | int | 3467 |
| 14 | 64421800 | 64423000 | + | Xkr6 | 3468 |
| 14 | 65658000 | 65659000 | + | Ints9 | 3469 |
| 14 | 66963400 | 66964400 | + | Stmn4 | 3470 |
| 14 | 69690800 | 69691800 | + | int | 3471 |
| 14 | 70162400 | 70163400 | + | int | 3472 |
| 14 | 71180200 | 71181600 | + | int | 3473 |
| 14 | 71804000 | 71805200 | + | int | 3474 |
| 14 | 71947800 | 71948800 | + | int | 3475 |
| 14 | 73127800 | 73129000 | + | int | 3476 |
| 14 | 73562000 | 73563200 | + | Rcbtb2 | 3477 |
| 14 | 73562000 | 73563200 | + | Rcbtb2 | 3478 |
| 14 | 79851600 | 79853000 | + | Gm5465 | 3479 |
| 14 | 80785600 | 80786600 | + | int | 3480 |
| 14 | 81186800 | 81188000 | + | int | 3481 |
| 14 | 81446000 | 81447200 | + | int | 3482 |
| 14 | 81526000 | 81527200 | + | int | 3483 |
| 14 | 81536000 | 81537000 | + | int | 3484 |
| 14 | 81952800 | 81954200 | + | int | 3485 |
| 14 | 82137000 | 82138000 | + | int | 3486 |
| 14 | 82298200 | 82299400 | + | int | 3487 |
| 14 | 82456800 | 82457800 | + | int | 3488 |
| 14 | 82643400 | 82644400 | + | int | 3489 |
| 14 | 82805800 | 82807200 | + | int | 3490 |
| 14 | 83027000 | 83028000 | + | int | 3491 |
| 14 | 83198400 | 83199400 | + | int | 3492 |
| 14 | 83295800 | 83296800 | + | int | 3493 |
| 14 | 83304200 | 83305200 | + | int | 3494 |
| 14 | 83441000 | 83442600 | + | int | 3495 |
| 14 | 83648200 | 83649200 | + | int | 3496 |
| 14 | 83683400 | 83684600 | + | int | 3497 |
| 14 | 83701800 | 83702800 | + | int | 3498 |
| 14 | 84033600 | 84034600 | + | int | 3499 |
| 14 | 84228000 | 84229600 | + | int | 3500 |
| 14 | 84300000 | 84301200 | + | int | 3501 |
| 14 | 84329400 | 84330400 | + | int | 3502 |
| 14 | 84357000 | 84358000 | + | int | 3503 |
| 14 | 84413200 | 84414600 | + | int | 3504 |
| 14 | 84426400 | 84428000 | + | int | 3505 |
| 14 | 84442400 | 84444000 | + | int | 3506 |
| 14 | 84532200 | 84533200 | + | int | 3507 |
| 14 | 84555800 | 84556800 | + | int | 3508 |
| 14 | 84601000 | 84602600 | + | int | 3509 |
| 14 | 84702400 | 84703600 | + | int | 3510 |
| 14 | 84761600 | 84763000 | + | int | 3511 |
| 14 | 85025200 | 85026600 | + | int | 3512 |
| 14 | 85058600 | 85060200 | + | int | 3513 |
| 14 | 85222000 | 85223400 | + | int | 3514 |
| 14 | 85878400 | 85879600 | + | int | 3515 |
| 14 | 86057800 | 86059000 | + | int | 3516 |
| 14 | 86149600 | 86150600 | + | int | 3517 |
| 14 | 86207000 | 86208200 | + | int | 3518 |
| 14 | 87291200 | 87292200 | − | Diap3 | 3519 |
| 14 | 87335800 | 87336800 | − | Diap3 | 3520 |
| 14 | 88211000 | 88212000 | + | int | 3521 |
| 14 | 88663000 | 88664000 | + | int | 3522 |
| 14 | 89573400 | 89574800 | + | int | 3523 |
| 14 | 89861000 | 89862000 | + | int | 3524 |
| 14 | 89957200 | 89958200 | + | int | 3525 |
| 14 | 90041400 | 90042800 | + | int | 3526 |
| 14 | 90109400 | 90110600 | + | int | 3527 |
| 14 | 90438600 | 90439600 | + | int | 3528 |
| 14 | 90674200 | 90675200 | + | int | 3529 |
| 14 | 90694400 | 90695600 | + | int | 3530 |
| 14 | 91157000 | 91158800 | + | int | 3531 |
| 14 | 91565200 | 91566600 | + | int | 3532 |
| 14 | 92009200 | 92010200 | + | int | 3533 |
| 14 | 92215800 | 92217000 | + | int | 3534 |
| 14 | 92439400 | 92440400 | + | int | 3535 |
| 14 | 92489200 | 92490200 | + | int | 3536 |
| 14 | 94033800 | 94035000 | − | Pcdh9 | 3537 |
| 14 | 94240000 | 94241000 | − | Pcdh9 | 3538 |
| 14 | 94264600 | 94266400 | − | Pcdh9 | 3539 |
| 14 | 94756400 | 94757600 | + | int | 3540 |
| 14 | 94809000 | 94810400 | + | int | 3541 |
| 14 | 94813400 | 94814400 | + | int | 3542 |

TABLE 1-continued

| chromosome | start | stop | strand | nearest gene | ID |
|---|---|---|---|---|---|
| 14 | 95263400 | 95264400 | + | int | 3543 |
| 14 | 95504400 | 95505400 | + | int | 3544 |
| 14 | 96336000 | 96337000 | + | int | 3545 |
| 14 | 96347400 | 96348400 | + | int | 3546 |
| 14 | 96553000 | 96554200 | − | Klhl1 | 3547 |
| 14 | 97006000 | 97007000 | + | int | 3548 |
| 14 | 97099200 | 97100400 | + | int | 3549 |
| 14 | 97514200 | 97515200 | + | int | 3550 |
| 14 | 97591600 | 97593200 | + | int | 3551 |
| 14 | 97894000 | 97895400 | + | int | 3552 |
| 14 | 98609400 | 98610400 | + | int | 3553 |
| 14 | 98942000 | 98943000 | + | int | 3554 |
| 14 | 99548400 | 99549400 | + | Pibf1 | 3555 |
| 14 | 99548400 | 99549400 | + | Pibf1 | 3556 |
| 14 | 99962400 | 99963400 | + | int | 3557 |
| 14 | 100273200 | 100274400 | − | Klf12 | 3558 |
| 14 | 101003000 | 101004000 | + | int | 3559 |
| 14 | 102856400 | 102857400 | + | int | 3560 |
| 14 | 103041400 | 103042800 | + | int | 3561 |
| 14 | 103283600 | 103284600 | + | int | 3562 |
| 14 | 103303200 | 103304600 | + | int | 3563 |
| 14 | 103501400 | 103502400 | − | Fbxl3 | 3564 |
| 14 | 103813400 | 103814400 | + | int | 3565 |
| 14 | 104688000 | 104689000 | + | int | 3566 |
| 14 | 104721200 | 104722400 | + | int | 3567 |
| 14 | 105098400 | 105099600 | + | D130009I18Rik | 3568 |
| 14 | 106492600 | 106493600 | + | int | 3569 |
| 14 | 106516800 | 106518400 | + | int | 3570 |
| 14 | 106807000 | 106808000 | + | int | 3571 |
| 14 | 106963000 | 106964400 | + | int | 3572 |
| 14 | 107129200 | 107130800 | + | int | 3573 |
| 14 | 107303800 | 107304800 | + | int | 3574 |
| 14 | 107539400 | 107540400 | + | int | 3575 |
| 14 | 107786600 | 107788200 | + | int | 3576 |
| 14 | 107825800 | 107827400 | + | int | 3577 |
| 14 | 107892000 | 107893200 | + | int | 3578 |
| 14 | 108258000 | 108259000 | + | int | 3579 |
| 14 | 108485600 | 108486600 | + | int | 3580 |
| 14 | 108845600 | 108846600 | + | int | 3581 |
| 14 | 109550800 | 109552200 | + | int | 3582 |
| 14 | 109921600 | 109922600 | + | int | 3583 |
| 14 | 110198000 | 110199000 | + | int | 3584 |
| 14 | 110928000 | 110929000 | + | int | 3585 |
| 14 | 111221200 | 111222400 | + | int | 3586 |
| 14 | 111345600 | 111347200 | + | int | 3587 |
| 14 | 111582600 | 111584000 | + | int | 3588 |
| 14 | 112073200 | 112074400 | + | Slitrk5 | 3589 |
| 14 | 112480200 | 112481200 | + | int | 3590 |
| 14 | 113105800 | 113107600 | + | int | 3591 |
| 14 | 113395000 | 113396200 | + | int | 3592 |
| 14 | 114171400 | 114173200 | + | int | 3593 |
| 14 | 114580600 | 114581800 | + | int | 3594 |
| 14 | 115040600 | 115042000 | + | int | 3595 |
| 14 | 115222800 | 115224200 | + | int | 3596 |
| 14 | 115693600 | 115695000 | + | Gpc5 | 3597 |
| 14 | 116083600 | 116084600 | + | Gpc5 | 3598 |
| 14 | 116305600 | 116306600 | + | Gpc5 | 3599 |
| 14 | 116913800 | 116914800 | + | Gpc5 | 3600 |
| 14 | 116941200 | 116942200 | + | int | 3601 |
| 14 | 117140200 | 117141600 | + | int | 3602 |
| 14 | 117203800 | 117205000 | + | int | 3603 |
| 14 | 117213200 | 117214400 | + | int | 3604 |
| 14 | 118655000 | 118656000 | + | Abcc4 | 3605 |
| 14 | 118959000 | 118960000 | − | Abcc4 | 3606 |
| 14 | 118959000 | 118960000 | − | Abcc4 | 3607 |
| 14 | 119430200 | 119431200 | − | Uggt2 | 3608 |
| 14 | 119630000 | 119631000 | + | Hs6st3 | 3609 |
| 14 | 119695200 | 119696200 | + | Hs6st3 | 3610 |
| 14 | 120228000 | 120229000 | + | Hs6st3 | 3611 |
| 14 | 120385600 | 120386600 | + | int | 3612 |
| 14 | 120968800 | 120969800 | + | int | 3613 |
| 14 | 121111800 | 121112700 | + | int | 3614 |
| 14 | 122576000 | 122577200 | + | int | 3615 |
| 14 | 123027200 | 123028400 | + | Pcca | 3616 |
| 14 | 123560000 | 123561000 | + | int | 3617 |
| 14 | 123879600 | 123880600 | − | Nalcn | 3618 |
| 15 | 3894400 | 3895600 | + | int | 3619 |
| 15 | 6677600 | 6678600 | + | Rictor | 3620 |
| 15 | 6755200 | 6756200 | + | int | 3621 |
| 15 | 8118400 | 8119400 | + | 2410089E03Rik | 3622 |
| 15 | 9130000 | 9131000 | + | int | 3623 |
| 15 | 9669000 | 9670000 | − | Spef2 | 3624 |
| 15 | 11142600 | 11144200 | + | Adamts12 | 3625 |
| 15 | 13450000 | 13451200 | + | int | 3626 |
| 15 | 13512600 | 13513800 | + | int | 3627 |
| 15 | 13615600 | 13616800 | + | int | 3628 |
| 15 | 14181400 | 14182400 | + | int | 3629 |
| 15 | 14248200 | 14249200 | + | int | 3630 |
| 15 | 14548800 | 14549800 | + | int | 3631 |
| 15 | 14785600 | 14786600 | + | int | 3632 |
| 15 | 14855800 | 14857600 | + | int | 3633 |
| 15 | 14918000 | 14919200 | + | int | 3634 |
| 15 | 15064800 | 15065800 | + | int | 3635 |
| 15 | 15363400 | 15365000 | + | int | 3636 |
| 15 | 15656800 | 15658200 | + | int | 3637 |
| 15 | 15804800 | 15806200 | + | int | 3638 |
| 15 | 16123600 | 16124800 | + | int | 3639 |
| 15 | 16191600 | 16193000 | + | int | 3640 |
| 15 | 16552000 | 16553200 | + | int | 3641 |
| 15 | 16588200 | 16589400 | + | int | 3642 |
| 15 | 16634400 | 16636000 | + | int | 3643 |
| 15 | 16736000 | 16737000 | + | Cdh9 | 3644 |
| 15 | 16816200 | 16817200 | + | int | 3645 |
| 15 | 17426800 | 17427800 | + | int | 3646 |
| 15 | 17875000 | 17876000 | + | int | 3647 |
| 15 | 17884600 | 17886000 | + | int | 3648 |
| 15 | 17909400 | 17910800 | + | int | 3649 |
| 15 | 19275200 | 19276200 | + | int | 3650 |
| 15 | 19457600 | 19458800 | + | int | 3651 |
| 15 | 19515200 | 19516200 | + | int | 3652 |
| 15 | 19541000 | 19542000 | + | int | 3653 |
| 15 | 19715400 | 19716600 | + | int | 3654 |
| 15 | 19768000 | 19769000 | + | int | 3655 |
| 15 | 19849200 | 19850600 | + | int | 3656 |
| 15 | 20131400 | 20132600 | + | int | 3657 |
| 15 | 20298400 | 20300200 | + | int | 3658 |
| 15 | 20365600 | 20366600 | + | int | 3659 |
| 15 | 20452000 | 20453000 | + | int | 3660 |
| 15 | 20578000 | 20579000 | + | int | 3661 |
| 15 | 20740200 | 20741200 | + | int | 3662 |
| 15 | 21491600 | 21493200 | + | Cdh12 | 3663 |
| 15 | 21558400 | 21559400 | + | int | 3664 |
| 15 | 21607600 | 21608600 | + | int | 3665 |
| 15 | 21627400 | 21628400 | + | int | 3666 |
| 15 | 21655400 | 21656800 | + | int | 3667 |
| 15 | 21929400 | 21930400 | + | int | 3668 |
| 15 | 22380800 | 22381800 | + | int | 3669 |
| 15 | 22487600 | 22488600 | + | int | 3670 |
| 15 | 22543200 | 22544400 | + | int | 3671 |
| 15 | 22630200 | 22631600 | + | int | 3672 |
| 15 | 22633400 | 22635000 | + | int | 3673 |
| 15 | 22705400 | 22706600 | + | int | 3674 |
| 15 | 23066600 | 23067600 | + | Cdh18 | 3675 |
| 15 | 23286200 | 23287200 | + | Cdh18 | 3676 |
| 15 | 23437800 | 23438800 | + | int | 3677 |
| 15 | 23792200 | 23793200 | + | int | 3678 |
| 15 | 23928200 | 23929400 | + | int | 3679 |
| 15 | 23968400 | 23969600 | + | int | 3680 |
| 15 | 24119600 | 24120800 | + | int | 3681 |
| 15 | 24363400 | 24364400 | + | int | 3682 |
| 15 | 24561400 | 24562600 | + | int | 3683 |
| 15 | 24823200 | 24824200 | + | int | 3684 |
| 15 | 24922600 | 24923600 | + | int | 3685 |
| 15 | 25174800 | 25176200 | + | int | 3686 |
| 15 | 26658400 | 26659600 | − | Fbxl7 | 3687 |
| 15 | 27127200 | 27128400 | + | int | 3688 |
| 15 | 28481400 | 28483000 | + | int | 3689 |
| 15 | 28618400 | 28619400 | + | int | 3690 |
| 15 | 28853400 | 28854800 | + | int | 3691 |
| 15 | 28880200 | 28881400 | + | int | 3692 |
| 15 | 29101200 | 29102200 | + | int | 3693 |
| 15 | 30016400 | 30018200 | + | int | 3694 |
| 15 | 30879200 | 30880400 | + | Ctnnd2 | 3695 |
| 15 | 32152200 | 32153400 | + | int | 3696 |

TABLE 1-continued

| chromosome | start | stop | strand | nearest gene | ID |
|---|---|---|---|---|---|
| 15 | 32743600 | 32744600 | + | int | 3697 |
| 15 | 33305800 | 33306800 | + | Pgcp | 3698 |
| 15 | 33423000 | 33424000 | + | Pgcp | 3699 |
| 15 | 33461800 | 33462800 | + | Pgcp | 3700 |
| 15 | 35119000 | 35120000 | + | int | 3701 |
| 15 | 35668600 | 35669800 | + | Vps13b | 3702 |
| 15 | 37207000 | 37208000 | + | Grhl2 | 3703 |
| 15 | 39268400 | 39269800 | + | Rims2 | 3704 |
| 15 | 39279800 | 39281200 | + | Rims2 | 3705 |
| 15 | 40339200 | 40340200 | + | int | 3706 |
| 15 | 40603400 | 40604400 | + | Zfpm2 | 3707 |
| 15 | 40695200 | 40696400 | + | Zfpm2 | 3708 |
| 15 | 41232400 | 41233400 | + | int | 3709 |
| 15 | 41834800 | 41836000 | + | int | 3710 |
| 15 | 43404000 | 43405600 | + | int | 3711 |
| 15 | 43561000 | 43562000 | + | int | 3712 |
| 15 | 43744000 | 43745200 | + | int | 3713 |
| 15 | 43850700 | 43851400 | + | int | 3714 |
| 15 | 44177600 | 44178800 | + | int | 3715 |
| 15 | 44411200 | 44412200 | + | Pkhd1l1 | 3716 |
| 15 | 44561600 | 44562600 | − | Sybu | 3717 |
| 15 | 44561600 | 44562600 | − | Sybu | 3718 |
| 15 | 45062600 | 45063600 | + | int | 3719 |
| 15 | 45093000 | 45094200 | + | int | 3720 |
| 15 | 45182800 | 45184000 | + | int | 3721 |
| 15 | 45311600 | 45312600 | + | int | 3722 |
| 15 | 45364000 | 45365200 | + | int | 3723 |
| 15 | 45786800 | 45787800 | + | int | 3724 |
| 15 | 45810400 | 45811800 | + | int | 3725 |
| 15 | 45851200 | 45852600 | + | int | 3726 |
| 15 | 45857400 | 45858600 | + | int | 3727 |
| 15 | 46060800 | 46061800 | + | int | 3728 |
| 15 | 46100200 | 46101200 | + | int | 3729 |
| 15 | 46111600 | 46112600 | + | int | 3730 |
| 15 | 46274600 | 46275600 | + | int | 3731 |
| 15 | 46295600 | 46296800 | + | int | 3732 |
| 15 | 46390600 | 46391600 | + | int | 3733 |
| 15 | 46482400 | 46483400 | + | int | 3734 |
| 15 | 46498200 | 46499200 | + | int | 3735 |
| 15 | 46572600 | 46573600 | + | int | 3736 |
| 15 | 46770400 | 46771600 | + | int | 3737 |
| 15 | 46833000 | 46834000 | + | int | 3738 |
| 15 | 46931800 | 46932800 | + | int | 3739 |
| 15 | 47020600 | 47022000 | + | int | 3740 |
| 15 | 47293400 | 47294600 | + | int | 3741 |
| 15 | 47948800 | 47950200 | − | Csmd3 | 3742 |
| 15 | 47972600 | 47973800 | − | Csmd3 | 3743 |
| 15 | 48159800 | 48161000 | − | Csmd3 | 3744 |
| 15 | 48454800 | 48455800 | − | Csmd3 | 3745 |
| 15 | 49030000 | 49031200 | + | int | 3746 |
| 15 | 49121000 | 49122000 | + | int | 3747 |
| 15 | 49161200 | 49162600 | + | int | 3748 |
| 15 | 49163800 | 49165000 | + | int | 3749 |
| 15 | 49184400 | 49186000 | + | int | 3750 |
| 15 | 49456000 | 49457000 | + | int | 3751 |
| 15 | 49888000 | 49889200 | + | int | 3752 |
| 15 | 50166800 | 50168000 | + | int | 3753 |
| 15 | 50653400 | 50654400 | − | Trps1 | 3754 |
| 15 | 50677400 | 50678800 | − | Trps1 | 3755 |
| 15 | 50820600 | 50821800 | + | int | 3756 |
| 15 | 50924000 | 50925200 | + | int | 3757 |
| 15 | 52437000 | 52438200 | + | int | 3758 |
| 15 | 53396600 | 53397800 | − | Samd12 | 3759 |
| 15 | 53766600 | 53767600 | + | int | 3760 |
| 15 | 54603800 | 54604800 | + | int | 3761 |
| 15 | 54633400 | 54634600 | + | int | 3762 |
| 15 | 55930200 | 55931200 | + | int | 3763 |
| 15 | 56235600 | 56236600 | + | int | 3764 |
| 15 | 56246000 | 56247200 | + | int | 3765 |
| 15 | 56271000 | 56272200 | + | int | 3766 |
| 15 | 56371000 | 56372000 | + | int | 3767 |
| 15 | 56385600 | 56386600 | + | int | 3768 |
| 15 | 56732400 | 56733400 | + | int | 3769 |
| 15 | 57135600 | 57136800 | − | BC026439 | 3770 |
| 15 | 58153800 | 58154800 | − | Klhl38 | 3771 |
| 15 | 58358000 | 58359400 | + | int | 3772 |
| 15 | 61946000 | 61947000 | + | Pvt1 | 3773 |
| 15 | 62437000 | 62438000 | + | int | 3774 |
| 15 | 62448800 | 62450000 | + | int | 3775 |
| 15 | 63736000 | 63737000 | − | Gsdmc4 | 3776 |
| 15 | 65262000 | 65263400 | + | int | 3777 |
| 15 | 66405800 | 66406800 | + | Phf20l1 | 3778 |
| 15 | 67739000 | 67740000 | + | int | 3779 |
| 15 | 67863400 | 67864400 | + | int | 3780 |
| 15 | 68566400 | 68567400 | + | int | 3781 |
| 15 | 69325000 | 69326200 | + | int | 3782 |
| 15 | 69454200 | 69455400 | + | int | 3783 |
| 15 | 69574000 | 69575000 | + | int | 3784 |
| 15 | 69872200 | 69873200 | + | int | 3785 |
| 15 | 69908400 | 69909600 | + | int | 3786 |
| 15 | 73370400 | 73371400 | + | Dennd3 | 3787 |
| 15 | 74293200 | 74294200 | + | int | 3788 |
| 15 | 74916400 | 74918000 | + | int | 3789 |
| 15 | 75156600 | 75157800 | + | int | 3790 |
| 15 | 80068800 | 80070000 | + | Smcr7l | 3791 |
| 15 | 81519800 | 81520800 | − | Chadl | 3792 |
| 15 | 81802800 | 81803800 | + | int | 3793 |
| 15 | 82383200 | 82384200 | + | Cyp2d12 | 3794 |
| 15 | 82490400 | 82492000 | + | int | 3795 |
| 15 | 83481400 | 83482400 | − | Scube1 | 3796 |
| 15 | 84042200 | 84043200 | + | Samm50 | 3797 |
| 15 | 84236200 | 84237200 | − | 1810041L15Rik | 3798 |
| 15 | 85114200 | 85115400 | + | Fbln1 | 3799 |
| 15 | 85565400 | 85566400 | + | Ppara | 3800 |
| 15 | 85565400 | 85566400 | + | Ppara | 3801 |
| 15 | 85816400 | 85817600 | − | Celsr1 | 3802 |
| 15 | 86024600 | 86026200 | + | int | 3803 |
| 15 | 86457200 | 86458600 | + | int | 3804 |
| 15 | 87299800 | 87301000 | + | int | 3805 |
| 15 | 87793400 | 87794400 | + | int | 3806 |
| 15 | 87976200 | 87977200 | + | int | 3807 |
| 15 | 90410400 | 90411400 | − | Cpne8 | 3808 |
| 15 | 91359200 | 91360200 | − | Slc2a13 | 3809 |
| 15 | 91550400 | 91551400 | + | Lrrk2 | 3810 |
| 15 | 91553400 | 91554400 | + | Lrrk2 | 3811 |
| 15 | 95381200 | 95382200 | + | int | 3812 |
| 15 | 95697800 | 95698800 | + | Ano6 | 3813 |
| 15 | 97567200 | 97568200 | + | int | 3814 |
| 15 | 98692800 | 98693800 | − | Mll2 | 3815 |
| 15 | 99565400 | 99567200 | − | Lass5 | 3816 |
| 15 | 100231200 | 100232400 | − | Slc11a2 | 3817 |
| 15 | 100231200 | 100232400 | − | Slc11a2 | 3818 |
| 15 | 100660600 | 100661600 | + | int | 3819 |
| 15 | 101465200 | 101466200 | − | Krt85 | 3820 |
| 15 | 102743200 | 102744200 | + | int | 3821 |
| 15 | 103276000 | 103277200 | − | BC048502 | 3822 |
| 16 | 3258800 | 3260000 | + | int | 3823 |
| 16 | 4154800 | 4155800 | − | Crebbp | 3824 |
| 16 | 4278200 | 4279400 | + | int | 3825 |
| 16 | 5667800 | 5668800 | + | int | 3826 |
| 16 | 7606200 | 7607800 | + | int | 3827 |
| 16 | 7910000 | 7911200 | + | int | 3828 |
| 16 | 9222000 | 9223600 | + | int | 3829 |
| 16 | 11143200 | 11145000 | − | Zc3h7a | 3830 |
| 16 | 11422200 | 11423400 | + | Snx29 | 3831 |
| 16 | 12730000 | 12731000 | + | int | 3832 |
| 16 | 13216200 | 13217400 | + | int | 3833 |
| 16 | 14261000 | 14262200 | − | Myh11 | 3834 |
| 16 | 14605200 | 14606400 | + | A630010A05Rik | 3835 |
| 16 | 14633000 | 14634400 | + | int | 3836 |
| 16 | 15118000 | 15119000 | + | int | 3837 |
| 16 | 15141200 | 15142200 | + | int | 3838 |
| 16 | 16189600 | 16190800 | + | int | 3839 |
| 16 | 16441400 | 16442400 | − | Fgd4 | 3840 |
| 16 | 16441400 | 16442400 | − | Fgd4 | 3841 |
| 16 | 19690000 | 19691200 | − | Lamp3 | 3842 |
| 16 | 22734200 | 22735200 | + | int | 3843 |
| 16 | 22736600 | 22737600 | + | int | 3844 |
| 16 | 23191200 | 23192600 | + | int | 3845 |
| 16 | 23872600 | 23874000 | + | int | 3846 |
| 16 | 25479800 | 25481400 | + | int | 3847 |
| 16 | 25892400 | 25894000 | + | int | 3848 |
| 16 | 26450200 | 26451200 | + | int | 3849 |
| 16 | 27017200 | 27018200 | + | int | 3850 |

TABLE 1-continued

| chromosome | start | stop | strand | nearest gene | ID |
|---|---|---|---|---|---|
| 16 | 27301800 | 27302800 | + | int | 3851 |
| 16 | 28126400 | 28127400 | + | int | 3852 |
| 16 | 29485200 | 29486400 | − | Atp13a4 | 3853 |
| 16 | 29485200 | 29486400 | − | Atp13a4 | 3854 |
| 16 | 31719200 | 31720400 | + | Dlg1 | 3855 |
| 16 | 31725000 | 31726000 | + | Dlg1 | 3856 |
| 16 | 32535600 | 32536600 | + | int | 3857 |
| 16 | 37156800 | 37157800 | − | Stxbp5l | 3858 |
| 16 | 37384600 | 37385800 | − | Stxbp5l | 3859 |
| 16 | 38496600 | 38497800 | + | int | 3860 |
| 16 | 39742200 | 39743200 | + | int | 3861 |
| 16 | 40202200 | 40203400 | + | int | 3862 |
| 16 | 40218600 | 40220200 | + | int | 3863 |
| 16 | 40256600 | 40257600 | + | int | 3864 |
| 16 | 41168200 | 41169200 | + | int | 3865 |
| 16 | 41306800 | 41308000 | + | int | 3866 |
| 16 | 41848800 | 41849800 | + | Lsamp | 3867 |
| 16 | 42038600 | 42040000 | + | Lsamp | 3868 |
| 16 | 42907200 | 42908200 | + | int | 3869 |
| 16 | 44832600 | 44834000 | + | Cd200r4 | 3870 |
| 16 | 45188600 | 45189600 | + | Atg3 | 3871 |
| 16 | 46584600 | 46585600 | + | int | 3872 |
| 16 | 47108200 | 47109200 | + | int | 3873 |
| 16 | 47119600 | 47120800 | + | int | 3874 |
| 16 | 47187400 | 47188800 | + | int | 3875 |
| 16 | 47432200 | 47433200 | + | int | 3876 |
| 16 | 48783400 | 48784400 | + | int | 3877 |
| 16 | 48835200 | 48836200 | + | int | 3878 |
| 16 | 49544200 | 49545200 | + | int | 3879 |
| 16 | 51792800 | 51794000 | + | int | 3880 |
| 16 | 53009200 | 53010400 | + | int | 3881 |
| 16 | 53064000 | 53065000 | + | int | 3882 |
| 16 | 53176600 | 53177800 | + | int | 3883 |
| 16 | 53253600 | 53254800 | + | int | 3884 |
| 16 | 53476800 | 53477800 | + | int | 3885 |
| 16 | 53694200 | 53695600 | + | int | 3886 |
| 16 | 53805000 | 53806200 | + | int | 3887 |
| 16 | 54239200 | 54240600 | + | int | 3888 |
| 16 | 54337200 | 54338400 | + | int | 3889 |
| 16 | 54464400 | 54465800 | + | int | 3890 |
| 16 | 54549000 | 54550200 | + | int | 3891 |
| 16 | 54590000 | 54591000 | + | int | 3892 |
| 16 | 55008000 | 55009000 | + | int | 3893 |
| 16 | 56489800 | 56490800 | + | Abi3bp | 3894 |
| 16 | 56690200 | 56691600 | + | Abi3bp | 3895 |
| 16 | 56690200 | 56691600 | − | Tfg | 3896 |
| 16 | 56981600 | 56982600 | + | int | 3897 |
| 16 | 57390800 | 57392600 | + | Filip1l | 3898 |
| 16 | 57390800 | 57392600 | − | 2610528E23Rik | 3899 |
| 16 | 57768400 | 57769600 | + | int | 3900 |
| 16 | 59170200 | 59171400 | − | Olfr196 | 3901 |
| 16 | 59427600 | 59428600 | + | Gabrr3 | 3902 |
| 16 | 59793200 | 59794200 | − | Epha6 | 3903 |
| 16 | 60571000 | 60572200 | − | Epha6 | 3904 |
| 16 | 61020000 | 61021000 | + | int | 3905 |
| 16 | 61066200 | 61067400 | + | int | 3906 |
| 16 | 61144200 | 61145600 | + | int | 3907 |
| 16 | 61178200 | 61179400 | + | int | 3908 |
| 16 | 61193600 | 61195400 | + | int | 3909 |
| 16 | 61429000 | 61430000 | + | int | 3910 |
| 16 | 62077600 | 62078600 | + | int | 3911 |
| 16 | 62097200 | 62098200 | + | int | 3912 |
| 16 | 62483200 | 62484400 | + | int | 3913 |
| 16 | 63099200 | 63100400 | + | int | 3914 |
| 16 | 63169400 | 63170800 | + | int | 3915 |
| 16 | 63290800 | 63292200 | + | int | 3916 |
| 16 | 63531800 | 63532800 | + | int | 3917 |
| 16 | 64460600 | 64461800 | + | int | 3918 |
| 16 | 64473200 | 64474200 | + | int | 3919 |
| 16 | 65253200 | 65254600 | + | int | 3920 |
| 16 | 65404600 | 65405600 | + | int | 3921 |
| 16 | 65935600 | 65937200 | + | int | 3922 |
| 16 | 65945000 | 65946000 | + | int | 3923 |
| 16 | 66017200 | 66018200 | + | int | 3924 |
| 16 | 66201200 | 66202200 | + | int | 3925 |
| 16 | 66286600 | 66287600 | + | int | 3926 |
| 16 | 66369600 | 66371200 | + | int | 3927 |
| 16 | 66560200 | 66561400 | + | int | 3928 |
| 16 | 66806000 | 66807000 | − | Cadm2 | 3929 |
| 16 | 66827600 | 66828800 | − | Cadm2 | 3930 |
| 16 | 67844400 | 67845800 | + | int | 3931 |
| 16 | 67989800 | 67991200 | + | int | 3932 |
| 16 | 67994200 | 67995200 | + | int | 3933 |
| 16 | 67996400 | 67997800 | + | int | 3934 |
| 16 | 68164200 | 68165800 | + | int | 3935 |
| 16 | 68524200 | 68525200 | + | int | 3936 |
| 16 | 68755800 | 68756800 | + | int | 3937 |
| 16 | 69068600 | 69069600 | + | int | 3938 |
| 16 | 69257600 | 69259000 | + | int | 3939 |
| 16 | 69285200 | 69286600 | + | int | 3940 |
| 16 | 69863600 | 69864800 | − | Speer2 | 3941 |
| 16 | 69877600 | 69879000 | + | int | 3942 |
| 16 | 69954600 | 69955600 | + | int | 3943 |
| 16 | 70135400 | 70136800 | + | int | 3944 |
| 16 | 70200600 | 70202000 | + | int | 3945 |
| 16 | 70390400 | 70391400 | + | Gbe1 | 3946 |
| 16 | 70953600 | 70954600 | + | int | 3947 |
| 16 | 71135200 | 71136200 | + | int | 3948 |
| 16 | 71424000 | 71425000 | + | int | 3949 |
| 16 | 71516400 | 71517400 | + | int | 3950 |
| 16 | 71561400 | 71562800 | + | int | 3951 |
| 16 | 71564000 | 71565000 | + | int | 3952 |
| 16 | 72523200 | 72524600 | + | int | 3953 |
| 16 | 72612200 | 72613400 | + | int | 3954 |
| 16 | 74019000 | 74020000 | − | Robo2 | 3955 |
| 16 | 74307000 | 74308200 | − | Robo2 | 3956 |
| 16 | 74526200 | 74527600 | + | int | 3957 |
| 16 | 74922400 | 74923400 | + | int | 3958 |
| 16 | 75134000 | 75135600 | + | int | 3959 |
| 16 | 75368400 | 75369600 | + | int | 3960 |
| 16 | 75978000 | 75979000 | + | int | 3961 |
| 16 | 76585000 | 76586400 | + | int | 3962 |
| 16 | 77847000 | 77848000 | + | int | 3963 |
| 16 | 78075400 | 78076400 | + | int | 3964 |
| 16 | 79144600 | 79146200 | + | int | 3965 |
| 16 | 79824600 | 79825800 | + | int | 3966 |
| 16 | 79917800 | 79918800 | + | int | 3967 |
| 16 | 80116200 | 80117200 | + | int | 3968 |
| 16 | 80169600 | 80170600 | + | int | 3969 |
| 16 | 80397200 | 80398400 | + | int | 3970 |
| 16 | 80956000 | 80957000 | + | int | 3971 |
| 16 | 81151600 | 81152600 | + | int | 3972 |
| 16 | 81202400 | 81203400 | + | Ncam2 | 3973 |
| 16 | 81202400 | 81203400 | + | Ncam2 | 3974 |
| 16 | 81216400 | 81217400 | + | Ncam2 | 3975 |
| 16 | 81216400 | 81217400 | + | Ncam2 | 3976 |
| 16 | 81350200 | 81351200 | + | Ncam2 | 3977 |
| 16 | 81350200 | 81351200 | + | Ncam2 | 3978 |
| 16 | 81592600 | 81593600 | + | Ncam2 | 3979 |
| 16 | 81592600 | 81593600 | + | Ncam2 | 3980 |
| 16 | 81756800 | 81757800 | + | int | 3981 |
| 16 | 81916800 | 81918200 | + | int | 3982 |
| 16 | 81919400 | 81920800 | + | int | 3983 |
| 16 | 82075800 | 82077600 | + | int | 3984 |
| 16 | 82289200 | 82290200 | + | int | 3985 |
| 16 | 82441400 | 82442600 | + | int | 3986 |
| 16 | 82582400 | 82584000 | + | int | 3987 |
| 16 | 82596200 | 82597600 | + | int | 3988 |
| 16 | 82600400 | 82601600 | + | int | 3989 |
| 16 | 82645200 | 82646200 | + | int | 3990 |
| 16 | 82803000 | 82804400 | + | int | 3991 |
| 16 | 82839400 | 82840600 | + | int | 3992 |
| 16 | 83353800 | 83354800 | + | int | 3993 |
| 16 | 83521800 | 83523000 | + | int | 3994 |
| 16 | 83689200 | 83690200 | + | int | 3995 |
| 16 | 83701200 | 83702400 | + | int | 3996 |
| 16 | 83983800 | 83985000 | + | int | 3997 |
| 16 | 86178000 | 86179800 | + | int | 3998 |
| 16 | 86481000 | 86482000 | + | int | 3999 |
| 16 | 88283600 | 88284800 | − | Grik1 | 4000 |
| 16 | 89278400 | 89279400 | + | int | 4001 |
| 16 | 89631800 | 89632800 | + | int | 4002 |
| 16 | 89837000 | 89838200 | − | Tiam1 | 4003 |
| 16 | 89837000 | 89838200 | − | Tiam1 | 4004 |

TABLE 1-continued

| chromosome | start | stop | strand | nearest gene | ID |
|---|---|---|---|---|---|
| 16 | 90354400 | 90355400 | + | int | 4005 |
| 16 | 90468600 | 90469600 | + | Hunk | 4006 |
| 16 | 91003000 | 91004200 | − | Synj1 | 4007 |
| 16 | 91003000 | 91004200 | − | Synj1 | 4008 |
| 16 | 92979600 | 92980400 | + | int | 4009 |
| 16 | 93363800 | 93364800 | + | int | 4010 |
| 16 | 93623600 | 93624600 | + | int | 4011 |
| 16 | 93725800 | 93727200 | + | Dopey2 | 4012 |
| 16 | 93725800 | 93727200 | + | Dopey2 | 4013 |
| 16 | 94071400 | 94072400 | + | int | 4014 |
| 17 | 3076800 | 3078400 | − | Pisd-ps2 | 4015 |
| 17 | 3081800 | 3083000 | − | Pisd-ps2 | 4016 |
| 17 | 3267800 | 3269000 | + | int | 4017 |
| 17 | 4573200 | 4574400 | + | int | 4018 |
| 17 | 5232200 | 5233200 | + | Arid1b | 4019 |
| 17 | 5777000 | 5778000 | + | int | 4020 |
| 17 | 6300200 | 6301200 | + | Tmem181a | 4021 |
| 17 | 6333600 | 6335200 | + | int | 4022 |
| 17 | 6449400 | 6450600 | − | Tmem181b-ps | 4023 |
| 17 | 6515400 | 6516400 | + | int | 4024 |
| 17 | 6574000 | 6575200 | + | int | 4025 |
| 17 | 6677800 | 6678800 | + | int | 4026 |
| 17 | 6780000 | 6781400 | + | int | 4027 |
| 17 | 6883000 | 6884000 | + | Sytl3 | 4028 |
| 17 | 6911000 | 6912600 | + | Sytl3 | 4029 |
| 17 | 6911000 | 6912600 | + | Sytl3 | 4030 |
| 17 | 6911000 | 6912600 | + | Sytl3 | 4031 |
| 17 | 7093800 | 7094800 | + | int | 4032 |
| 17 | 7571000 | 7572000 | − | Gm9992 | 4033 |
| 17 | 7613000 | 7614600 | + | int | 4034 |
| 17 | 8761800 | 8762800 | + | int | 4035 |
| 17 | 10103200 | 10104200 | + | int | 4036 |
| 17 | 10501400 | 10503000 | − | Qk | 4037 |
| 17 | 10501400 | 10503000 | − | Qk | 4038 |
| 17 | 11493800 | 11494800 | + | Park2 | 4039 |
| 17 | 13244800 | 13246000 | − | Gpr31c | 4040 |
| 17 | 13291000 | 13294000 | + | Tcp10a | 4041 |
| 17 | 13291000 | 13294000 | − | Gm11166 | 4042 |
| 17 | 13314000 | 13315000 | + | Tcp10a | 4043 |
| 17 | 13314000 | 13315000 | − | Unc93a | 4044 |
| 17 | 13538200 | 13539600 | + | Tcp10a | 4045 |
| 17 | 13578400 | 13581600 | + | int | 4046 |
| 17 | 13599200 | 13600400 | + | int | 4047 |
| 17 | 14035600 | 14036600 | + | Mllt4 | 4048 |
| 17 | 14281200 | 14282200 | + | int | 4049 |
| 17 | 15123600 | 15125000 | + | 9030025P20Rik | 4050 |
| 17 | 15128600 | 15129600 | + | int | 4051 |
| 17 | 15154800 | 15156400 | + | Gm3435 | 4052 |
| 17 | 15160000 | 15161000 | + | int | 4053 |
| 17 | 16935800 | 16936800 | + | int | 4054 |
| 17 | 17641400 | 17644800 | + | int | 4055 |
| 17 | 18075600 | 18076600 | + | int | 4056 |
| 17 | 18423600 | 18424800 | + | int | 4057 |
| 17 | 18547200 | 18548200 | + | int | 4058 |
| 17 | 18567400 | 18568400 | + | Vmn2r95 | 4059 |
| 17 | 18619000 | 18620200 | + | int | 4060 |
| 17 | 18652200 | 18653400 | + | int | 4061 |
| 17 | 19164800 | 19165800 | + | int | 4062 |
| 17 | 19567200 | 19568200 | + | int | 4063 |
| 17 | 19723800 | 19725400 | + | Vmn2r101 | 4064 |
| 17 | 19789200 | 19790400 | + | int | 4065 |
| 17 | 19948400 | 19949600 | + | Vmn2r103 | 4066 |
| 17 | 20083600 | 20084800 | + | int | 4067 |
| 17 | 20311000 | 20312400 | + | int | 4068 |
| 17 | 20727600 | 20729200 | − | Vmn2r110 | 4069 |
| 17 | 20772800 | 20774400 | + | int | 4070 |
| 17 | 20794800 | 20796000 | + | int | 4071 |
| 17 | 20845400 | 20846400 | + | int | 4072 |
| 17 | 20869400 | 20871000 | + | Vmn1r227 | 4073 |
| 17 | 20905400 | 20906600 | + | int | 4074 |
| 17 | 20983800 | 20985000 | + | Vmn1r230 | 4075 |
| 17 | 21009200 | 21010200 | + | int | 4076 |
| 17 | 21201800 | 21202800 | + | int | 4077 |
| 17 | 21294600 | 21295800 | + | int | 4078 |
| 17 | 21317800 | 21319000 | + | int | 4079 |
| 17 | 21347600 | 21348800 | + | int | 4080 |
| 17 | 21402000 | 21403000 | + | int | 4081 |
| 17 | 22688200 | 22689200 | − | Vmn2r111 | 4082 |
| 17 | 23098000 | 23099200 | + | int | 4083 |
| 17 | 23291600 | 23292600 | + | int | 4084 |
| 17 | 23511400 | 23512400 | + | int | 4085 |
| 17 | 28955600 | 28955800 | + | Brpf3 | 4086 |
| 17 | 29334000 | 29335000 | − | Cpne5 | 4087 |
| 17 | 31349000 | 31350000 | + | Ubash3a | 4088 |
| 17 | 31538800 | 31539800 | + | Pde9a | 4089 |
| 17 | 34755400 | 34756400 | − | Egfl8 | 4090 |
| 17 | 34755400 | 34756400 | − | Ppt2 | 4091 |
| 17 | 34879600 | 34880600 | − | C4b | 4092 |
| 17 | 37362000 | 37363000 | + | Olfr96 | 4093 |
| 17 | 37450200 | 37451400 | − | Olfr100 | 4094 |
| 17 | 37450200 | 37451400 | − | Olfr102 | 4095 |
| 17 | 37558800 | 37559800 | + | int | 4096 |
| 17 | 37793800 | 37795200 | + | int | 4097 |
| 17 | 37900600 | 37901600 | + | int | 4098 |
| 17 | 38690600 | 38691600 | + | Esp34 | 4099 |
| 17 | 39449000 | 39450000 | + | int | 4100 |
| 17 | 39697800 | 39699000 | + | int | 4101 |
| 17 | 39804800 | 39806200 | + | int | 4102 |
| 17 | 39830000 | 39831400 | + | int | 4103 |
| 17 | 39857800 | 39858800 | + | int | 4104 |
| 17 | 39950400 | 39951400 | + | int | 4105 |
| 17 | 40004400 | 40005400 | + | int | 4106 |
| 17 | 40136800 | 40137800 | + | int | 4107 |
| 17 | 41595800 | 41597000 | + | int | 4108 |
| 17 | 41610800 | 41611800 | + | int | 4109 |
| 17 | 42065000 | 42066000 | + | int | 4110 |
| 17 | 42185000 | 42186400 | + | int | 4111 |
| 17 | 43438200 | 43439200 | + | Gpr110 | 4112 |
| 17 | 46984200 | 46985200 | + | int | 4113 |
| 17 | 50852400 | 50853400 | + | int | 4114 |
| 17 | 51280800 | 51282400 | − | Tbc1d5 | 4115 |
| 17 | 51970400 | 51971400 | − | Satb1 | 4116 |
| 17 | 51970400 | 51971400 | − | Satb1 | 4117 |
| 17 | 52392600 | 52394000 | + | int | 4118 |
| 17 | 53333200 | 53334200 | + | int | 4119 |
| 17 | 53451600 | 53452800 | + | int | 4120 |
| 17 | 53510400 | 53511800 | + | int | 4121 |
| 17 | 53576400 | 53577400 | − | Efhb | 4122 |
| 17 | 53740600 | 53741600 | + | Kat2b | 4123 |
| 17 | 53740600 | 53741600 | + | Kat2b | 4124 |
| 17 | 55061400 | 55062400 | + | int | 4125 |
| 17 | 55304000 | 55305000 | + | int | 4126 |
| 17 | 55445800 | 55446800 | + | int | 4127 |
| 17 | 56737800 | 56738800 | + | Safb | 4128 |
| 17 | 57833600 | 57834600 | + | int | 4129 |
| 17 | 59167000 | 59168200 | + | int | 4130 |
| 17 | 59358600 | 59359800 | + | int | 4131 |
| 17 | 59775600 | 59776600 | + | int | 4132 |
| 17 | 59962400 | 59963600 | + | int | 4133 |
| 17 | 60026800 | 60027800 | + | int | 4134 |
| 17 | 60270000 | 60271200 | + | int | 4135 |
| 17 | 60634200 | 60635600 | + | int | 4136 |
| 17 | 61054600 | 61055600 | + | int | 4137 |
| 17 | 61131200 | 61132400 | + | int | 4138 |
| 17 | 61500000 | 61501000 | + | int | 4139 |
| 17 | 61622600 | 61623000 | + | int | 4140 |
| 17 | 61639000 | 61640000 | + | int | 4141 |
| 17 | 61751800 | 61753200 | + | int | 4142 |
| 17 | 61756600 | 61757600 | + | int | 4143 |
| 17 | 61829200 | 61830400 | + | int | 4144 |
| 17 | 61968400 | 61969600 | + | int | 4145 |
| 17 | 62033200 | 62034400 | + | int | 4146 |
| 17 | 62052800 | 62053800 | + | int | 4147 |
| 17 | 62250000 | 62251200 | + | int | 4148 |
| 17 | 62269600 | 62270800 | + | int | 4149 |
| 17 | 62460400 | 62462200 | + | int | 4150 |
| 17 | 62582200 | 62583200 | + | int | 4151 |
| 17 | 62762000 | 62763000 | + | int | 4152 |
| 17 | 62834200 | 62835400 | + | int | 4153 |
| 17 | 63796400 | 63797400 | − | Fbxl17 | 4154 |
| 17 | 64021800 | 64022800 | + | int | 4155 |
| 17 | 66660600 | 66661800 | + | int | 4156 |
| 17 | 66924200 | 66925400 | − | 9130404H23Rik | 4157 |
| 17 | 68432600 | 68433800 | + | int | 4158 |

TABLE 1-continued

| chromosome | start | stop | strand | nearest gene | ID |
|---|---|---|---|---|---|
| 17 | 71312200 | 71314000 | + | int | 4159 |
| 17 | 76478200 | 76479600 | + | int | 4160 |
| 17 | 76965400 | 76966400 | + | int | 4161 |
| 17 | 76969800 | 76970800 | + | int | 4162 |
| 17 | 77281800 | 77282800 | + | int | 4163 |
| 17 | 77443400 | 77444600 | + | int | 4164 |
| 17 | 77459800 | 77461200 | + | int | 4165 |
| 17 | 77627200 | 77628800 | + | int | 4166 |
| 17 | 77806400 | 77807800 | + | int | 4167 |
| 17 | 78184200 | 78185400 | + | int | 4168 |
| 17 | 82168200 | 82169400 | + | int | 4169 |
| 17 | 82199800 | 82200800 | + | int | 4170 |
| 17 | 83630400 | 83631400 | + | Lrpprc | 4171 |
| 17 | 85125000 | 85126000 | − | Lrpprc | 4172 |
| 17 | 90592600 | 90593600 | − | Nrxn1 | 4173 |
| 17 | 90821400 | 90822600 | − | Nrxn1 | 4174 |
| 17 | 91315200 | 91316600 | − | Nrxn1 | 4175 |
| 17 | 91547000 | 91548000 | + | int | 4176 |
| 17 | 91599200 | 91600400 | + | int | 4177 |
| 17 | 91769400 | 91770400 | + | int | 4178 |
| 17 | 92091000 | 92092800 | + | int | 4179 |
| 17 | 92295200 | 92296400 | + | int | 4180 |
| 17 | 92736600 | 92738200 | + | int | 4181 |
| 17 | 93110800 | 93111800 | + | int | 4182 |
| 17 | 93256200 | 93257400 | + | int | 4183 |
| 17 | 93277400 | 93278800 | + | int | 4184 |
| 17 | 93515200 | 93516200 | + | int | 4185 |
| 17 | 93522400 | 93523400 | + | int | 4186 |
| 17 | 93734800 | 93736200 | + | int | 4187 |
| 17 | 93754000 | 93755200 | + | int | 4188 |
| 17 | 93853000 | 93854000 | + | int | 4189 |
| 17 | 93881400 | 93882600 | + | int | 4190 |
| 17 | 94145600 | 94146800 | + | int | 4191 |
| 17 | 94704200 | 94705600 | + | int | 4192 |
| 17 | 94744000 | 94745000 | + | int | 4193 |
| 17 | 95215600 | 95216600 | − | 2610044O15Rik | 4194 |
| 18 | 3004800 | 3006400 | + | int | 4195 |
| 18 | 3168400 | 3169400 | + | int | 4196 |
| 18 | 3618400 | 3619400 | + | int | 4197 |
| 18 | 3697800 | 3699600 | + | int | 4198 |
| 18 | 3701000 | 3702000 | + | int | 4199 |
| 18 | 4431600 | 4432600 | + | int | 4200 |
| 18 | 6273800 | 6274800 | + | int | 4201 |
| 18 | 7297000 | 7298200 | − | Armc4 | 4202 |
| 18 | 7851800 | 7852800 | + | int | 4203 |
| 18 | 8323000 | 8324200 | + | int | 4204 |
| 18 | 9536000 | 9537000 | + | int | 4205 |
| 18 | 9540200 | 9541200 | + | int | 4206 |
| 18 | 9548200 | 9549200 | + | int | 4207 |
| 18 | 11293800 | 11294800 | + | int | 4208 |
| 18 | 11303600 | 11305000 | + | int | 4209 |
| 18 | 11749400 | 11750600 | + | int | 4210 |
| 18 | 11855800 | 11857000 | + | Rbbp8 | 4211 |
| 18 | 15870800 | 15872200 | − | Chst9 | 4212 |
| 18 | 16260000 | 16261000 | + | int | 4213 |
| 18 | 16297600 | 16298600 | + | int | 4214 |
| 18 | 16475200 | 16476400 | + | int | 4215 |
| 18 | 17762600 | 17763600 | + | int | 4216 |
| 18 | 17997800 | 17999200 | + | int | 4217 |
| 18 | 18032800 | 18034000 | + | int | 4218 |
| 18 | 18105800 | 18107000 | + | int | 4219 |
| 18 | 18405600 | 18406600 | + | int | 4220 |
| 18 | 18647200 | 18648400 | + | int | 4221 |
| 18 | 18707600 | 18709000 | + | int | 4222 |
| 18 | 18986200 | 18987200 | + | int | 4223 |
| 18 | 19169800 | 19171600 | + | int | 4224 |
| 18 | 19237600 | 19238800 | + | int | 4225 |
| 18 | 19308400 | 19309400 | + | int | 4226 |
| 18 | 19517600 | 19519000 | + | int | 4227 |
| 18 | 19953400 | 19954600 | + | int | 4228 |
| 18 | 19984800 | 19986000 | + | int | 4229 |
| 18 | 20774400 | 20775400 | + | int | 4230 |
| 18 | 22223600 | 22224600 | − | 4921528I01Rik | 4231 |
| 18 | 23360600 | 23361800 | + | int | 4232 |
| 18 | 25094200 | 25095200 | + | Fhod3 | 4233 |
| 18 | 25531200 | 25532200 | + | AW554918 | 4234 |
| 18 | 26299400 | 26301000 | + | int | 4235 |
| 18 | 26750200 | 26751200 | + | int | 4236 |
| 18 | 27757200 | 27758200 | + | int | 4237 |
| 18 | 27968400 | 27969600 | + | int | 4238 |
| 18 | 28332000 | 28333200 | + | int | 4239 |
| 18 | 29180000 | 29181200 | + | int | 4240 |
| 18 | 29471600 | 29472600 | + | int | 4241 |
| 18 | 30213600 | 30214600 | + | int | 4242 |
| 18 | 31376800 | 31378200 | − | Rit2 | 4243 |
| 18 | 31769000 | 31770000 | − | Slc25a46 | 4244 |
| 18 | 32286200 | 32287800 | − | Proc | 4245 |
| 18 | 32286200 | 32287800 | − | Proc | 4246 |
| 18 | 33588600 | 33591600 | + | int | 4247 |
| 18 | 34477200 | 34478200 | + | Apc | 4248 |
| 18 | 37044600 | 37045600 | + | int | 4249 |
| 18 | 37148200 | 37149600 | + | Pcdha1 | 4250 |
| 18 | 37148200 | 37149600 | + | Pcdha2 | 4251 |
| 18 | 37148200 | 37149600 | + | Pcdha3 | 4252 |
| 18 | 37148200 | 37149600 | + | Pcdha4 | 4253 |
| 18 | 37148200 | 37149600 | + | Pcdha4-g | 4254 |
| 18 | 37148200 | 37149600 | + | Pcdha5 | 4255 |
| 18 | 37148200 | 37149600 | + | Pcdha6 | 4256 |
| 18 | 37148200 | 37149600 | + | Pcdha7 | 4257 |
| 18 | 37148200 | 37149600 | + | Pcdha8 | 4258 |
| 18 | 37158600 | 37159800 | + | Pcdha1 | 4259 |
| 18 | 37158600 | 37159800 | + | Pcdha2 | 4260 |
| 18 | 37158600 | 37159800 | + | Pcdha3 | 4261 |
| 18 | 37158600 | 37159800 | + | Pcdha4 | 4262 |
| 18 | 37158600 | 37159800 | + | Pcdha4-g | 4263 |
| 18 | 37158600 | 37159800 | + | Pcdha5 | 4264 |
| 18 | 37158600 | 37159800 | + | Pcdha6 | 4265 |
| 18 | 37158600 | 37159800 | + | Pcdha7 | 4266 |
| 18 | 37158600 | 37159800 | + | Pcdha8 | 4267 |
| 18 | 37158600 | 37159800 | + | Pcdha9 | 4268 |
| 18 | 37477200 | 37479000 | + | Pcdha4-g | 4269 |
| 18 | 37477200 | 37479000 | + | Pcdhb5 | 4270 |
| 18 | 37754400 | 37755400 | + | Pcdha4-g | 4271 |
| 18 | 39608200 | 39609200 | − | Nr3c1 | 4272 |
| 18 | 41190600 | 41192000 | + | int | 4273 |
| 18 | 41320200 | 41321200 | + | int | 4274 |
| 18 | 41566600 | 41567800 | + | int | 4275 |
| 18 | 44384200 | 44385400 | + | int | 4276 |
| 18 | 45305200 | 45306800 | + | int | 4277 |
| 18 | 46547200 | 46548200 | + | int | 4278 |
| 18 | 46712200 | 46713200 | + | int | 4279 |
| 18 | 47048000 | 47049000 | + | 4833403I15Rik | 4280 |
| 18 | 47157800 | 47159000 | + | Commd10 | 4281 |
| 18 | 47164600 | 47165600 | + | Commd10 | 4282 |
| 18 | 48068200 | 48069400 | + | int | 4283 |
| 18 | 48479800 | 48480800 | + | int | 4284 |
| 18 | 48494600 | 48495600 | + | int | 4285 |
| 18 | 48815800 | 48817200 | + | int | 4286 |
| 18 | 49768600 | 49769600 | + | int | 4287 |
| 18 | 50055400 | 50057200 | + | Dmxl1 | 4288 |
| 18 | 51092000 | 51093200 | + | int | 4289 |
| 18 | 51193600 | 51194600 | + | int | 4290 |
| 18 | 51531600 | 51532600 | + | int | 4291 |
| 18 | 51889800 | 51891600 | + | int | 4292 |
| 18 | 51927000 | 51928000 | + | int | 4293 |
| 18 | 52079400 | 52080600 | + | int | 4294 |
| 18 | 52601200 | 52602200 | + | int | 4295 |
| 18 | 53922800 | 53923800 | + | int | 4296 |
| 18 | 54102400 | 54104000 | + | Csnk1g3 | 4297 |
| 18 | 54539000 | 54540000 | + | int | 4298 |
| 18 | 54858000 | 54859600 | + | int | 4299 |
| 18 | 58383600 | 58384600 | + | int | 4300 |
| 18 | 58409800 | 58410800 | + | int | 4301 |
| 18 | 59197200 | 59199000 | + | Adamts19 | 4302 |
| 18 | 59644000 | 59645200 | + | int | 4303 |
| 18 | 60014200 | 60015200 | + | int | 4304 |
| 18 | 60088200 | 60089400 | + | int | 4305 |
| 18 | 60174000 | 60175000 | + | int | 4306 |
| 18 | 60251800 | 60253400 | + | int | 4307 |
| 18 | 63633000 | 63634000 | + | int | 4308 |
| 18 | 63692400 | 63693600 | + | int | 4309 |
| 18 | 63916200 | 63917200 | + | Wdr7 | 4310 |
| 18 | 67671800 | 67672800 | − | Spire1 | 4311 |
| 18 | 67671800 | 67672800 | − | Spire1 | 4312 |

TABLE 1-continued

| chromo-some | start | stop | strand | nearest gene | ID |
|---|---|---|---|---|---|
| 18 | 70189200 | 70190600 | − | Rab27b | 4313 |
| 18 | 70189200 | 70190600 | − | Rab27b | 4314 |
| 18 | 70200000 | 70201000 | − | Rab27b | 4315 |
| 18 | 70200000 | 70201000 | − | Rab27b | 4316 |
| 18 | 70668800 | 70669800 | − | Poli | 4317 |
| 18 | 70668800 | 70669800 | − | Poli | 4318 |
| 18 | 71582000 | 71583000 | − | Dcc | 4319 |
| 18 | 71772000 | 71773000 | − | Dcc | 4320 |
| 18 | 71817400 | 71818400 | − | Dcc | 4321 |
| 18 | 72371400 | 72372400 | − | Dcc | 4322 |
| 18 | 73085200 | 73086200 | + | int | 4323 |
| 18 | 73387200 | 73388200 | + | int | 4324 |
| 18 | 73415200 | 73416800 | + | int | 4325 |
| 18 | 73480400 | 73481400 | + | int | 4326 |
| 18 | 73594000 | 73595200 | + | int | 4327 |
| 18 | 74350200 | 74351400 | + | int | 4328 |
| 18 | 74359400 | 74360800 | − | Ska1 | 4329 |
| 18 | 74561800 | 74562800 | + | int | 4330 |
| 18 | 75236000 | 75237000 | + | Dym | 4331 |
| 18 | 77071000 | 77072000 | + | int | 4332 |
| 18 | 77415800 | 77417400 | + | int | 4333 |
| 18 | 79710400 | 79711400 | + | int | 4334 |
| 18 | 81267800 | 81268800 | + | int | 4335 |
| 18 | 81913600 | 81914600 | + | int | 4336 |
| 18 | 83618800 | 83619800 | + | int | 4337 |
| 18 | 85338200 | 85339200 | + | int | 4338 |
| 18 | 86235800 | 86236800 | + | int | 4339 |
| 18 | 86275000 | 86276000 | + | int | 4340 |
| 18 | 86667600 | 86668800 | + | Neto1 | 4341 |
| 18 | 86756000 | 86757600 | + | int | 4342 |
| 18 | 87451200 | 87452200 | + | int | 4343 |
| 18 | 87531200 | 87532200 | + | int | 4344 |
| 18 | 87614000 | 87617200 | + | int | 4345 |
| 18 | 87736400 | 87737600 | + | int | 4346 |
| 18 | 87880400 | 87881600 | + | int | 4347 |
| 18 | 88030600 | 88031800 | + | int | 4348 |
| 18 | 88375400 | 88376600 | + | int | 4349 |
| 18 | 88785400 | 88786600 | + | int | 4350 |
| 18 | 89453200 | 89454200 | + | int | 4351 |
| 18 | 89830200 | 89831200 | − | Dok6 | 4352 |
| 18 | 89923800 | 89924800 | − | Dok6 | 4353 |
| 18 | 90187000 | 90188200 | + | int | 4354 |
| 18 | 90309800 | 90311000 | + | int | 4355 |
| 18 | 90641800 | 90643000 | + | int | 4356 |
| 18 | 90769400 | 90770400 | + | int | 4357 |
| 19 | 7758200 | 7759200 | − | Slc22a19 | 4358 |
| 19 | 9622400 | 9623200 | + | int | 4359 |
| 19 | 9869400 | 9870400 | + | int | 4360 |
| 19 | 11499800 | 11501000 | + | Ms4a4c | 4361 |
| 19 | 12762400 | 12763800 | + | int | 4362 |
| 19 | 12888800 | 12889600 | + | Lpxn | 4363 |
| 19 | 12958000 | 12959200 | + | Olfr1445 | 4364 |
| 19 | 12994000 | 12995000 | − | Olfr1448 | 4365 |
| 19 | 13258800 | 13260000 | + | int | 4366 |
| 19 | 13481200 | 13482800 | + | Olfr1469 | 4367 |
| 19 | 13581800 | 13583000 | + | int | 4368 |
| 19 | 13781200 | 13782200 | + | int | 4369 |
| 19 | 13817800 | 13819400 | + | int | 4370 |
| 19 | 14069200 | 14070200 | + | int | 4371 |
| 19 | 14126400 | 14127400 | + | int | 4372 |
| 19 | 14762400 | 14763400 | + | int | 4373 |
| 19 | 15657600 | 15658600 | + | int | 4374 |
| 19 | 17413400 | 17414800 | − | Gcnt1 | 4375 |
| 19 | 17413400 | 17414800 | − | Gcnt1 | 4376 |
| 19 | 17413400 | 17414800 | − | Gcnt1 | 4377 |
| 19 | 18560000 | 18561000 | + | int | 4378 |
| 19 | 19188200 | 19189400 | − | Rorb | 4379 |
| 19 | 19335800 | 19337000 | + | int | 4380 |
| 19 | 19342000 | 19343600 | + | int | 4381 |
| 19 | 19861200 | 19862200 | + | int | 4382 |
| 19 | 19973400 | 19974600 | + | int | 4383 |
| 19 | 20190200 | 20192200 | + | int | 4384 |
| 19 | 22397200 | 22398200 | + | Trpm3 | 4385 |
| 19 | 22547800 | 22548800 | + | Trpm3 | 4386 |
| 19 | 22547800 | 22548800 | + | Trpm3 | 4387 |
| 19 | 22871200 | 22872200 | + | Trpm3 | 4388 |
| 19 | 22871200 | 22872200 | + | Trpm3 | 4389 |
| 19 | 22871200 | 22872200 | + | Trpm3 | 4390 |
| 19 | 23204600 | 23205800 | + | int | 4391 |
| 19 | 23924200 | 23925200 | + | Apba1 | 4392 |
| 19 | 27943400 | 27944400 | − | Rfx3 | 4393 |
| 19 | 27943400 | 27944400 | − | Rfx3 | 4394 |
| 19 | 29135400 | 29136400 | + | int | 4395 |
| 19 | 29796600 | 29797600 | − | 9930021J03Rik | 4396 |
| 19 | 29908800 | 29909800 | + | int | 4397 |
| 19 | 32350600 | 32351600 | − | Sgms1 | 4398 |
| 19 | 32350600 | 32351600 | − | Sgms1 | 4399 |
| 19 | 33642200 | 33643600 | − | AI747699 | 4400 |
| 19 | 33807600 | 33808600 | + | int | 4401 |
| 19 | 35508000 | 35509000 | + | int | 4402 |
| 19 | 36030000 | 36031200 | + | int | 4403 |
| 19 | 39250200 | 39252000 | + | Cyp2c66 | 4404 |
| 19 | 39608800 | 39609800 | + | Cyp2c39 | 4405 |
| 19 | 39833400 | 39834400 | + | int | 4406 |
| 19 | 39859800 | 39861000 | − | Cyp2c40 | 4407 |
| 19 | 39865600 | 39866600 | − | Cyp2c40 | 4408 |
| 19 | 39908800 | 39909800 | + | int | 4409 |
| 19 | 41430600 | 41431600 | − | Pik3ap1 | 4410 |
| 19 | 43418400 | 43419400 | − | Hpse2 | 4411 |
| 19 | 43424600 | 43425800 | − | Hpse2 | 4412 |
| 19 | 43893400 | 43894400 | + | Abcc2 | 4413 |
| 19 | 44797600 | 44799000 | + | int | 4414 |
| 19 | 48972200 | 48973200 | + | int | 4415 |
| 19 | 49640800 | 49642200 | + | int | 4416 |
| 19 | 50111000 | 50112600 | + | int | 4417 |
| 19 | 50887800 | 50888800 | + | int | 4418 |
| 19 | 51478400 | 51479800 | + | int | 4419 |
| 19 | 51683600 | 51684600 | + | int | 4420 |
| 19 | 51932600 | 51934200 | + | int | 4421 |
| 19 | 52556600 | 52558000 | + | int | 4422 |
| 19 | 53516000 | 53517000 | − | 5830416P10Rik | 4423 |
| 19 | 55528000 | 55529000 | + | Vti1a | 4424 |
| 19 | 55680600 | 55681600 | + | Vti1a | 4425 |
| 19 | 57534600 | 57537600 | + | Trub1 | 4426 |
| 19 | 57534600 | 57537600 | + | Trub1 | 4427 |
| 19 | 58621800 | 58622800 | + | 1700011F14Rik | 4428 |
| 19 | 59926200 | 59927200 | + | int | 4429 |
| 19 | 60750800 | 60752000 | + | int | 4430 |
| X | 3025400 | 3027200 | + | int | 4431 |
| X | 3060000 | 3061400 | + | int | 4432 |
| X | 3217600 | 3218800 | + | int | 4433 |
| X | 4150400 | 4151600 | + | int | 4434 |
| X | 4252800 | 4254400 | + | int | 4435 |
| X | 4780200 | 4781800 | + | int | 4436 |
| X | 4797600 | 4798600 | + | int | 4437 |
| X | 5351400 | 5352400 | + | int | 4438 |
| X | 5906400 | 5907400 | + | int | 4439 |
| X | 5960600 | 5961800 | + | int | 4440 |
| X | 5963200 | 5964200 | + | int | 4441 |
| X | 6097400 | 6098400 | + | Shroom4 | 4442 |
| X | 6219600 | 6220600 | + | int | 4443 |
| X | 6259200 | 6260200 | + | int | 4444 |
| X | 6339200 | 6340200 | + | int | 4445 |
| X | 6562000 | 6563000 | − | Ccnb3 | 4446 |
| X | 6843400 | 6844400 | + | int | 4447 |
| X | 7283200 | 7284200 | + | Gpkow | 4448 |
| X | 7472600 | 7473700 | + | Timm17b | 4449 |
| X | 7472600 | 7473800 | − | Pqbp1 | 4450 |
| X | 8205600 | 8207000 | + | int | 4451 |
| X | 8358400 | 8359600 | + | int | 4452 |
| X | 8539800 | 8541200 | − | Gm5634 | 4453 |
| X | 10499000 | 10500200 | + | int | 4454 |
| X | 10510800 | 10512000 | + | int | 4455 |
| X | 12074400 | 12075800 | + | int | 4456 |
| X | 12463200 | 12464400 | + | int | 4457 |
| X | 12961600 | 12962600 | + | int | 4458 |
| X | 13920000 | 13921000 | + | int | 4459 |
| X | 14057400 | 14058400 | + | int | 4460 |
| X | 14181200 | 14182400 | + | int | 4461 |
| X | 14251000 | 14252200 | + | int | 4462 |
| X | 14369200 | 14370200 | + | int | 4463 |
| X | 14627400 | 14628800 | + | int | 4464 |
| X | 14806000 | 14807000 | + | int | 4465 |
| X | 14868000 | 14869400 | + | int | 4466 |

TABLE 1-continued

| chromosome | start | stop | strand | nearest gene | ID |
|---|---|---|---|---|---|
| X | 15523000 | 15524400 | + | int | 4467 |
| X | 15810600 | 15811800 | + | int | 4468 |
| X | 16174800 | 16176000 | + | int | 4469 |
| X | 16227800 | 16228800 | + | Maoa | 4470 |
| X | 16255700 | 16257400 | + | Maoa | 4471 |
| X | 16346000 | 16347400 | − | Maob | 4472 |
| X | 16527400 | 16528800 | + | int | 4473 |
| X | 17018400 | 17019400 | + | int | 4474 |
| X | 17542800 | 17543800 | + | int | 4475 |
| X | 17807000 | 17808000 | + | Kdm6a | 4476 |
| X | 18099800 | 18101000 | + | int | 4477 |
| X | 18615600 | 18616600 | + | int | 4478 |
| X | 19057600 | 19058800 | + | int | 4479 |
| X | 19296200 | 19297600 | + | int | 4480 |
| X | 20677400 | 20679000 | + | int | 4481 |
| X | 20737000 | 20738200 | + | int | 4482 |
| X | 20853600 | 20854600 | + | int | 4483 |
| X | 22111400 | 22112400 | + | int | 4484 |
| X | 22354600 | 22355600 | + | int | 4485 |
| X | 22742400 | 22743800 | + | int | 4486 |
| X | 23481400 | 23482400 | + | Gm4907 | 4487 |
| X | 23489800 | 23491000 | + | int | 4488 |
| X | 23668800 | 23670200 | + | int | 4489 |
| X | 23746800 | 23748000 | + | int | 4490 |
| X | 23765200 | 23766200 | + | int | 4491 |
| X | 24817200 | 24819000 | + | int | 4492 |
| X | 25585600 | 25587000 | + | int | 4493 |
| X | 30353600 | 30355000 | + | int | 4494 |
| X | 30467800 | 30469200 | + | int | 4495 |
| X | 30628000 | 30629000 | + | int | 4496 |
| X | 30842800 | 30844400 | + | int | 4497 |
| X | 30960200 | 30961200 | + | int | 4498 |
| X | 31076200 | 31077800 | + | int | 4499 |
| X | 31309800 | 31311200 | + | int | 4500 |
| X | 31320400 | 31321400 | + | int | 4501 |
| X | 31404000 | 31405600 | + | int | 4502 |
| X | 31441600 | 31443200 | + | int | 4503 |
| X | 31964000 | 31965000 | + | int | 4504 |
| X | 31991400 | 31992400 | + | int | 4505 |
| X | 32007000 | 32008000 | + | int | 4506 |
| X | 32030800 | 32032200 | + | int | 4507 |
| X | 32089600 | 32090600 | + | int | 4508 |
| X | 32164800 | 32166400 | + | int | 4509 |
| X | 33297400 | 33298400 | + | int | 4510 |
| X | 33385600 | 33386800 | + | int | 4511 |
| X | 34970800 | 34971800 | + | Rhox4e | 4512 |
| X | 35023800 | 35024800 | − | Rhox4f | 4513 |
| X | 35241400 | 35242400 | + | int | 4514 |
| X | 35365200 | 35366400 | + | int | 4515 |
| X | 35731000 | 35732000 | + | int | 4516 |
| X | 35896800 | 35897800 | − | Cul4b | 4517 |
| X | 36217800 | 36218800 | + | 6030498E09Rik | 4518 |
| X | 36250000 | 36251400 | + | 6030498E09Rik | 4519 |
| X | 36410000 | 36411200 | + | int | 4520 |
| X | 37047600 | 37048600 | + | int | 4521 |
| X | 37301800 | 37303000 | + | int | 4522 |
| X | 37490000 | 37491200 | + | int | 4523 |
| X | 37499200 | 37500200 | + | int | 4524 |
| X | 37602800 | 37604200 | + | int | 4525 |
| X | 37834800 | 37836400 | + | int | 4526 |
| X | 37879000 | 37880400 | + | int | 4527 |
| X | 37937000 | 37938400 | + | int | 4528 |
| X | 38023800 | 38025000 | + | int | 4529 |
| X | 38038400 | 38039400 | + | int | 4530 |
| X | 38073400 | 38074400 | + | int | 4531 |
| X | 38244000 | 38245000 | + | int | 4532 |
| X | 38290000 | 38291000 | + | int | 4533 |
| X | 38505200 | 38506200 | + | int | 4534 |
| X | 38559000 | 38560000 | + | int | 4535 |
| X | 38571400 | 38572600 | + | int | 4536 |
| X | 39481000 | 39482200 | + | int | 4537 |
| X | 39626600 | 39627800 | + | Stag2 | 4538 |
| X | 39626600 | 39627800 | + | Stag2 | 4539 |
| X | 40125200 | 40126400 | − | Odz1 | 4540 |
| X | 40137200 | 40138200 | − | Odz1 | 4541 |
| X | 40232400 | 40233800 | − | Odz1 | 4542 |
| X | 40460200 | 40461400 | − | Odz1 | 4543 |
| X | 40507600 | 40509000 | − | Odz1 | 4544 |
| X | 40549400 | 40550800 | − | Odz1 | 4545 |
| X | 40605600 | 40606600 | − | Odz1 | 4546 |
| X | 40692400 | 40693400 | + | int | 4547 |
| X | 41078600 | 41079600 | + | int | 4548 |
| X | 41129400 | 41131000 | + | int | 4549 |
| X | 41136800 | 41137800 | + | int | 4550 |
| X | 41207400 | 41208400 | + | int | 4551 |
| X | 41320200 | 41321600 | + | int | 4552 |
| X | 41350600 | 41351600 | + | int | 4553 |
| X | 41475600 | 41476600 | + | int | 4554 |
| X | 41603400 | 41604800 | + | int | 4555 |
| X | 41614600 | 41616000 | + | int | 4556 |
| X | 41816000 | 41817200 | + | int | 4557 |
| X | 41885600 | 41886600 | + | int | 4558 |
| X | 41926200 | 41927400 | + | int | 4559 |
| X | 42273600 | 42275200 | + | int | 4560 |
| X | 42356200 | 42357600 | + | int | 4561 |
| X | 42440400 | 42441600 | + | 1110059M19Rik | 4562 |
| X | 42603800 | 42605200 | + | int | 4563 |
| X | 42617800 | 42618800 | + | int | 4564 |
| X | 42739600 | 42740800 | + | int | 4565 |
| X | 42769400 | 42770400 | + | int | 4566 |
| X | 42777600 | 42778600 | + | int | 4567 |
| X | 42810200 | 42811200 | + | int | 4568 |
| X | 42844200 | 42845200 | + | int | 4569 |
| X | 42850400 | 42851400 | + | int | 4570 |
| X | 42944200 | 42945400 | + | int | 4571 |
| X | 43025400 | 43026400 | + | int | 4572 |
| X | 43032200 | 43033600 | + | int | 4573 |
| X | 43120600 | 43121600 | + | int | 4574 |
| X | 43148400 | 43149600 | + | int | 4575 |
| X | 43205000 | 43206400 | + | int | 4576 |
| X | 43212400 | 43213400 | + | int | 4577 |
| X | 43418200 | 43419400 | + | int | 4578 |
| X | 43490600 | 43491800 | + | int | 4579 |
| X | 43790200 | 43791200 | + | int | 4580 |
| X | 43808600 | 43809600 | − | Gm4987 | 4581 |
| X | 43846200 | 43847200 | + | int | 4582 |
| X | 43851400 | 43852800 | + | int | 4583 |
| X | 44028200 | 44029600 | + | int | 4584 |
| X | 44682200 | 44683400 | + | int | 4585 |
| X | 45245200 | 45246000 | − | Smarca1 | 4586 |
| X | 45531000 | 45532000 | − | Zdhhc9 | 4587 |
| X | 46083200 | 46084600 | + | int | 4588 |
| X | 46313800 | 46315200 | + | int | 4589 |
| X | 46867600 | 46868600 | + | int | 4590 |
| X | 46932600 | 46933600 | + | int | 4591 |
| X | 46952200 | 46953200 | + | int | 4592 |
| X | 46970600 | 46972000 | + | int | 4593 |
| X | 47057600 | 47058800 | + | int | 4594 |
| X | 47125600 | 47126600 | + | int | 4595 |
| X | 47448200 | 47449600 | + | int | 4596 |
| X | 47473800 | 47475000 | + | int | 4597 |
| X | 47551400 | 47552600 | + | int | 4598 |
| X | 47559800 | 47560800 | + | int | 4599 |
| X | 47631800 | 47633400 | + | int | 4600 |
| X | 48094400 | 48095600 | + | int | 4601 |
| X | 48099800 | 48101000 | + | int | 4602 |
| X | 48704200 | 48705200 | + | int | 4603 |
| X | 49280200 | 49281400 | + | int | 4604 |
| X | 50186000 | 50187000 | + | int | 4605 |
| X | 50775400 | 50776400 | + | int | 4606 |
| X | 50882200 | 50883400 | + | int | 4607 |
| X | 51097400 | 51099000 | − | Xlr | 4608 |
| X | 51168800 | 51170000 | + | int | 4609 |
| X | 51349800 | 51350800 | + | int | 4610 |
| X | 51527400 | 51528400 | + | int | 4611 |
| X | 52621800 | 52623000 | + | int | 4612 |
| X | 53391800 | 53392800 | + | 3830403N18Rik | 4613 |
| X | 53406600 | 53407800 | + | 3830403N18Rik | 4614 |
| X | 53635200 | 53636400 | + | int | 4615 |
| X | 54639600 | 54640800 | − | Rbmx | 4616 |
| X | 54639600 | 54640800 | − | Rbmx | 4617 |
| X | 55654200 | 55655200 | + | int | 4618 |
| X | 55691200 | 55692400 | + | int | 4619 |
| X | 56047200 | 56048600 | + | int | 4620 |

TABLE 1-continued

| chromo-some | start | stop | strand | nearest gene | ID |
|---|---|---|---|---|---|
| X | 56262400 | 56263400 | + | int | 4621 |
| X | 56856600 | 56857600 | + | int | 4622 |
| X | 56901600 | 56902600 | + | int | 4623 |
| X | 56940400 | 56941400 | + | int | 4624 |
| X | 57728200 | 57730000 | + | int | 4625 |
| X | 57738400 | 57739400 | + | int | 4626 |
| X | 57848000 | 57849000 | + | int | 4627 |
| X | 58358400 | 58359400 | + | int | 4628 |
| X | 58577600 | 58578600 | + | int | 4629 |
| X | 58709000 | 58710000 | + | int | 4630 |
| X | 58733400 | 58734400 | + | int | 4631 |
| X | 58896400 | 58898000 | + | int | 4632 |
| X | 59038600 | 59040200 | + | int | 4633 |
| X | 59101400 | 59102400 | + | int | 4634 |
| X | 59139000 | 59140000 | + | int | 4635 |
| X | 59254800 | 59255800 | + | int | 4636 |
| X | 59831200 | 59832400 | + | int | 4637 |
| X | 59877600 | 59879000 | + | int | 4638 |
| X | 60111600 | 60112600 | + | int | 4639 |
| X | 60172600 | 60173800 | + | int | 4640 |
| X | 60311200 | 60312200 | + | int | 4641 |
| X | 60322200 | 60323200 | + | int | 4642 |
| X | 60325800 | 60326800 | + | int | 4643 |
| X | 60351000 | 60352000 | + | int | 4644 |
| X | 60799600 | 60800600 | + | int | 4645 |
| X | 60862600 | 60863600 | + | int | 4646 |
| X | 60885600 | 60886600 | + | int | 4647 |
| X | 60910200 | 60911400 | + | int | 4648 |
| X | 61040400 | 61041400 | + | int | 4649 |
| X | 61099800 | 61100800 | + | int | 4650 |
| X | 61149000 | 61150200 | + | int | 4651 |
| X | 61171000 | 61172400 | + | int | 4652 |
| X | 61300400 | 61301600 | + | int | 4653 |
| X | 61528600 | 61529600 | − | Slitrk4 | 4654 |
| X | 61548200 | 61549200 | + | int | 4655 |
| X | 61708600 | 61709600 | + | int | 4656 |
| X | 61780400 | 61781600 | + | int | 4657 |
| X | 61974800 | 61975800 | + | int | 4658 |
| X | 62020600 | 62021600 | + | int | 4659 |
| X | 62184800 | 62186000 | + | int | 4660 |
| X | 62258400 | 62259400 | + | int | 4661 |
| X | 62459800 | 62460800 | + | int | 4662 |
| X | 62748000 | 62749600 | + | int | 4663 |
| X | 62755200 | 62756400 | + | int | 4664 |
| X | 62826000 | 62827000 | + | int | 4665 |
| X | 62879000 | 62880200 | + | int | 4666 |
| X | 62900800 | 62901800 | + | int | 4667 |
| X | 62987200 | 62988400 | + | int | 4668 |
| X | 63002000 | 63003400 | + | int | 4669 |
| X | 63053200 | 63054600 | + | int | 4670 |
| X | 63064200 | 63065200 | + | int | 4671 |
| X | 63175600 | 63176800 | + | int | 4672 |
| X | 63193800 | 63195200 | + | int | 4673 |
| X | 63265200 | 63266200 | + | int | 4674 |
| X | 63637400 | 63638600 | + | int | 4675 |
| X | 63685600 | 63686800 | + | int | 4676 |
| X | 63693000 | 63694000 | + | int | 4677 |
| X | 63811200 | 63812600 | + | int | 4678 |
| X | 63833600 | 63835000 | + | int | 4679 |
| X | 64328800 | 64330000 | + | int | 4680 |
| X | 64352400 | 64353800 | + | int | 4681 |
| X | 64584400 | 64585400 | + | int | 4682 |
| X | 64781400 | 64782400 | + | int | 4683 |
| X | 64912400 | 64914000 | + | int | 4684 |
| X | 65038400 | 65040000 | + | int | 4685 |
| X | 65065000 | 65066000 | + | int | 4686 |
| X | 65177400 | 65178600 | − | 4933436I01Rik | 4687 |
| X | 65544800 | 65545800 | + | int | 4688 |
| X | 65642800 | 65643800 | + | int | 4689 |
| X | 65907600 | 65909000 | + | int | 4690 |
| X | 66014800 | 66016000 | + | Fmr1nb | 4691 |
| X | 66171400 | 66172400 | + | int | 4692 |
| X | 66402800 | 66403800 | + | int | 4693 |
| X | 66476400 | 66477600 | + | int | 4694 |
| X | 66595400 | 66596400 | + | int | 4695 |
| X | 67099200 | 67100200 | + | Aff2 | 4696 |
| X | 67265600 | 67266600 | − | 1700111N16Rik | 4697 |
| X | 67327200 | 67328400 | − | 1700111N16Rik | 4698 |
| X | 68450000 | 68451000 | + | int | 4699 |
| X | 68666000 | 68667000 | + | Mtmr1 | 4700 |
| X | 69913600 | 69914600 | + | int | 4701 |
| X | 69937600 | 69938600 | + | int | 4702 |
| X | 70311800 | 70313400 | + | Pnma3 | 4703 |
| X | 70369200 | 70370600 | + | DXBay18 | 4704 |
| X | 70369200 | 70370600 | + | Gm14685 | 4705 |
| X | 70386600 | 70388000 | − | DXBay18 | 4706 |
| X | 70386600 | 70388000 | − | Gm14685 | 4707 |
| X | 70418800 | 70420400 | + | int | 4708 |
| X | 70540800 | 70542200 | + | int | 4709 |
| X | 70642800 | 70643800 | + | int | 4710 |
| X | 71393200 | 71394400 | + | Opn1mw | 4711 |
| X | 71511600 | 71512800 | + | int | 4712 |
| X | 71832200 | 71833800 | + | int | 4713 |
| X | 71885600 | 71886800 | − | Gm5640 | 4714 |
| X | 71919800 | 71921600 | + | int | 4715 |
| X | 71937000 | 71938000 | + | int | 4716 |
| X | 71959400 | 71960400 | + | int | 4717 |
| X | 71989200 | 71990600 | + | int | 4718 |
| X | 72036200 | 72037200 | + | int | 4719 |
| X | 72052200 | 72053400 | + | int | 4720 |
| X | 72086200 | 72087600 | + | Gm5936 | 4721 |
| X | 72156000 | 72157000 | + | int | 4722 |
| X | 72170600 | 72171600 | + | int | 4723 |
| X | 72396600 | 72397600 | − | 4930428E23Rik | 4724 |
| X | 72745600 | 72747200 | + | int | 4725 |
| X | 73236400 | 73237800 | + | int | 4726 |
| X | 73467600 | 73468600 | + | int | 4727 |
| X | 73495200 | 73496200 | + | int | 4728 |
| X | 73676000 | 73677000 | + | int | 4729 |
| X | 73758200 | 73759400 | + | int | 4730 |
| X | 73826600 | 73829600 | + | int | 4731 |
| X | 73843400 | 73845000 | + | int | 4732 |
| X | 74553600 | 74554600 | + | int | 4733 |
| X | 74580000 | 74581200 | + | int | 4734 |
| X | 75461000 | 75462000 | + | int | 4735 |
| X | 75531000 | 75532000 | + | int | 4736 |
| X | 75635800 | 75636800 | + | int | 4737 |
| X | 75744200 | 75745200 | − | Prrg1 | 4738 |
| X | 75744200 | 75745200 | − | Prrg1 | 4739 |
| X | 76162600 | 76164000 | + | int | 4740 |
| X | 76190600 | 76191800 | + | int | 4741 |
| X | 76264400 | 76265600 | + | int | 4742 |
| X | 76347000 | 76348400 | + | int | 4743 |
| X | 76448800 | 76450000 | + | int | 4744 |
| X | 76589000 | 76590000 | − | Gm8787 | 4745 |
| X | 76664000 | 76665800 | + | int | 4746 |
| X | 76832200 | 76833800 | + | int | 4747 |
| X | 76835200 | 76836800 | + | int | 4748 |
| X | 77503000 | 77504600 | + | int | 4749 |
| X | 77589800 | 77591200 | + | int | 4750 |
| X | 77650400 | 77651600 | + | int | 4751 |
| X | 77662400 | 77663600 | + | int | 4752 |
| X | 77894800 | 77896000 | + | int | 4753 |
| X | 78005000 | 78006000 | + | int | 4754 |
| X | 78034600 | 78035800 | + | int | 4755 |
| X | 78251800 | 78253200 | + | int | 4756 |
| X | 78408200 | 78409200 | + | int | 4757 |
| X | 78479000 | 78480000 | + | int | 4758 |
| X | 78693000 | 78694200 | − | 4930595M18Rik | 4759 |
| X | 78718400 | 78719600 | + | int | 4760 |
| X | 78860000 | 78861400 | + | int | 4761 |
| X | 78862600 | 78863600 | + | int | 4762 |
| X | 79261400 | 79262600 | + | int | 4763 |
| X | 79477200 | 79478200 | + | int | 4764 |
| X | 79978000 | 79979000 | + | int | 4765 |
| X | 80049000 | 80050000 | + | int | 4766 |
| X | 80055800 | 80057200 | + | int | 4767 |
| X | 80210000 | 80211200 | + | Dmd | 4768 |
| X | 80309400 | 80310600 | + | Dmd | 4769 |
| X | 81175400 | 81176400 | + | Dmd | 4770 |
| X | 81283600 | 81284600 | + | Dmd | 4771 |
| X | 81406000 | 81407000 | + | Dmd | 4772 |
| X | 81439400 | 81440400 | + | Dmd | 4773 |
| X | 81694800 | 81695800 | + | Dmd | 4774 |

TABLE 1-continued

| chromosome | start | stop | strand | nearest gene | ID |
|---|---|---|---|---|---|
| X | 81737200 | 81738200 | + | Dmd | 4775 |
| X | 81781400 | 81782600 | + | Dmd | 4776 |
| X | 82240000 | 82241000 | + | Dmd | 4777 |
| X | 82759000 | 82760000 | + | int | 4778 |
| X | 82801400 | 82802600 | + | int | 4779 |
| X | 82849800 | 82851200 | + | Tab3 | 4780 |
| X | 83133200 | 83134200 | + | 5430427O19Rik | 4781 |
| X | 83327800 | 83329800 | + | int | 4782 |
| X | 83366200 | 83367400 | + | int | 4783 |
| X | 83789200 | 83790400 | + | int | 4784 |
| X | 83875800 | 83877200 | + | int | 4785 |
| X | 83887600 | 83888800 | + | int | 4786 |
| X | 84005600 | 84006800 | − | Il1rapl1 | 4787 |
| X | 84074400 | 84075000 | − | Il1rapl1 | 4788 |
| X | 84370400 | 84371400 | − | Il1rapl1 | 4789 |
| X | 84433400 | 84434600 | − | Il1rapl1 | 4790 |
| X | 84445600 | 84447000 | − | Il1rapl1 | 4791 |
| X | 84719600 | 84720600 | − | Il1rapl1 | 4792 |
| X | 84946200 | 84947200 | − | Il1rapl1 | 4793 |
| X | 84984000 | 84985600 | − | Il1rapl1 | 4794 |
| X | 85091400 | 85092400 | − | Il1rapl1 | 4795 |
| X | 85270400 | 85271800 | − | Il1rapl1 | 4796 |
| X | 85288800 | 85290200 | − | Il1rapl1 | 4797 |
| X | 85686000 | 85687200 | + | int | 4798 |
| X | 85716600 | 85717600 | + | int | 4799 |
| X | 85732400 | 85733600 | + | int | 4800 |
| X | 85828000 | 85829000 | + | int | 4801 |
| X | 85844200 | 85845200 | + | int | 4802 |
| X | 85852600 | 85854000 | + | int | 4803 |
| X | 85891400 | 85892400 | + | int | 4804 |
| X | 85906800 | 85907800 | + | int | 4805 |
| X | 85942000 | 85943600 | + | int | 4806 |
| X | 86012000 | 86013400 | + | int | 4807 |
| X | 86183600 | 86184600 | + | int | 4808 |
| X | 86228000 | 86229000 | + | int | 4809 |
| X | 86243600 | 86244600 | + | int | 4810 |
| X | 86247600 | 86248600 | + | int | 4811 |
| X | 86297000 | 86298200 | + | int | 4812 |
| X | 86370400 | 86371600 | + | int | 4813 |
| X | 86700600 | 86701800 | + | int | 4814 |
| X | 86719800 | 86720800 | + | int | 4815 |
| X | 87025200 | 87026200 | + | int | 4816 |
| X | 87109800 | 87110800 | + | int | 4817 |
| X | 87287400 | 87288400 | + | int | 4818 |
| X | 87353200 | 87354200 | + | int | 4819 |
| X | 87377000 | 87378600 | + | int | 4820 |
| X | 87396400 | 87397400 | + | int | 4821 |
| X | 87889800 | 87891000 | + | int | 4822 |
| X | 87991200 | 87992400 | + | int | 4823 |
| X | 88014800 | 88015800 | + | int | 4824 |
| X | 88061200 | 88062600 | + | int | 4825 |
| X | 88134800 | 88136200 | + | Gm44 | 4826 |
| X | 88162600 | 88164000 | + | int | 4827 |
| X | 88235800 | 88236800 | + | int | 4828 |
| X | 88475600 | 88476600 | + | int | 4829 |
| X | 88543200 | 88544600 | + | int | 4830 |
| X | 88599600 | 88601400 | + | int | 4831 |
| X | 88689400 | 88690400 | + | int | 4832 |
| X | 88925800 | 88926800 | + | int | 4833 |
| X | 88950600 | 88952000 | + | int | 4834 |
| X | 89057400 | 89058600 | + | int | 4835 |
| X | 89228600 | 89230200 | + | int | 4836 |
| X | 89288800 | 89290200 | + | int | 4837 |
| X | 89611800 | 89612800 | − | Mageb18 | 4838 |
| X | 90008400 | 90009600 | + | int | 4839 |
| X | 90123800 | 90124800 | + | int | 4840 |
| X | 90266200 | 90267400 | + | int | 4841 |
| X | 90278400 | 90280200 | + | int | 4842 |
| X | 90772600 | 90773800 | − | Pola1 | 4843 |
| X | 91557400 | 91558400 | + | int | 4844 |
| X | 91818400 | 91819400 | + | int | 4845 |
| X | 91951400 | 91952400 | + | int | 4846 |
| X | 91994800 | 91996000 | + | int | 4847 |
| X | 92256000 | 92257000 | − | Arhgef9 | 4848 |
| X | 92291200 | 92292600 | − | Arhgef9 | 4849 |
| X | 92457400 | 92458400 | + | int | 4850 |
| X | 92549600 | 92550600 | + | int | 4851 |
| X | 92709400 | 92710400 | + | int | 4852 |
| X | 93065000 | 93066000 | + | Zc3h12b | 4853 |
| X | 93099400 | 93100400 | + | Zc3h12b | 4854 |
| X | 93136800 | 93137800 | − | Las1l | 4855 |
| X | 93286600 | 93287800 | + | int | 4856 |
| X | 93403000 | 93404200 | + | int | 4857 |
| X | 93467000 | 93468000 | − | Vsig4 | 4858 |
| X | 93530000 | 93531400 | − | Hsf3 | 4859 |
| X | 93570200 | 93571400 | + | int | 4860 |
| X | 93758400 | 93759600 | + | Heph | 4861 |
| X | 93758400 | 93759600 | + | Heph | 4862 |
| X | 94092600 | 94093600 | + | int | 4863 |
| X | 94202000 | 94203000 | + | int | 4864 |
| X | 94211400 | 94212600 | + | int | 4865 |
| X | 94304000 | 94305000 | + | int | 4866 |
| X | 94563800 | 94565000 | − | Eda2r | 4867 |
| X | 94563800 | 94565000 | − | Eda2r | 4868 |
| X | 94872600 | 94873600 | + | int | 4869 |
| X | 95209800 | 95210800 | + | int | 4870 |
| X | 95242400 | 95243400 | + | int | 4871 |
| X | 95260800 | 95261800 | + | int | 4872 |
| X | 95270000 | 95271000 | + | int | 4873 |
| X | 95313200 | 95314200 | + | int | 4874 |
| X | 95386000 | 95387400 | + | Ar | 4875 |
| X | 95475600 | 95476600 | + | Ar | 4876 |
| X | 96261200 | 96262200 | + | Stard8 | 4877 |
| X | 96959600 | 96960800 | + | int | 4878 |
| X | 96975600 | 96976600 | + | int | 4879 |
| X | 97261200 | 97262800 | + | Eda | 4880 |
| X | 97261200 | 97262800 | + | Eda | 4881 |
| X | 97384000 | 97385200 | + | Eda | 4882 |
| X | 97384000 | 97385200 | + | Eda | 4883 |
| X | 97453400 | 97454800 | + | Eda | 4884 |
| X | 97453400 | 97454800 | + | Eda | 4885 |
| X | 98674600 | 98675600 | + | int | 4886 |
| X | 99763200 | 99764200 | − | Phka1 | 4887 |
| X | 100301000 | 100302400 | + | int | 4888 |
| X | 100654200 | 100656200 | + | Tsix | 4889 |
| X | 100654200 | 100656200 | − | Xist | 4890 |
| X | 100661000 | 100662000 | + | Tsix | 4891 |
| X | 100661000 | 100662000 | − | Xist | 4892 |
| X | 100663400 | 100665600 | + | Tsix | 4893 |
| X | 100663400 | 100665600 | − | Xist | 4894 |
| X | 100669800 | 100673800 | + | Tsix | 4895 |
| X | 100669800 | 100673800 | − | Xist | 4896 |
| X | 101587800 | 101588800 | − | Abcb7 | 4897 |
| X | 101833200 | 101834400 | − | Zdhhc15 | 4898 |
| X | 101962400 | 101963400 | + | int | 4899 |
| X | 102171200 | 102172400 | + | int | 4900 |
| X | 102289000 | 102290200 | + | int | 4901 |
| X | 102484000 | 102485200 | + | int | 4902 |
| X | 102497000 | 102498000 | + | int | 4903 |
| X | 102520000 | 102521000 | + | int | 4904 |
| X | 102635400 | 102636600 | + | int | 4905 |
| X | 102674800 | 102676000 | + | int | 4906 |
| X | 102820600 | 102822000 | + | int | 4907 |
| X | 102967200 | 102968200 | + | Fgf16 | 4908 |
| X | 103023000 | 103024000 | − | Atrx | 4909 |
| X | 103210600 | 103211800 | + | Cox7b | 4910 |
| X | 103861400 | 103862600 | + | Gm5127 | 4911 |
| X | 104189200 | 104190400 | + | int | 4912 |
| X | 104213400 | 104214400 | + | int | 4913 |
| X | 104574600 | 104575600 | + | int | 4914 |
| X | 105022200 | 105023200 | + | Fam46d | 4915 |
| X | 105381400 | 105382600 | + | int | 4916 |
| X | 105637200 | 105638800 | + | int | 4917 |
| X | 105700200 | 105701400 | + | int | 4918 |
| X | 105716200 | 105717200 | + | int | 4919 |
| X | 105718400 | 105719400 | + | int | 4920 |
| X | 105722200 | 105723400 | + | int | 4921 |
| X | 105742000 | 105743000 | + | int | 4922 |
| X | 105904400 | 105905800 | + | int | 4923 |
| X | 106085000 | 106086000 | + | int | 4924 |
| X | 106243400 | 106244600 | + | int | 4925 |
| X | 106652000 | 106653000 | + | int | 4926 |
| X | 106656000 | 106657000 | + | int | 4927 |
| X | 106793600 | 106795400 | + | int | 4928 |

TABLE 1-continued

| chromosome | start | stop | strand | nearest gene | ID |
|---|---|---|---|---|---|
| X | 106882000 | 106883200 | + | int | 4929 |
| X | 106952600 | 106953800 | + | int | 4930 |
| X | 107162000 | 107163000 | + | int | 4931 |
| X | 107381200 | 107382200 | + | int | 4932 |
| X | 107405800 | 107407400 | + | int | 4933 |
| X | 107409600 | 107410800 | + | int | 4934 |
| X | 107887000 | 107888000 | + | int | 4935 |
| X | 108042200 | 108043400 | + | int | 4936 |
| X | 108303200 | 108304400 | + | Cylc1 | 4937 |
| X | 108579200 | 108580600 | − | Rps6ka6 | 4938 |
| X | 108763600 | 108765000 | − | Hdx | 4939 |
| X | 108880400 | 108881600 | + | int | 4940 |
| X | 109085600 | 109086600 | + | int | 4941 |
| X | 109249600 | 109250800 | + | int | 4942 |
| X | 109468400 | 109469400 | + | Apool | 4943 |
| X | 109483800 | 109485400 | + | Apool | 4944 |
| X | 109542000 | 109543600 | + | int | 4945 |
| X | 109588800 | 109590200 | + | int | 4946 |
| X | 109631200 | 109632200 | + | 2010106E10Rik | 4947 |
| X | 109882600 | 109883600 | + | int | 4948 |
| X | 109891400 | 109892400 | + | int | 4949 |
| X | 109920000 | 109921000 | + | int | 4950 |
| X | 109960200 | 109961200 | + | int | 4951 |
| X | 110062000 | 110063000 | + | int | 4952 |
| X | 110170400 | 110171400 | − | Chm | 4953 |
| X | 110320400 | 110321600 | + | int | 4954 |
| X | 110393000 | 110394200 | + | int | 4955 |
| X | 110423800 | 110424800 | + | Dach2 | 4956 |
| X | 110423800 | 110424800 | + | Dach2 | 4957 |
| X | 110499200 | 110500200 | + | Dach2 | 4958 |
| X | 110499200 | 110500200 | + | Dach2 | 4959 |
| X | 110673200 | 110674600 | + | Dach2 | 4960 |
| X | 110673200 | 110674600 | + | Dach2 | 4961 |
| X | 110898600 | 110899800 | + | Dach2 | 4962 |
| X | 110898600 | 110899800 | + | Dach2 | 4963 |
| X | 110977200 | 110978200 | + | int | 4964 |
| X | 110987400 | 110988400 | + | int | 4965 |
| X | 111078800 | 111079800 | + | int | 4966 |
| X | 111162800 | 111164000 | + | int | 4967 |
| X | 111175800 | 111176800 | + | int | 4968 |
| X | 111181600 | 111183000 | + | int | 4969 |
| X | 111201400 | 111203000 | + | int | 4970 |
| X | 111485400 | 111486200 | + | int | 4971 |
| X | 111492600 | 111493600 | + | int | 4972 |
| X | 111798600 | 111799600 | + | int | 4973 |
| X | 111941000 | 111942400 | + | int | 4974 |
| X | 111974200 | 111975800 | + | int | 4975 |
| X | 112135600 | 112137200 | + | int | 4976 |
| X | 112353400 | 112354600 | + | int | 4977 |
| X | 112369400 | 112370400 | + | int | 4978 |
| X | 112385200 | 112386200 | + | int | 4979 |
| X | 112401800 | 112403000 | + | int | 4980 |
| X | 112570200 | 112571800 | + | int | 4981 |
| X | 112662000 | 112663200 | + | int | 4982 |
| X | 112715600 | 112716000 | + | int | 4983 |
| X | 112867400 | 112868600 | + | int | 4984 |
| X | 113168600 | 113170200 | + | int | 4985 |
| X | 113299000 | 113300000 | + | int | 4986 |
| X | 113428400 | 113429800 | + | int | 4987 |
| X | 113443400 | 113445400 | + | int | 4988 |
| X | 113557800 | 113559000 | + | int | 4989 |
| X | 113683400 | 113684400 | + | int | 4990 |
| X | 113860400 | 113861400 | + | int | 4991 |
| X | 113865600 | 113867200 | + | int | 4992 |
| X | 114020200 | 114021400 | + | int | 4993 |
| X | 114143200 | 114144400 | + | int | 4994 |
| X | 114329600 | 114330600 | + | int | 4995 |
| X | 114401800 | 114403200 | + | int | 4996 |
| X | 114691800 | 114693000 | + | int | 4997 |
| X | 114843800 | 114845400 | + | int | 4998 |
| X | 114940800 | 114942200 | + | int | 4999 |
| X | 114967200 | 114968400 | + | int | 5000 |
| X | 115330200 | 115331600 | + | int | 5001 |
| X | 115567600 | 115568800 | + | int | 5002 |
| X | 116418000 | 116419200 | + | int | 5003 |
| X | 116771400 | 116774000 | + | int | 5004 |
| X | 116966000 | 116967400 | + | int | 5005 |
| X | 117014600 | 117015800 | + | int | 5006 |
| X | 117062000 | 117063600 | + | int | 5007 |
| X | 117138000 | 117139000 | + | int | 5008 |
| X | 117225600 | 117226800 | + | int | 5009 |
| X | 117248400 | 117249600 | + | int | 5010 |
| X | 117494600 | 117496000 | + | Pcdh11x | 5011 |
| X | 117529600 | 117531000 | + | Pcdh11x | 5012 |
| X | 117622800 | 117623800 | + | Pcdh11x | 5013 |
| X | 117659600 | 117660800 | + | Pcdh11x | 5014 |
| X | 117767000 | 117768200 | + | Pcdh11x | 5015 |
| X | 117801400 | 117802800 | + | Pcdh11x | 5016 |
| X | 117962000 | 117963200 | + | Pcdh11x | 5017 |
| X | 118019000 | 118020200 | + | Pcdh11x | 5018 |
| X | 118201800 | 118202800 | + | int | 5019 |
| X | 118252000 | 118253000 | + | int | 5020 |
| X | 118389000 | 118390000 | + | int | 5021 |
| X | 118517600 | 118518800 | + | int | 5022 |
| X | 118581200 | 118582200 | + | int | 5023 |
| X | 118819000 | 118820000 | + | int | 5024 |
| X | 118867800 | 118869000 | + | int | 5025 |
| X | 118937400 | 118939000 | + | int | 5026 |
| X | 118951200 | 118952600 | + | int | 5027 |
| X | 119007200 | 119008200 | + | int | 5028 |
| X | 119088000 | 119089200 | + | int | 5029 |
| X | 119095600 | 119096600 | + | int | 5030 |
| X | 119172400 | 119174000 | + | int | 5031 |
| X | 119304000 | 119305000 | + | int | 5032 |
| X | 119358600 | 119359600 | + | int | 5033 |
| X | 119366000 | 119367600 | + | int | 5034 |
| X | 119386200 | 119387200 | + | int | 5035 |
| X | 119484800 | 119486000 | + | int | 5036 |
| X | 119557000 | 119558000 | + | int | 5037 |
| X | 119673800 | 119674800 | + | int | 5038 |
| X | 119837000 | 119838400 | + | int | 5039 |
| X | 119851400 | 119852400 | + | int | 5040 |
| X | 120000200 | 120001400 | + | int | 5041 |
| X | 120064200 | 120065600 | + | int | 5042 |
| X | 120225400 | 120226400 | + | 3110007F17Rik | 5043 |
| X | 120269400 | 120270400 | + | int | 5044 |
| X | 120439600 | 120440800 | + | int | 5045 |
| X | 120723000 | 120724200 | + | int | 5046 |
| X | 121281000 | 121282800 | + | int | 5047 |
| X | 122724400 | 122725800 | + | int | 5048 |
| X | 122729400 | 122730600 | + | int | 5049 |
| X | 122852800 | 122853800 | + | int | 5050 |
| X | 122895400 | 122896600 | + | int | 5051 |
| X | 122927000 | 122928200 | + | int | 5052 |
| X | 123022800 | 123024400 | + | int | 5053 |
| X | 123370400 | 123371600 | + | int | 5054 |
| X | 123544600 | 123546000 | + | int | 5055 |
| X | 123609600 | 123610800 | + | int | 5056 |
| X | 123720000 | 123721200 | + | int | 5057 |
| X | 123925800 | 123926800 | + | 4921511C20Rik | 5058 |
| X | 123954200 | 123955200 | + | int | 5059 |
| X | 123993200 | 123994400 | + | int | 5060 |
| X | 124035600 | 124036800 | + | int | 5061 |
| X | 124221000 | 124222200 | + | int | 5062 |
| X | 124420400 | 124421400 | + | int | 5063 |
| X | 124537000 | 124538400 | + | int | 5064 |
| X | 124545400 | 124546600 | + | int | 5065 |
| X | 124613000 | 124614200 | + | int | 5066 |
| X | 124808200 | 124809400 | + | int | 5067 |
| X | 124894400 | 124895400 | + | int | 5068 |
| X | 124900600 | 124901800 | + | int | 5069 |
| X | 124918800 | 124919800 | + | int | 5070 |
| X | 124945200 | 124946200 | + | int | 5071 |
| X | 125015800 | 125017400 | + | int | 5072 |
| X | 125422200 | 125423600 | + | int | 5073 |
| X | 125486800 | 125488200 | + | int | 5074 |
| X | 125633600 | 125635200 | + | int | 5075 |
| X | 125715400 | 125716600 | + | int | 5076 |
| X | 125781800 | 125783000 | + | int | 5077 |
| X | 125833800 | 125835400 | + | int | 5078 |
| X | 126064800 | 126065800 | + | int | 5079 |
| X | 126136200 | 126137200 | + | int | 5080 |
| X | 126161600 | 126162800 | + | int | 5081 |
| X | 126193200 | 126194200 | + | int | 5082 |

TABLE 1-continued

| chromosome | start | stop | strand | nearest gene | ID |
|---|---|---|---|---|---|
| X | 126446200 | 126447200 | + | Diap2 | 5083 |
| X | 126446200 | 126447200 | + | Diap2 | 5084 |
| X | 126715400 | 126716400 | + | Diap2 | 5085 |
| X | 126715400 | 126716400 | + | Diap2 | 5086 |
| X | 126934800 | 126936200 | + | Diap2 | 5087 |
| X | 126961400 | 126962600 | + | Diap2 | 5088 |
| X | 127374400 | 127375400 | + | int | 5089 |
| X | 127674000 | 127675200 | + | int | 5090 |
| X | 129205600 | 129206600 | + | int | 5091 |
| X | 129314400 | 129315400 | + | int | 5092 |
| X | 129422600 | 129423600 | + | int | 5093 |
| X | 129467800 | 129469000 | + | int | 5094 |
| X | 129518600 | 129519600 | + | int | 5095 |
| X | 129624400 | 129625200 | + | int | 5096 |
| X | 129640000 | 129641400 | + | int | 5097 |
| X | 129650200 | 129651200 | + | int | 5098 |
| X | 129771200 | 129772200 | + | int | 5099 |
| X | 129778600 | 129779600 | + | int | 5100 |
| X | 129826800 | 129828400 | + | int | 5101 |
| X | 130035400 | 130036800 | + | int | 5102 |
| X | 130230200 | 130231400 | + | int | 5103 |
| X | 131266200 | 131267200 | + | int | 5104 |
| X | 131504000 | 131505000 | + | int | 5105 |
| X | 131659400 | 131660600 | + | int | 5106 |
| X | 131708200 | 131709800 | − | AV320801 | 5107 |
| X | 131708200 | 131709800 | − | Gm15023 | 5108 |
| X | 131927800 | 131929000 | + | int | 5109 |
| X | 131988400 | 131989600 | + | int | 5110 |
| X | 132032000 | 132033000 | + | AV320801 | 5111 |
| X | 132032000 | 132033000 | + | Gm15023 | 5112 |
| X | 132080600 | 132081800 | + | int | 5113 |
| X | 132161400 | 132163200 | − | Prame | 5114 |
| X | 132437800 | 132438800 | + | int | 5115 |
| X | 133225600 | 133227200 | + | int | 5116 |
| X | 133406200 | 133407200 | + | int | 5117 |
| X | 133698800 | 133699800 | + | int | 5118 |
| X | 133849800 | 133850800 | + | int | 5119 |
| X | 134070000 | 134071600 | + | Il1rapl2 | 5120 |
| X | 134356200 | 134357200 | + | Il1rapl2 | 5121 |
| X | 134747200 | 134748200 | + | Il1rapl2 | 5122 |
| X | 134887800 | 134888800 | + | Il1rapl2 | 5123 |
| X | 134905800 | 134907000 | + | Il1rapl2 | 5124 |
| X | 135011200 | 135012600 | + | Il1rapl2 | 5125 |
| X | 135234400 | 135235600 | + | Il1rapl2 | 5126 |
| X | 135553200 | 135554200 | + | int | 5127 |
| X | 136506400 | 136507400 | − | Rbm41 | 5128 |
| X | 136506400 | 136507400 | − | Rbm41 | 5129 |
| X | 137787800 | 137788800 | − | Col4a6 | 5130 |
| X | 137930600 | 137932000 | + | Col4a5 | 5131 |
| X | 137947800 | 137949000 | + | Col4a5 | 5132 |
| X | 137954400 | 137955600 | + | Col4a5 | 5133 |
| X | 138325800 | 138327000 | + | int | 5134 |
| X | 138623400 | 138624600 | − | Gucy2f | 5135 |
| X | 139189600 | 139190800 | + | Tmem164 | 5136 |
| X | 139639800 | 139640800 | + | int | 5137 |
| X | 140127200 | 140128200 | + | Pak3 | 5138 |
| X | 141391400 | 141392400 | + | Zcchc16 | 5139 |
| X | 141395200 | 141396400 | + | Zcchc16 | 5140 |
| X | 141636000 | 141637000 | + | int | 5141 |
| X | 142038200 | 142039200 | + | int | 5142 |
| X | 142432400 | 142433400 | + | int | 5143 |
| X | 142602600 | 142603800 | + | int | 5144 |
| X | 142643400 | 142644400 | + | int | 5145 |
| X | 142706600 | 142707800 | + | int | 5146 |
| X | 142942800 | 142944000 | + | int | 5147 |
| X | 142953400 | 142955000 | + | int | 5148 |
| X | 143098600 | 143100000 | + | int | 5149 |
| X | 143154800 | 143155400 | + | int | 5150 |
| X | 143991200 | 143992200 | − | Lrch2 | 5151 |
| X | 145108600 | 145109800 | + | Gm15127 | 5152 |
| X | 145248800 | 145250000 | + | int | 5153 |
| X | 146206800 | 146208000 | + | int | 5154 |
| X | 146537400 | 146538800 | + | int | 5155 |
| X | 146775600 | 146776600 | + | int | 5156 |
| X | 146882800 | 146883800 | − | Tmem29 | 5157 |
| X | 147586400 | 147587400 | + | int | 5158 |
| X | 148261800 | 148262800 | + | Huwe1 | 5159 |
| X | 148272200 | 148273200 | + | Huwe1 | 5160 |
| X | 149103000 | 149104000 | − | Shroom2 | 5161 |
| X | 149352200 | 149353800 | + | int | 5162 |
| X | 149416800 | 149417800 | + | int | 5163 |
| X | 149421200 | 149422600 | + | int | 5164 |
| X | 149574200 | 149575200 | + | Rragb | 5165 |
| X | 149985800 | 149986800 | + | int | 5166 |
| X | 150014000 | 150015600 | + | int | 5167 |
| X | 150165000 | 150166000 | + | 2210013O21Rik | 5168 |
| X | 150355800 | 150356800 | + | int | 5169 |
| X | 150570800 | 150572000 | + | int | 5170 |
| X | 151119000 | 151120200 | + | int | 5171 |
| X | 151307000 | 151308000 | + | int | 5172 |
| X | 151472000 | 151473400 | + | int | 5173 |
| X | 152148400 | 152149600 | + | int | 5174 |
| X | 152249200 | 152250400 | + | int | 5175 |
| X | 152607600 | 152608600 | + | int | 5176 |
| X | 152652000 | 152653000 | + | int | 5177 |
| X | 152679000 | 152680400 | + | int | 5178 |
| X | 152839200 | 152840200 | + | int | 5179 |
| X | 152902600 | 152903800 | + | int | 5180 |
| X | 152925600 | 152926800 | + | int | 5181 |
| X | 153057200 | 153058200 | + | int | 5182 |
| X | 153083600 | 153085000 | + | int | 5183 |
| X | 153234600 | 153236000 | + | int | 5184 |
| X | 153373000 | 153374400 | + | int | 5185 |
| X | 153680600 | 153681800 | − | Phex | 5186 |
| X | 153753200 | 153754400 | − | Phex | 5187 |
| X | 153889800 | 153890800 | − | Sms | 5188 |
| X | 154006000 | 154007200 | − | Mbtps2 | 5189 |
| X | 154006000 | 154007200 | − | Yy2 | 5190 |
| X | 154309400 | 154310400 | − | Cnksr2 | 5191 |
| X | 154377000 | 154378000 | − | Cnksr2 | 5192 |
| X | 154602400 | 154603400 | + | int | 5193 |
| X | 154631200 | 154632200 | + | int | 5194 |
| X | 154995200 | 154997000 | + | int | 5195 |
| X | 155565600 | 155566600 | + | int | 5196 |
| X | 155995400 | 155996600 | + | A830080D01Rik | 5197 |
| X | 156445800 | 156447000 | + | Map3k15 | 5198 |
| X | 160932800 | 160934000 | + | Asb9 | 5199 |
| X | 161048200 | 161049400 | + | int | 5200 |
| X | 161197000 | 161198600 | + | int | 5201 |
| X | 161216400 | 161217600 | + | int | 5202 |
| X | 161525000 | 161527000 | + | int | 5203 |
| X | 161677200 | 161678200 | − | Glra2 | 5204 |
| X | 161935600 | 161936600 | + | int | 5205 |
| X | 162035800 | 162037200 | + | int | 5206 |
| X | 162218000 | 162219200 | + | int | 5207 |
| X | 162243800 | 162245200 | + | int | 5208 |
| X | 162312000 | 162313200 | + | int | 5209 |
| X | 162365200 | 162366200 | + | int | 5210 |
| X | 162705600 | 162706600 | + | Gpm6b | 5211 |
| X | 163272000 | 163273400 | + | int | 5212 |
| X | 164877200 | 164878200 | − | Frmpd4 | 5213 |
| X | 164946000 | 164947200 | − | Frmpd4 | 5214 |
| X | 165025400 | 165026400 | + | int | 5215 |
| X | 165887600 | 165888600 | + | int | 5216 |
| X | 166426600 | 166428200 | + | Mid1 | 5217 |
| X | 166426600 | 166428200 | + | Mid1 | 5218 |
| X | 166429800 | 166433600 | + | int | 5219 |
| X | 166440000 | 166441200 | + | int | 5220 |
| X | 166442600 | 166443600 | + | int | 5221 |
| X | 166445400 | 166446400 | + | int | 5222 |
| X | 166500600 | 166501800 | + | int | 5223 |
| X | 166507400 | 166509200 | + | int | 5224 |
| X | 166585800 | 166587600 | + | int | 5225 |
| X | 166597200 | 166598200 | + | int | 5226 |
| X | 166600600 | 166601600 | + | int | 5227 |
| X | 166611600 | 166612600 | + | int | 5228 |
| X | 166628200 | 166631800 | + | int | 5229 |

TABLE 2

| chromosome | start | stop | strand | nearest gene | ID |
|---|---|---|---|---|---|
| 1 | 62925 | 63859 | + | int | 5230 |
| 1 | 1269141 | 1270483 | + | TAS1R3 | 5231 |
| 1 | 1718247 | 1720713 | − | GNB1 | 5232 |
| 1 | 2361248 | 2362574 | + | int | 5233 |
| 1 | 2429859 | 2431920 | + | PLCH2 | 5234 |
| 1 | 4580506 | 4581081 | + | int | 5235 |
| 1 | 5407372 | 5409386 | + | int | 5236 |
| 1 | 6100618 | 6101819 | + | KCNAB2 | 5237 |
| 1 | 6100618 | 6101819 | + | KCNAB2 | 5238 |
| 1 | 6100618 | 6101819 | + | KCNAB2 | 5239 |
| 1 | 6697907 | 6698543 | − | DNAJC11 | 5240 |
| 1 | 7681658 | 7682868 | + | CAMTA1 | 5241 |
| 1 | 8130448 | 8131247 | + | int | 5242 |
| 1 | 8395005 | 8395834 | + | SLC45A1 | 5243 |
| 1 | 9833148 | 9839195 | − | CLSTN1 | 5244 |
| 1 | 10238942 | 10239998 | + | UBE4B | 5245 |
| 1 | 12017859 | 12018961 | + | PLOD1 | 5246 |
| 1 | 14013613 | 14014205 | + | int | 5247 |
| 1 | 15649180 | 15650322 | + | FHAD1 | 5248 |
| 1 | 16372322 | 16374449 | + | CLCNKB | 5249 |
| 1 | 17260007 | 17260794 | + | CROCC | 5250 |
| 1 | 17901418 | 17902508 | + | ARHGEF10L | 5251 |
| 1 | 18632407 | 18633383 | + | IGSF21 | 5252 |
| 1 | 19934590 | 19935124 | + | C1orf151-NBL1 | 5253 |
| 1 | 19934590 | 19935124 | + | MINOS1 | 5254 |
| 1 | 20102316 | 20106014 | − | TMCO4 | 5255 |
| 1 | 23743330 | 23743706 | − | TCEA3 | 5256 |
| 1 | 26099805 | 26100375 | + | MAN1C1 | 5257 |
| 1 | 26139767 | 26140679 | + | SEPN1 | 5258 |
| 1 | 27226401 | 27226983 | − | GPATCH3 | 5259 |
| 1 | 31836876 | 31837408 | + | ZCCHC17 | 5260 |
| 1 | 32138278 | 32139327 | − | COL16A1 | 5261 |
| 1 | 32799624 | 32801606 | − | MARCKSL1 | 5262 |
| 1 | 33086613 | 33087181 | + | int | 5263 |
| 1 | 34635784 | 34636297 | + | C1orf94 | 5264 |
| 1 | 36027860 | 36028433 | + | NCDN | 5265 |
| 1 | 39134892 | 39135954 | + | int | 5266 |
| 1 | 41316882 | 41317594 | + | int | 5267 |
| 1 | 49259352 | 49260498 | − | AGBL4 | 5268 |
| 1 | 58877152 | 58878087 | + | int | 5269 |
| 1 | 59465285 | 59466321 | + | int | 5270 |
| 1 | 59564184 | 59565067 | + | int | 5271 |
| 1 | 64095094 | 64095217 | + | PGM1 | 5272 |
| 1 | 64095094 | 64095217 | + | PGM1 | 5273 |
| 1 | 64095094 | 64095217 | + | PGM1 | 5274 |
| 1 | 64125220 | 64125793 | + | PGM1 | 5275 |
| 1 | 64125220 | 64125793 | + | PGM1 | 5276 |
| 1 | 64125220 | 64125793 | + | PGM1 | 5277 |
| 1 | 64500904 | 64503088 | + | ROR1 | 5278 |
| 1 | 64500904 | 64503088 | + | ROR1 | 5279 |
| 1 | 65138531 | 65139380 | + | CACHD1 | 5280 |
| 1 | 69286915 | 69287593 | + | int | 5281 |
| 1 | 69412404 | 69412973 | + | int | 5282 |
| 1 | 70254124 | 70254724 | + | LRRC7 | 5283 |
| 1 | 73423014 | 73423184 | + | int | 5284 |
| 1 | 73520373 | 73521415 | + | int | 5285 |
| 1 | 73592323 | 73592596 | + | int | 5286 |
| 1 | 73870884 | 73872562 | + | int | 5287 |
| 1 | 75139852 | 75140620 | + | int | 5288 |
| 1 | 76773961 | 76775053 | + | ST6GALNAC3 | 5289 |
| 1 | 76773961 | 76775053 | + | ST6GALNAC3 | 5290 |
| 1 | 77165462 | 77166393 | + | int | 5291 |
| 1 | 77166073 | 77166699 | + | int | 5292 |
| 1 | 77366563 | 77367973 | + | ST6GALNAC5 | 5293 |
| 1 | 77594763 | 77595396 | − | PIGK | 5294 |
| 1 | 78561337 | 78562144 | + | GIPC2 | 5295 |
| 1 | 81163829 | 81164857 | + | int | 5296 |
| 1 | 81513625 | 81514317 | + | int | 5297 |
| 1 | 82338448 | 82339381 | + | LPHN2 | 5298 |
| 1 | 82553856 | 82554077 | + | int | 5299 |
| 1 | 83190610 | 83193264 | + | int | 5300 |
| 1 | 83501804 | 83502175 | + | int | 5301 |
| 1 | 83988311 | 83988698 | + | int | 5302 |
| 1 | 86621339 | 86622361 | − | COL24A1 | 5303 |
| 1 | 87104398 | 87105427 | + | CLCA3P | 5304 |
| 1 | 87665649 | 87666451 | + | int | 5305 |
| 1 | 89237196 | 89238345 | + | PKN2 | 5306 |
| 1 | 95713423 | 95713921 | + | int | 5307 |

TABLE 2-continued

| chromosome | start | stop | strand | nearest gene | ID |
|---|---|---|---|---|---|
| 1 | 96035938 | 96036972 | + | int | 5308 |
| 1 | 96575052 | 96575735 | + | int | 5309 |
| 1 | 98005281 | 98005499 | − | DPYD | 5310 |
| 1 | 98100045 | 98101075 | − | DPYD | 5311 |
| 1 | 98116801 | 98117768 | − | DPYD | 5312 |
| 1 | 98248130 | 98248310 | − | DPYD | 5313 |
| 1 | 98248130 | 98248310 | − | DPYD | 5314 |
| 1 | 99597966 | 99598085 | + | LOC100129620 | 5315 |
| 1 | 101074590 | 101075887 | + | int | 5316 |
| 1 | 102655747 | 102656554 | + | int | 5317 |
| 1 | 102785851 | 102786365 | + | int | 5318 |
| 1 | 103042793 | 103043087 | + | int | 5319 |
| 1 | 103189222 | 103189483 | + | int | 5320 |
| 1 | 103916327 | 103916671 | + | int | 5321 |
| 1 | 103968461 | 103969172 | + | int | 5322 |
| 1 | 104574457 | 104574923 | + | int | 5323 |
| 1 | 104811182 | 104811635 | + | int | 5324 |
| 1 | 106837670 | 106838525 | + | int | 5325 |
| 1 | 108854727 | 108855041 | + | int | 5326 |
| 1 | 109322026 | 109322782 | + | STXBP3 | 5327 |
| 1 | 109352245 | 109352551 | + | int | 5328 |
| 1 | 110223508 | 110223826 | + | GSTM2 | 5329 |
| 1 | 110824486 | 110826036 | + | int | 5330 |
| 1 | 112959896 | 112960298 | + | CTTNBP2NL | 5331 |
| 1 | 113132382 | 113133165 | − | ST7L | 5332 |
| 1 | 113132382 | 113133165 | − | ST7L | 5333 |
| 1 | 113676496 | 113677232 | + | int | 5334 |
| 1 | 113983467 | 113983910 | + | MAGI3 | 5335 |
| 1 | 117010815 | 117011456 | + | int | 5336 |
| 1 | 117249110 | 117250402 | + | int | 5337 |
| 1 | 117866547 | 117867704 | + | int | 5338 |
| 1 | 118953136 | 118953963 | + | int | 5339 |
| 1 | 118965396 | 118966501 | + | int | 5340 |
| 1 | 119803349 | 119804254 | + | int | 5341 |
| 1 | 120185631 | 120186892 | − | ZNF697 | 5342 |
| 1 | 120263786 | 120279827 | + | PHGDH | 5343 |
| 1 | 143898151 | 143899226 | − | FAM72D | 5344 |
| 1 | 145693257 | 145693705 | + | int | 5345 |
| 1 | 150744176 | 150744317 | + | int | 5346 |
| 1 | 150776415 | 150777080 | − | CTSK | 5347 |
| 1 | 151134323 | 151138465 | + | TNFAIP8L2-SCNM1 | 5348 |
| 1 | 151134323 | 151138465 | − | LYSMD1 | 5349 |
| 1 | 151134323 | 151138465 | − | LYSMD1 | 5350 |
| 1 | 152079633 | 152080708 | − | TCHH | 5351 |
| 1 | 156125160 | 156127864 | + | SEMA4A | 5352 |
| 1 | 156125160 | 156127864 | + | SEMA4A | 5353 |
| 1 | 156125160 | 156127864 | + | SEMA4A | 5354 |
| 1 | 157840185 | 157841465 | + | int | 5355 |
| 1 | 160492621 | 160493124 | − | SLAMF6 | 5356 |
| 1 | 161811876 | 161812052 | + | ATF6 | 5357 |
| 1 | 162824071 | 162825118 | − | C1orf110 | 5358 |
| 1 | 164237773 | 164238041 | + | int | 5359 |
| 1 | 165178317 | 165180116 | − | LMX1A | 5360 |
| 1 | 165178317 | 165180116 | − | LMX1A | 5361 |
| 1 | 166171383 | 166172403 | + | int | 5362 |
| 1 | 166245049 | 166246428 | + | int | 5363 |
| 1 | 167025391 | 167026778 | − | GPA33 | 5364 |
| 1 | 167267423 | 167267720 | + | POU2F1 | 5365 |
| 1 | 167267423 | 167267720 | + | POU2F1 | 5366 |
| 1 | 167887316 | 167889902 | − | MPC2 | 5367 |
| 1 | 167887316 | 167889902 | − | MPC2 | 5368 |
| 1 | 168169442 | 168169675 | + | TIPRL | 5369 |
| 1 | 170129256 | 170130490 | + | METTL11B | 5370 |
| 1 | 170788689 | 170789084 | + | int | 5371 |
| 1 | 175946714 | 175947029 | − | RFWD2 | 5372 |
| 1 | 178229080 | 178229672 | + | RASAL2 | 5373 |
| 1 | 181668542 | 181668658 | + | CACNA1E | 5374 |
| 1 | 182092214 | 182094219 | + | int | 5375 |
| 1 | 182960047 | 182960566 | + | int | 5376 |
| 1 | 185136994 | 185137381 | + | SWT1 | 5377 |
| 1 | 185136994 | 185137381 | + | SWT1 | 5378 |
| 1 | 186044972 | 186046518 | + | HMCN1 | 5379 |
| 1 | 186044972 | 186046518 | − | MIR548F1 | 5380 |
| 1 | 186323457 | 186324486 | − | MIR548F1 | 5381 |
| 1 | 186323457 | 186324486 | − | TPR | 5382 |
| 1 | 187007776 | 187008767 | + | int | 5383 |
| 1 | 188410834 | 188411230 | + | int | 5384 |

TABLE 2-continued

| chromosome | start | stop | strand | nearest gene | ID |
|---|---|---|---|---|---|
| 1 | 189781599 | 189782057 | + | int | 5385 |
| 1 | 191827120 | 191827308 | + | int | 5386 |
| 1 | 192104764 | 192107246 | + | int | 5387 |
| 1 | 193836227 | 193837382 | + | int | 5388 |
| 1 | 194277443 | 194278906 | + | int | 5389 |
| 1 | 194435095 | 194435736 | + | int | 5390 |
| 1 | 194689780 | 194690347 | + | int | 5391 |
| 1 | 194851222 | 194851407 | + | int | 5392 |
| 1 | 195401643 | 195401978 | + | int | 5393 |
| 1 | 195685711 | 195685935 | + | int | 5394 |
| 1 | 196646415 | 196646853 | + | CFH | 5395 |
| 1 | 196646415 | 196646853 | + | CFH | 5396 |
| 1 | 196646422 | 196646853 | + | CFH | 5397 |
| 1 | 196646422 | 196646853 | + | CFH | 5398 |
| 1 | 196651723 | 196652124 | + | CFH | 5399 |
| 1 | 196651723 | 196652124 | + | CFH | 5400 |
| 1 | 197297556 | 197298144 | + | CRB1 | 5401 |
| 1 | 197297556 | 197298144 | + | CRB1 | 5402 |
| 1 | 197871872 | 197872822 | + | C1orf53 | 5403 |
| 1 | 197910575 | 197911360 | + | int | 5404 |
| 1 | 199493175 | 199494058 | + | int | 5405 |
| 1 | 199730342 | 199731309 | + | int | 5406 |
| 1 | 199922816 | 199924442 | + | int | 5407 |
| 1 | 200047960 | 200049194 | + | NR5A2 | 5408 |
| 1 | 202512555 | 202513359 | + | PPP1R12B | 5409 |
| 1 | 202512555 | 202513359 | + | PPP1R12B | 5410 |
| 1 | 202512555 | 202513359 | + | PPP1R12B | 5411 |
| 1 | 202636522 | 202637973 | − | SYT2 | 5412 |
| 1 | 202934995 | 202936351 | − | CYB5R1 | 5413 |
| 1 | 203613813 | 203614514 | + | ATP2B4 | 5414 |
| 1 | 204839101 | 204840275 | + | NFASC | 5415 |
| 1 | 204839101 | 204840275 | + | NFASC | 5416 |
| 1 | 208169087 | 208169565 | + | int | 5417 |
| 1 | 209938164 | 209940648 | + | TRAF3IP3 | 5418 |
| 1 | 211380408 | 211381367 | + | int | 5419 |
| 1 | 212442971 | 212443782 | + | int | 5420 |
| 1 | 212617571 | 212618300 | + | NENF | 5421 |
| 1 | 212672920 | 212673672 | + | int | 5422 |
| 1 | 212844920 | 212845584 | + | int | 5423 |
| 1 | 213141900 | 213143218 | + | VASH2 | 5424 |
| 1 | 213167017 | 213168128 | − | ANGEL2 | 5425 |
| 1 | 213859018 | 213860672 | + | int | 5426 |
| 1 | 215089799 | 215090913 | + | int | 5427 |
| 1 | 216737579 | 216738597 | − | ESRRG | 5428 |
| 1 | 216737579 | 216738597 | − | ESRRG | 5429 |
| 1 | 216737579 | 216738597 | − | ESRRG | 5430 |
| 1 | 216737579 | 216738597 | − | ESRRG | 5431 |
| 1 | 216737579 | 216738597 | − | ESRRG | 5432 |
| 1 | 216737579 | 216738597 | − | ESRRG | 5433 |
| 1 | 216737579 | 216738597 | − | ESRRG | 5434 |
| 1 | 216737579 | 216738597 | − | ESRRG | 5435 |
| 1 | 216773033 | 216774789 | − | ESRRG | 5436 |
| 1 | 216773033 | 216774789 | − | ESRRG | 5437 |
| 1 | 216773033 | 216774789 | − | ESRRG | 5438 |
| 1 | 216773033 | 216774789 | − | ESRRG | 5439 |
| 1 | 216773033 | 216774789 | − | ESRRG | 5440 |
| 1 | 216773033 | 216774789 | − | ESRRG | 5441 |
| 1 | 216773033 | 216774789 | − | ESRRG | 5442 |
| 1 | 216773033 | 216774789 | − | ESRRG | 5443 |
| 1 | 220426919 | 220427424 | − | RAB3GAP2 | 5444 |
| 1 | 221020266 | 221020413 | + | int | 5445 |
| 1 | 222405247 | 222405962 | + | int | 5446 |
| 1 | 223254506 | 223254968 | + | int | 5447 |
| 1 | 223516993 | 223518250 | − | SUSD4 | 5448 |
| 1 | 223516993 | 223518250 | − | SUSD4 | 5449 |
| 1 | 223686495 | 223687136 | + | int | 5450 |
| 1 | 224861212 | 224862414 | + | CNIH3 | 5451 |
| 1 | 228502050 | 228503198 | + | OBSCN | 5452 |
| 1 | 228502050 | 228503198 | + | OBSCN | 5453 |
| 1 | 230886293 | 230886636 | + | CAPN9 | 5454 |
| 1 | 230886293 | 230886636 | + | CAPN9 | 5455 |
| 1 | 231701116 | 231701910 | + | TSNAX | 5456 |
| 1 | 231701116 | 231701910 | + | TSNAX-DISC1 | 5457 |
| 1 | 231701116 | 231701910 | + | TSNAX-DISC1 | 5458 |
| 1 | 231701116 | 231701910 | + | TSNAX-DISC1 | 5459 |
| 1 | 231701116 | 231701910 | + | TSNAX-DISC1 | 5460 |
| 1 | 233178374 | 233181335 | − | PCNXL2 | 5461 |
| 1 | 234657062 | 234658610 | + | int | 5462 |

TABLE 2-continued

| chromosome | start | stop | strand | nearest gene | ID |
|---|---|---|---|---|---|
| 1 | 236647030 | 236648184 | + | EDARADD | 5463 |
| 1 | 236647030 | 236648184 | + | EDARADD | 5464 |
| 1 | 236647192 | 236648123 | + | EDARADD | 5465 |
| 1 | 236647192 | 236648123 | + | EDARADD | 5466 |
| 1 | 240676903 | 240679934 | − | GREM2 | 5467 |
| 1 | 240946576 | 240948759 | − | RGS7 | 5468 |
| 1 | 243780378 | 243780722 | − | AKT3 | 5469 |
| 1 | 243780378 | 243780722 | − | AKT3 | 5470 |
| 1 | 243780378 | 243780722 | − | AKT3 | 5471 |
| 1 | 244106774 | 244107910 | + | LOC339529 | 5472 |
| 1 | 244534540 | 244535400 | + | C1orf100 | 5473 |
| 1 | 245244002 | 245245639 | + | EFCAB2 | 5474 |
| 1 | 245244002 | 245245639 | + | EFCAB2 | 5475 |
| 1 | 245244002 | 245245639 | + | EFCAB2 | 5476 |
| 1 | 245244002 | 245245639 | + | EFCAB2 | 5477 |
| 1 | 247782966 | 247783842 | + | int | 5478 |
| 1 | 247938064 | 247939521 | + | int | 5479 |
| 2 | 2810598 | 2811358 | + | int | 5480 |
| 2 | 3097980 | 3099705 | + | int | 5481 |
| 2 | 4118569 | 4119615 | + | int | 5482 |
| 2 | 5756085 | 5756909 | + | int | 5483 |
| 2 | 6510814 | 6511877 | + | int | 5484 |
| 2 | 7592590 | 7593545 | + | int | 5485 |
| 2 | 9328189 | 9328480 | + | int | 5486 |
| 2 | 9340151 | 9340763 | + | int | 5487 |
| 2 | 9346016 | 9347428 | + | ASAP2 | 5488 |
| 2 | 9346179 | 9346415 | + | int | 5489 |
| 2 | 9346692 | 9347428 | + | ASAP2 | 5490 |
| 2 | 9352889 | 9353704 | + | ASAP2 | 5491 |
| 2 | 10544645 | 10545182 | + | HPCAL1 | 5492 |
| 2 | 10544645 | 10545182 | + | HPCAL1 | 5493 |
| 2 | 10544645 | 10545182 | + | HPCAL1 | 5494 |
| 2 | 10544645 | 10545182 | + | HPCAL1 | 5495 |
| 2 | 10544645 | 10545182 | + | HPCAL1 | 5496 |
| 2 | 10549344 | 10550855 | + | HPCAL1 | 5497 |
| 2 | 10549344 | 10550855 | + | HPCAL1 | 5498 |
| 2 | 10549344 | 10550855 | + | HPCAL1 | 5499 |
| 2 | 10549344 | 10550855 | + | HPCAL1 | 5500 |
| 2 | 10549344 | 10550855 | + | HPCAL1 | 5501 |
| 2 | 10550855 | 10551118 | + | HPCAL1 | 5502 |
| 2 | 10550855 | 10551118 | + | HPCAL1 | 5503 |
| 2 | 10550855 | 10551118 | + | HPCAL1 | 5504 |
| 2 | 10550855 | 10551118 | + | HPCAL1 | 5505 |
| 2 | 10550855 | 10551118 | + | HPCAL1 | 5506 |
| 2 | 10562894 | 10563470 | + | HPCAL1 | 5507 |
| 2 | 10562894 | 10563470 | + | HPCAL1 | 5508 |
| 2 | 10562894 | 10563470 | + | HPCAL1 | 5509 |
| 2 | 10562894 | 10563470 | + | HPCAL1 | 5510 |
| 2 | 10562894 | 10563470 | + | HPCAL1 | 5511 |
| 2 | 11102933 | 11103733 | + | int | 5512 |
| 2 | 11936082 | 11938813 | + | LPIN1 | 5513 |
| 2 | 11936082 | 11938813 | + | LPIN1 | 5514 |
| 2 | 11936082 | 11938813 | + | LPIN1 | 5515 |
| 2 | 13283814 | 13284133 | + | int | 5516 |
| 2 | 13706520 | 13706897 | + | int | 5517 |
| 2 | 13975980 | 13976272 | + | int | 5518 |
| 2 | 14746121 | 14747130 | + | int | 5519 |
| 2 | 18962915 | 18963945 | + | int | 5520 |
| 2 | 19314511 | 19315248 | + | int | 5521 |
| 2 | 21099734 | 21100233 | + | int | 5522 |
| 2 | 22974095 | 22975110 | + | int | 5523 |
| 2 | 23556578 | 23557580 | + | int | 5524 |
| 2 | 35254552 | 35254696 | + | int | 5525 |
| 2 | 35428638 | 35428996 | + | int | 5526 |
| 2 | 35675351 | 35675774 | + | int | 5527 |
| 2 | 42290524 | 42291636 | + | int | 5528 |
| 2 | 44145147 | 44145525 | − | LRPPRC | 5529 |
| 2 | 44461058 | 44461202 | + | PPM1B | 5530 |
| 2 | 50304232 | 50304673 | − | NRXN1 | 5531 |
| 2 | 50304232 | 50304673 | − | NRXN1 | 5532 |
| 2 | 50541257 | 50541432 | − | NRXN1 | 5533 |
| 2 | 50541257 | 50541432 | − | NRXN1 | 5534 |
| 2 | 51346766 | 51347485 | + | int | 5535 |
| 2 | 51808093 | 51809454 | + | int | 5536 |
| 2 | 52052761 | 52053236 | + | int | 5537 |
| 2 | 52431854 | 52432217 | + | int | 5538 |
| 2 | 52824373 | 52825346 | + | int | 5539 |
| 2 | 52963260 | 52963505 | + | int | 5540 |

TABLE 2-continued

| chromosome | start | stop | strand | nearest gene | ID |
|---|---|---|---|---|---|
| 2 | 52990864 | 52991399 | + | int | 5541 |
| 2 | 55561419 | 55562426 | − | CCDC88A | 5542 |
| 2 | 56671889 | 56672074 | + | int | 5543 |
| 2 | 57675062 | 57675364 | + | int | 5544 |
| 2 | 57934140 | 57934515 | + | int | 5545 |
| 2 | 58386832 | 58386900 | + | VRK2 | 5546 |
| 2 | 58386832 | 58386900 | + | VRK2 | 5547 |
| 2 | 58386832 | 58386900 | − | FANCL | 5548 |
| 2 | 59251560 | 59252700 | + | FLJ30838 | 5549 |
| 2 | 59480213 | 59480707 | + | int | 5550 |
| 2 | 64052417 | 64052566 | + | int | 5551 |
| 2 | 66036593 | 66037591 | + | int | 5552 |
| 2 | 68347533 | 68348523 | + | int | 5553 |
| 2 | 68482198 | 68483520 | + | int | 5554 |
| 2 | 71234325 | 71235610 | + | int | 5555 |
| 2 | 74041965 | 74042614 | + | C2orf78 | 5556 |
| 2 | 75548626 | 75550042 | + | int | 5557 |
| 2 | 79249325 | 79250397 | + | int | 5558 |
| 2 | 79911946 | 79913406 | + | CTNNA2 | 5559 |
| 2 | 81206364 | 81207077 | + | int | 5560 |
| 2 | 82457717 | 82458506 | + | int | 5561 |
| 2 | 83089000 | 83090081 | + | int | 5562 |
| 2 | 83157658 | 83158275 | + | int | 5563 |
| 2 | 83749237 | 83750029 | + | int | 5564 |
| 2 | 85568396 | 85569005 | + | int | 5565 |
| 2 | 85858114 | 85860609 | + | USP39 | 5566 |
| 2 | 85858114 | 85860609 | + | USP39 | 5567 |
| 2 | 85858114 | 85860609 | + | USP39 | 5568 |
| 2 | 89952644 | 89953446 | + | int | 5569 |
| 2 | 97503172 | 97504334 | − | ANKRD23 | 5570 |
| 2 | 103294629 | 103295231 | + | SLC9A2 | 5571 |
| 2 | 106271853 | 106272184 | + | int | 5572 |
| 2 | 109300752 | 109301535 | + | LIMS1 | 5573 |
| 2 | 109300752 | 109301535 | + | LIMS1 | 5574 |
| 2 | 109300752 | 109301535 | + | LIMS1 | 5575 |
| 2 | 109300752 | 109301535 | + | LIMS1 | 5576 |
| 2 | 109300752 | 109301535 | + | LIMS1 | 5577 |
| 2 | 109300752 | 109301535 | + | LIMS1 | 5578 |
| 2 | 109872967 | 109874062 | + | SH3RF3 | 5579 |
| 2 | 110922133 | 110922802 | − | NPHP1 | 5580 |
| 2 | 113790622 | 113791455 | − | IL36B | 5581 |
| 2 | 113790622 | 113791455 | − | IL36B | 5582 |
| 2 | 115787274 | 115787902 | + | DPP10 | 5583 |
| 2 | 115787274 | 115787902 | + | DPP10 | 5584 |
| 2 | 116237740 | 116238632 | + | DPP10 | 5585 |
| 2 | 116237740 | 116238632 | + | DPP10 | 5586 |
| 2 | 116237740 | 116238632 | + | DPP10 | 5587 |
| 2 | 116237740 | 116238632 | + | DPP10 | 5588 |
| 2 | 116237740 | 116238632 | + | DPP10 | 5589 |
| 2 | 119914332 | 119915339 | − | C1QL2 | 5590 |
| 2 | 120464856 | 120466170 | + | int | 5591 |
| 2 | 121229781 | 121230149 | + | int | 5592 |
| 2 | 121856871 | 121857681 | + | int | 5593 |
| 2 | 123333041 | 123333382 | + | int | 5594 |
| 2 | 124122162 | 124122541 | + | int | 5595 |
| 2 | 125594590 | 125595688 | + | CNTNAP5 | 5596 |
| 2 | 126310898 | 126311093 | + | int | 5597 |
| 2 | 128183334 | 128183945 | + | PROC | 5598 |
| 2 | 129986006 | 129986499 | + | int | 5599 |
| 2 | 133317407 | 133318361 | + | GPR39 | 5600 |
| 2 | 135015861 | 135017307 | + | MGAT5 | 5601 |
| 2 | 137200000 | 137201169 | + | int | 5602 |
| 2 | 137369230 | 137370544 | + | int | 5603 |
| 2 | 137408409 | 137409442 | + | int | 5604 |
| 2 | 137813826 | 137814843 | + | THSD7B | 5605 |
| 2 | 138601734 | 138602206 | + | int | 5606 |
| 2 | 138604738 | 138605115 | + | int | 5607 |
| 2 | 139068918 | 139069725 | + | int | 5608 |
| 2 | 139542443 | 139543930 | + | int | 5609 |
| 2 | 140381445 | 140381635 | + | int | 5610 |
| 2 | 140388868 | 140389051 | + | int | 5611 |
| 2 | 141013697 | 141014027 | − | LRP1B | 5612 |
| 2 | 142309438 | 142310442 | − | LRP1B | 5613 |
| 2 | 142948108 | 142949384 | + | int | 5614 |
| 2 | 143687830 | 143697550 | + | KYNU | 5615 |
| 2 | 143687830 | 143697550 | + | KYNU | 5616 |
| 2 | 144226232 | 144226525 | + | ARHGAP15 | 5617 |
| 2 | 145161563 | 145162567 | − | ZEB2 | 5618 |

TABLE 2-continued

| chromosome | start | stop | strand | nearest gene | ID |
|---|---|---|---|---|---|
| 2 | 145599465 | 145599724 | + | DKFZp686O1327 | 5619 |
| 2 | 146423248 | 146423689 | + | int | 5620 |
| 2 | 146741340 | 146742451 | + | int | 5621 |
| 2 | 147443378 | 147443576 | + | int | 5622 |
| 2 | 147444957 | 147445159 | + | int | 5623 |
| 2 | 148794804 | 148794912 | + | MBD5 | 5624 |
| 2 | 150069506 | 150071120 | + | LYPD6B | 5625 |
| 2 | 150117925 | 150118988 | + | int | 5626 |
| 2 | 150478452 | 150479578 | + | int | 5627 |
| 2 | 152041455 | 152041721 | + | int | 5628 |
| 2 | 152302857 | 152308349 | + | RIF1 | 5629 |
| 2 | 152302857 | 152308349 | + | RIF1 | 5630 |
| 2 | 152302857 | 152308349 | + | RIF1 | 5631 |
| 2 | 154817715 | 154818597 | + | GALNT13 | 5632 |
| 2 | 155089140 | 155089662 | + | GALNT13 | 5633 |
| 2 | 155193356 | 155194698 | + | GALNT13 | 5634 |
| 2 | 155431237 | 155431831 | + | int | 5635 |
| 2 | 156238769 | 156240111 | + | int | 5636 |
| 2 | 156250920 | 156251954 | + | int | 5637 |
| 2 | 156548285 | 156548624 | + | int | 5638 |
| 2 | 157009105 | 157009874 | + | int | 5639 |
| 2 | 159068206 | 159068537 | + | CCDC148-AS1 | 5640 |
| 2 | 159068206 | 159068537 | − | CCDC148 | 5641 |
| 2 | 162548507 | 162550522 | + | SLC4A10 | 5642 |
| 2 | 163288479 | 163288689 | − | KCNH7 | 5643 |
| 2 | 163288479 | 163288689 | − | KCNH7 | 5644 |
| 2 | 165210977 | 165211163 | + | int | 5645 |
| 2 | 167876237 | 167877007 | + | XIRP2 | 5646 |
| 2 | 173447088 | 173447754 | + | PDK1 | 5647 |
| 2 | 176109892 | 176110285 | + | int | 5648 |
| 2 | 176243267 | 176244205 | + | int | 5649 |
| 2 | 178357696 | 178359652 | + | AGPS | 5650 |
| 2 | 178478339 | 178480169 | − | TTC30A | 5651 |
| 2 | 180491667 | 180493751 | − | ZNF385B | 5652 |
| 2 | 180491667 | 180493751 | − | ZNF385B | 5653 |
| 2 | 182852303 | 182853323 | + | PPP1R1C | 5654 |
| 2 | 182852303 | 182853323 | + | PPP1R1C | 5655 |
| 2 | 182852303 | 182853323 | + | PPP1R1C | 5656 |
| 2 | 182928092 | 182929303 | + | PPP1R1C | 5657 |
| 2 | 182928092 | 182929303 | + | PPP1R1C | 5658 |
| 2 | 182928092 | 182929303 | + | PPP1R1C | 5659 |
| 2 | 183339335 | 183340323 | − | PDE1A | 5660 |
| 2 | 183339335 | 183340323 | − | PDE1A | 5661 |
| 2 | 183339335 | 183340323 | − | PDE1A | 5662 |
| 2 | 184541138 | 184541317 | + | int | 5663 |
| 2 | 185105199 | 185118081 | + | int | 5664 |
| 2 | 186574480 | 186574603 | + | int | 5665 |
| 2 | 187147103 | 187147455 | + | int | 5666 |
| 2 | 187273468 | 187273674 | + | int | 5667 |
| 2 | 188255210 | 188256285 | − | CALCRL | 5668 |
| 2 | 189239230 | 189239675 | + | GULP1 | 5669 |
| 2 | 189239230 | 189239675 | + | GULP1 | 5670 |
| 2 | 189394197 | 189394417 | + | GULP1 | 5671 |
| 2 | 189394197 | 189394417 | + | GULP1 | 5672 |
| 2 | 189542964 | 189543137 | + | int | 5673 |
| 2 | 189625512 | 189625736 | − | DIRC1 | 5674 |
| 2 | 191330309 | 191331603 | + | MFSD6 | 5675 |
| 2 | 192035996 | 192037063 | + | int | 5676 |
| 2 | 192445075 | 192446271 | + | int | 5677 |
| 2 | 192836519 | 192837456 | − | TMEFF2 | 5678 |
| 2 | 193236472 | 193238217 | + | int | 5679 |
| 2 | 194173030 | 194173208 | + | int | 5680 |
| 2 | 194250243 | 194250794 | + | int | 5681 |
| 2 | 194383914 | 194384083 | + | int | 5682 |
| 2 | 194672979 | 194676448 | + | int | 5683 |
| 2 | 196544751 | 196545745 | + | SLC39A10 | 5684 |
| 2 | 196544751 | 196545745 | + | SLC39A10 | 5685 |
| 2 | 197490364 | 197490538 | + | int | 5686 |
| 2 | 198677554 | 198678591 | + | PLCL1 | 5687 |
| 2 | 198730263 | 198731013 | + | PLCL1 | 5688 |
| 2 | 198939852 | 198940319 | + | PLCL1 | 5689 |
| 2 | 198941100 | 198942643 | + | PLCL1 | 5690 |
| 2 | 199726478 | 199727540 | + | int | 5691 |
| 2 | 199914387 | 199915415 | + | int | 5692 |
| 2 | 200122933 | 200123341 | + | int | 5693 |
| 2 | 200793375 | 200794537 | − | TYW5 | 5694 |
| 2 | 201254283 | 201255419 | + | SPATS2L | 5695 |
| 2 | 201254283 | 201255419 | + | SPATS2L | 5696 |

TABLE 2-continued

| chromosome | start | stop | strand | nearest gene | ID |
|---|---|---|---|---|---|
| 2 | 201254283 | 201255419 | + | SPATS2L | 5697 |
| 2 | 202153346 | 202154489 | − | ALS2CR12 | 5698 |
| 2 | 203192385 | 203193078 | + | int | 5699 |
| 2 | 204480554 | 204482602 | + | int | 5700 |
| 2 | 205210904 | 205211598 | + | int | 5701 |
| 2 | 205274226 | 205274570 | + | int | 5702 |
| 2 | 205635310 | 205636545 | + | PARD3B | 5703 |
| 2 | 205700911 | 205701997 | + | PARD3B | 5704 |
| 2 | 206571574 | 206572979 | + | NRP2 | 5705 |
| 2 | 206571574 | 206572979 | + | NRP2 | 5706 |
| 2 | 206571574 | 206572979 | + | NRP2 | 5707 |
| 2 | 208152713 | 208153445 | + | int | 5708 |
| 2 | 208992505 | 208993362 | + | LOC100507443 | 5709 |
| 2 | 208992505 | 208993362 | − | CRYGC | 5710 |
| 2 | 209025449 | 209026387 | − | CRYGA | 5711 |
| 2 | 209198113 | 209199374 | + | PIKFYVE | 5712 |
| 2 | 209324597 | 209324920 | + | PTH2R | 5713 |
| 2 | 209324597 | 209324920 | + | PTH2R | 5714 |
| 2 | 209489030 | 209489367 | + | int | 5715 |
| 2 | 209631625 | 209632424 | + | int | 5716 |
| 2 | 210687800 | 210690141 | + | UNC80 | 5717 |
| 2 | 211071336 | 211072365 | − | ACADL | 5718 |
| 2 | 211425536 | 211426849 | + | CPS1 | 5719 |
| 2 | 211425536 | 211426849 | + | CPS1 | 5720 |
| 2 | 212533415 | 212534157 | − | ERBB4 | 5721 |
| 2 | 212874613 | 212875039 | − | ERBB4 | 5722 |
| 2 | 213733502 | 213734831 | + | int | 5723 |
| 2 | 213901967 | 213903759 | − | IKZF2 | 5724 |
| 2 | 213901967 | 213903759 | − | IKZF2 | 5725 |
| 2 | 214171815 | 214172885 | + | SPAG16 | 5726 |
| 2 | 214171815 | 214172885 | + | SPAG16 | 5727 |
| 2 | 215176504 | 215177745 | + | SPAG16 | 5728 |
| 2 | 215278372 | 215279366 | + | VWC2L | 5729 |
| 2 | 216338512 | 216339428 | + | int | 5730 |
| 2 | 216776090 | 216777748 | + | int | 5731 |
| 2 | 217252676 | 217252970 | + | int | 5732 |
| 2 | 218165767 | 218166744 | − | DIRC3 | 5733 |
| 2 | 219210629 | 219212174 | + | PNKD | 5734 |
| 2 | 219210629 | 219212174 | + | PNKD | 5735 |
| 2 | 219508639 | 219509630 | − | ZNF142 | 5736 |
| 2 | 219508639 | 219509630 | − | ZNF142 | 5737 |
| 2 | 220138448 | 220139221 | + | int | 5738 |
| 2 | 220420971 | 220422007 | − | OBSL1 | 5739 |
| 2 | 220420971 | 220422007 | − | OBSL1 | 5740 |
| 2 | 220755792 | 220757252 | + | int | 5741 |
| 2 | 224433759 | 224434706 | + | int | 5742 |
| 2 | 224554453 | 224556042 | + | int | 5743 |
| 2 | 225087562 | 225087969 | + | int | 5744 |
| 2 | 225580234 | 225581498 | + | int | 5745 |
| 2 | 226093155 | 226094921 | + | int | 5746 |
| 2 | 226119816 | 226121048 | + | int | 5747 |
| 2 | 226189783 | 226190710 | + | int | 5748 |
| 2 | 227199754 | 227200707 | + | int | 5749 |
| 2 | 231042483 | 231046216 | − | SP110 | 5750 |
| 2 | 231042483 | 231046216 | − | SP110 | 5751 |
| 2 | 231042483 | 231046216 | − | SP110 | 5752 |
| 2 | 231043570 | 231045358 | − | SP110 | 5753 |
| 2 | 231043570 | 231045358 | − | SP110 | 5754 |
| 2 | 231043570 | 231045358 | − | SP110 | 5755 |
| 2 | 231162063 | 231162923 | + | SP140 | 5756 |
| 2 | 231261661 | 231262267 | + | SP140L | 5757 |
| 2 | 231762081 | 231763222 | + | LOC151484 | 5758 |
| 2 | 233244030 | 233245076 | + | ALPP | 5759 |
| 2 | 233749691 | 233750619 | − | NGEF | 5760 |
| 2 | 233749691 | 233750619 | − | NGEF | 5761 |
| 2 | 234863536 | 234865126 | + | TRPM8 | 5762 |
| 2 | 235791909 | 235793743 | + | int | 5763 |
| 2 | 236832390 | 236834045 | + | AGAP1 | 5764 |
| 2 | 238671959 | 238673144 | + | LRRFIP1 | 5765 |
| 2 | 238671959 | 238673144 | + | LRRFIP1 | 5766 |
| 2 | 238671959 | 238673144 | + | LRRFIP1 | 5767 |
| 2 | 239552766 | 239553597 | + | int | 5768 |
| 2 | 242611901 | 242612850 | + | ATG4B | 5769 |
| 3 | 369467 | 370389 | + | CHL1 | 5770 |
| 3 | 369467 | 370389 | + | CHL1 | 5771 |
| 3 | 1142838 | 1143425 | + | CNTN6 | 5772 |
| 3 | 1191697 | 1192301 | + | CNTN6 | 5773 |
| 3 | 1584010 | 1584367 | + | int | 5774 |

TABLE 2-continued

| chromosome | start | stop | strand | nearest gene | ID |
|---|---|---|---|---|---|
| 3 | 1790124 | 1790622 | + | int | 5775 |
| 3 | 2972138 | 2972732 | + | CNTN4 | 5776 |
| 3 | 2972138 | 2972732 | + | CNTN4 | 5777 |
| 3 | 2972138 | 2972732 | + | CNTN4 | 5778 |
| 3 | 4305880 | 4306520 | + | int | 5779 |
| 3 | 6174316 | 6175356 | + | int | 5780 |
| 3 | 7965975 | 7966107 | + | int | 5781 |
| 3 | 8669599 | 8671324 | − | SSUH2 | 5782 |
| 3 | 8669599 | 8671324 | − | SSUH2 | 5783 |
| 3 | 8755326 | 8755990 | + | int | 5784 |
| 3 | 10568656 | 10569747 | + | int | 5785 |
| 3 | 10666051 | 10668167 | + | int | 5786 |
| 3 | 10857688 | 10858728 | + | SLC6A11 | 5787 |
| 3 | 17164083 | 17164806 | + | int | 5788 |
| 3 | 17725273 | 17727004 | − | TBC1D5 | 5789 |
| 3 | 17725273 | 17727004 | − | TBC1D5 | 5790 |
| 3 | 17725273 | 17727004 | − | TBC1D5 | 5791 |
| 3 | 18484658 | 18485677 | + | int | 5792 |
| 3 | 19947103 | 19947911 | − | EFHB | 5793 |
| 3 | 25124953 | 25125773 | + | int | 5794 |
| 3 | 26750878 | 26752096 | + | LRRC3B | 5795 |
| 3 | 30810212 | 30810710 | − | GADL1 | 5796 |
| 3 | 34223484 | 34224719 | + | int | 5797 |
| 3 | 34717729 | 34718306 | + | int | 5798 |
| 3 | 35741884 | 35742883 | + | ARPP21 | 5799 |
| 3 | 35741884 | 35742883 | + | ARPP21 | 5800 |
| 3 | 35741884 | 35742883 | + | ARPP21 | 5801 |
| 3 | 35977977 | 35978520 | + | int | 5802 |
| 3 | 36756415 | 36759679 | − | DCLK3 | 5803 |
| 3 | 38316851 | 38317850 | + | SLC22A13 | 5804 |
| 3 | 45584309 | 45590931 | + | LARS2 | 5805 |
| 3 | 47039680 | 47040780 | + | NBEAL2 | 5806 |
| 3 | 52073787 | 52076080 | + | int | 5807 |
| 3 | 52354256 | 52354739 | + | DNAH1 | 5808 |
| 3 | 52366568 | 52367323 | + | DNAH1 | 5809 |
| 3 | 54821639 | 54823145 | + | CACNA2D3 | 5810 |
| 3 | 56121755 | 56122952 | − | ERC2 | 5811 |
| 3 | 56144313 | 56145837 | − | ERC2 | 5812 |
| 3 | 57505308 | 57505750 | − | DNAH12 | 5813 |
| 3 | 57505308 | 57505750 | − | DNAH12 | 5814 |
| 3 | 57505392 | 57505743 | − | DNAH12 | 5815 |
| 3 | 57505392 | 57505743 | − | DNAH12 | 5816 |
| 3 | 58279339 | 58280206 | + | ABHD6 | 5817 |
| 3 | 59867692 | 59868631 | − | FHIT | 5818 |
| 3 | 60919162 | 60920259 | − | FHIT | 5819 |
| 3 | 61415667 | 61416535 | + | int | 5820 |
| 3 | 63609433 | 63609578 | + | int | 5821 |
| 3 | 64518768 | 64519826 | − | ADAMTS9 | 5822 |
| 3 | 69058781 | 69061952 | − | EOGT | 5823 |
| 3 | 72881775 | 72883135 | − | SHQ1 | 5824 |
| 3 | 73953672 | 73953794 | + | int | 5825 |
| 3 | 76060734 | 76061384 | + | int | 5826 |
| 3 | 76324635 | 76325304 | + | int | 5827 |
| 3 | 76534917 | 76535520 | + | int | 5828 |
| 3 | 76948927 | 76950857 | + | int | 5829 |
| 3 | 77207697 | 77208918 | + | ROBO2 | 5830 |
| 3 | 77207697 | 77208918 | + | ROBO2 | 5831 |
| 3 | 77563334 | 77563671 | + | ROBO2 | 5832 |
| 3 | 77563334 | 77563671 | + | ROBO2 | 5833 |
| 3 | 79129363 | 79129530 | − | ROBO1 | 5834 |
| 3 | 79215067 | 79215682 | − | ROBO1 | 5835 |
| 3 | 80493613 | 80493738 | + | int | 5836 |
| 3 | 81889478 | 81889701 | + | int | 5837 |
| 3 | 82108050 | 82108552 | + | int | 5838 |
| 3 | 82189867 | 82190050 | + | int | 5839 |
| 3 | 82828454 | 82828799 | + | int | 5840 |
| 3 | 83858400 | 83864623 | + | int | 5841 |
| 3 | 84358138 | 84362406 | + | int | 5842 |
| 3 | 84604635 | 84605364 | + | int | 5843 |
| 3 | 84775944 | 84777411 | − | LOC440970 | 5844 |
| 3 | 85921104 | 85923642 | + | CADM2 | 5845 |
| 3 | 85921104 | 85923642 | + | CADM2 | 5846 |
| 3 | 85921104 | 85923642 | + | CADM2 | 5847 |
| 3 | 86415135 | 86416846 | + | int | 5848 |
| 3 | 86507426 | 86507864 | + | int | 5849 |
| 3 | 86605944 | 86606152 | + | int | 5850 |
| 3 | 86938329 | 86938554 | + | int | 5851 |
| 3 | 87484963 | 87485773 | + | int | 5852 |

TABLE 2-continued

| chromosome | start | stop | strand | nearest gene | ID |
|---|---|---|---|---|---|
| 3 | 89832148 | 89833522 | + | int | 5853 |
| 3 | 89994810 | 89995585 | + | int | 5854 |
| 3 | 94456458 | 94456636 | + | int | 5855 |
| 3 | 95354985 | 95355794 | + | int | 5856 |
| 3 | 96563175 | 96563845 | + | EPHA6 | 5857 |
| 3 | 97732561 | 97735527 | − | GABRR3 | 5858 |
| 3 | 97849283 | 97849575 | + | int | 5859 |
| 3 | 99340486 | 99340678 | − | MIR548G | 5860 |
| 3 | 100466697 | 100468228 | + | TFG | 5861 |
| 3 | 100466697 | 100468228 | + | TFG | 5862 |
| 3 | 100466697 | 100468228 | + | TFG | 5863 |
| 3 | 100466697 | 100468228 | − | ABI3BP | 5864 |
| 3 | 100698838 | 100699036 | − | ABI3BP | 5865 |
| 3 | 102374828 | 102375669 | + | int | 5866 |
| 3 | 102825230 | 102825493 | + | int | 5867 |
| 3 | 103925344 | 103926775 | − | MIR548A3 | 5868 |
| 3 | 104486562 | 104487618 | + | int | 5869 |
| 3 | 104526494 | 104526628 | + | int | 5870 |
| 3 | 110100888 | 110101192 | + | int | 5871 |
| 3 | 110651084 | 110651851 | + | int | 5872 |
| 3 | 112542201 | 112547747 | − | CD200R1L | 5873 |
| 3 | 114818651 | 114819646 | − | ZBTB20 | 5874 |
| 3 | 115656637 | 115657345 | − | LSAMP | 5875 |
| 3 | 115846202 | 115846743 | − | LSAMP | 5876 |
| 3 | 116433994 | 116434326 | + | LSAMP-AS3 | 5877 |
| 3 | 117451995 | 117452677 | + | int | 5878 |
| 3 | 117486866 | 117487329 | + | int | 5879 |
| 3 | 119243285 | 119243471 | − | CD80 | 5880 |
| 3 | 120626292 | 120627524 | + | STXBP5L | 5881 |
| 3 | 121043228 | 121043470 | + | STXBP5L | 5882 |
| 3 | 128864455 | 128864920 | − | ISY1 | 5883 |
| 3 | 128864455 | 128864920 | − | ISY1-RAB43 | 5884 |
| 3 | 128992972 | 128994199 | + | COPG1 | 5885 |
| 3 | 130240798 | 130242042 | + | int | 5886 |
| 3 | 130648421 | 130649630 | + | ATP2C1 | 5887 |
| 3 | 130648421 | 130649630 | + | ATP2C1 | 5888 |
| 3 | 130648421 | 130649630 | + | ATP2C1 | 5889 |
| 3 | 130648421 | 130649630 | + | ATP2C1 | 5890 |
| 3 | 130648421 | 130649630 | + | ATP2C1 | 5891 |
| 3 | 130648421 | 130649630 | + | ATP2C1 | 5892 |
| 3 | 130648421 | 130649630 | + | ATP2C1 | 5893 |
| 3 | 130648421 | 130649630 | + | ATP2C1 | 5894 |
| 3 | 130648421 | 130649630 | + | ATP2C1 | 5895 |
| 3 | 133952856 | 133953046 | − | RYK | 5896 |
| 3 | 136775331 | 136783671 | + | int | 5897 |
| 3 | 137913554 | 137916532 | + | ARMC8 | 5898 |
| 3 | 137913554 | 137916532 | + | ARMC8 | 5899 |
| 3 | 141021073 | 141022577 | + | int | 5900 |
| 3 | 147011230 | 147013250 | + | int | 5901 |
| 3 | 147060248 | 147060407 | + | int | 5902 |
| 3 | 147622213 | 147622804 | + | int | 5903 |
| 3 | 147657106 | 147658272 | + | int | 5904 |
| 3 | 149846007 | 149849544 | + | int | 5905 |
| 3 | 151023568 | 151024627 | + | MED12L | 5906 |
| 3 | 151023568 | 151024627 | − | GPR87 | 5907 |
| 3 | 151110510 | 151111585 | + | MED12L | 5908 |
| 3 | 151733960 | 151734169 | + | int | 5909 |
| 3 | 152987165 | 152987814 | + | int | 5910 |
| 3 | 154030763 | 154032240 | − | DHX36 | 5911 |
| 3 | 155021162 | 155022635 | + | int | 5912 |
| 3 | 155900802 | 155901558 | + | KCNAB1 | 5913 |
| 3 | 155900802 | 155901558 | + | KCNAB1 | 5914 |
| 3 | 156070927 | 156072891 | + | KCNAB1 | 5915 |
| 3 | 156070927 | 156072891 | + | KCNAB1 | 5916 |
| 3 | 156070927 | 156072891 | + | KCNAB1 | 5917 |
| 3 | 157890491 | 157890656 | + | RSRC1 | 5918 |
| 3 | 158541781 | 158543920 | + | MFSD1 | 5919 |
| 3 | 160000453 | 160000857 | − | IFT80 | 5920 |
| 3 | 160000453 | 160000857 | − | IFT80 | 5921 |
| 3 | 160019350 | 160020098 | − | IFT80 | 5922 |
| 3 | 160019350 | 160020098 | − | IFT80 | 5923 |
| 3 | 164134187 | 164135386 | + | int | 5924 |
| 3 | 164288733 | 164289181 | + | int | 5925 |
| 3 | 166723584 | 166724347 | + | int | 5926 |
| 3 | 167061593 | 167062677 | − | ZBBX | 5927 |
| 3 | 167061593 | 167062677 | − | ZBBX | 5928 |
| 3 | 167963509 | 167964355 | + | int | 5929 |
| 3 | 168269460 | 168270355 | + | EGFEM1P | 5930 |

TABLE 2-continued

| chromosome | start | stop | strand | nearest gene | ID |
|---|---|---|---|---|---|
| 3 | 168269460 | 168270355 | + | MIR551B | 5931 |
| 3 | 169312074 | 169312786 | − | MECOM | 5932 |
| 3 | 169672092 | 169672385 | − | LOC100128164 | 5933 |
| 3 | 169672092 | 169672385 | − | LOC100128164 | 5934 |
| 3 | 170843257 | 170843799 | − | TNIK | 5935 |
| 3 | 173154797 | 173154921 | + | NLGN1 | 5936 |
| 3 | 173718296 | 173718842 | + | NLGN1 | 5937 |
| 3 | 174051829 | 174052381 | + | int | 5938 |
| 3 | 175032931 | 175033323 | + | NAALADL2 | 5939 |
| 3 | 175196776 | 175197501 | + | NAALADL2 | 5940 |
| 3 | 175376261 | 175376483 | + | NAALADL2 | 5941 |
| 3 | 177351002 | 177351120 | + | LINC00578 | 5942 |
| 3 | 180472626 | 180474146 | + | int | 5943 |
| 3 | 182414253 | 182414630 | + | int | 5944 |
| 3 | 185634515 | 185634600 | − | TRA2B | 5945 |
| 3 | 186174540 | 186175828 | − | LOC253573 | 5946 |
| 3 | 186177408 | 186178135 | − | LOC253573 | 5947 |
| 3 | 189091168 | 189107739 | + | int | 5948 |
| 3 | 189615359 | 189615893 | + | int | 5949 |
| 3 | 190659343 | 190660312 | + | int | 5950 |
| 3 | 193225814 | 193228235 | − | ATP13A4 | 5951 |
| 3 | 195890381 | 195891114 | + | int | 5952 |
| 3 | 197786953 | 197787168 | − | ANKRD18DP | 5953 |
| 4 | 3726360 | 3727717 | + | int | 5954 |
| 4 | 11068562 | 11069327 | + | int | 5955 |
| 4 | 12223643 | 12224378 | + | int | 5956 |
| 4 | 14708233 | 14709800 | + | int | 5957 |
| 4 | 18882136 | 18882563 | + | int | 5958 |
| 4 | 19110835 | 19111011 | + | int | 5959 |
| 4 | 19121730 | 19122480 | + | int | 5960 |
| 4 | 20155237 | 20165097 | + | int | 5961 |
| 4 | 21799419 | 21799737 | − | KCNIP4 | 5962 |
| 4 | 22021113 | 22021348 | + | int | 5963 |
| 4 | 24092707 | 24093761 | + | int | 5964 |
| 4 | 24946496 | 24947701 | − | CCDC149 | 5965 |
| 4 | 25672323 | 25673674 | + | SLC34A2 | 5966 |
| 4 | 25672323 | 25673674 | + | SLC34A2 | 5967 |
| 4 | 26576884 | 26577056 | + | int | 5968 |
| 4 | 26579517 | 26580003 | + | int | 5969 |
| 4 | 27477816 | 27478545 | + | int | 5970 |
| 4 | 27727434 | 27728076 | + | int | 5971 |
| 4 | 31024543 | 31025020 | + | PCDH7 | 5972 |
| 4 | 31570854 | 31571228 | + | int | 5973 |
| 4 | 31594090 | 31594583 | + | int | 5974 |
| 4 | 31698682 | 31698955 | + | int | 5975 |
| 4 | 31789866 | 31791096 | + | int | 5976 |
| 4 | 33615851 | 33616017 | + | int | 5977 |
| 4 | 33925485 | 33925835 | + | int | 5978 |
| 4 | 33936264 | 33936881 | + | int | 5979 |
| 4 | 34016819 | 34017250 | + | int | 5980 |
| 4 | 34419085 | 34419220 | + | int | 5981 |
| 4 | 34645492 | 34646486 | + | int | 5982 |
| 4 | 34799012 | 34800237 | + | int | 5983 |
| 4 | 35670626 | 35671038 | + | int | 5984 |
| 4 | 35817287 | 35817974 | + | int | 5985 |
| 4 | 43845222 | 43845527 | + | int | 5986 |
| 4 | 44695727 | 44696750 | + | GUF1 | 5987 |
| 4 | 44763427 | 44763853 | + | int | 5988 |
| 4 | 45152470 | 45154466 | + | int | 5989 |
| 4 | 45869197 | 45869870 | + | int | 5990 |
| 4 | 46038810 | 46040363 | − | GABRG1 | 5991 |
| 4 | 46170405 | 46170780 | + | int | 5992 |
| 4 | 46942286 | 46942820 | − | GABRA4 | 5993 |
| 4 | 46942286 | 46942820 | − | GABRA4 | 5994 |
| 4 | 53373212 | 53374069 | + | int | 5995 |
| 4 | 59316508 | 59317238 | + | int | 5996 |
| 4 | 60067890 | 60068135 | + | int | 5997 |
| 4 | 61206721 | 61206986 | + | int | 5998 |
| 4 | 62121450 | 62121720 | + | int | 5999 |
| 4 | 62356403 | 62356914 | + | int | 6000 |
| 4 | 63747718 | 63748216 | + | int | 6001 |
| 4 | 64186604 | 64187014 | + | int | 6002 |
| 4 | 66316865 | 66317249 | − | EPHA5 | 6003 |
| 4 | 66584759 | 66585047 | + | int | 6004 |
| 4 | 67273325 | 67273668 | + | int | 6005 |
| 4 | 67945635 | 67946097 | + | int | 6006 |
| 4 | 68704433 | 68704723 | − | TMPRSS11D | 6007 |
| 4 | 68995491 | 68996406 | − | TMPRSS11F | 6008 |

TABLE 2-continued

| chromosome | start | stop | strand | nearest gene | ID |
|---|---|---|---|---|---|
| 4 | 73364119 | 73364727 | − | ADAMTS3 | 6009 |
| 4 | 75404438 | 75405434 | + | int | 6010 |
| 4 | 77806896 | 77807763 | + | int | 6011 |
| 4 | 78662832 | 78663497 | − | CNOT6L | 6012 |
| 4 | 79140677 | 79141665 | + | FRAS1 | 6013 |
| 4 | 79140677 | 79141665 | + | FRAS1 | 6014 |
| 4 | 80511717 | 80512773 | + | int | 6015 |
| 4 | 81535936 | 81536130 | + | C4orf22 | 6016 |
| 4 | 81773361 | 81774713 | + | C4orf22 | 6017 |
| 4 | 81842538 | 81843466 | + | C4orf22 | 6018 |
| 4 | 83349485 | 83350593 | − | HNRPDL | 6019 |
| 4 | 85591547 | 85592635 | − | WDFY3 | 6020 |
| 4 | 86680606 | 86681382 | + | ARHGAP24 | 6021 |
| 4 | 88161470 | 88161839 | + | int | 6022 |
| 4 | 89677104 | 89677726 | − | FAM13A | 6023 |
| 4 | 89677104 | 89677726 | − | FAM13A | 6024 |
| 4 | 90238707 | 90238946 | + | int | 6025 |
| 4 | 93816871 | 93818414 | + | GRID2 | 6026 |
| 4 | 94341135 | 94341588 | + | GRID2 | 6027 |
| 4 | 95202783 | 95203599 | + | SMARCAD1 | 6028 |
| 4 | 95202783 | 95203599 | + | SMARCAD1 | 6029 |
| 4 | 95202783 | 95203599 | + | SMARCAD1 | 6030 |
| 4 | 95202783 | 95203599 | + | SMARCAD1 | 6031 |
| 4 | 96551660 | 96552445 | + | int | 6032 |
| 4 | 96581689 | 96592565 | + | int | 6033 |
| 4 | 97146043 | 97147095 | + | int | 6034 |
| 4 | 97207706 | 97208296 | + | int | 6035 |
| 4 | 98111116 | 98111824 | + | int | 6036 |
| 4 | 98217602 | 98219633 | + | int | 6037 |
| 4 | 98603427 | 98603725 | − | STPG2 | 6038 |
| 4 | 100357798 | 100358134 | + | int | 6039 |
| 4 | 100522534 | 100522879 | + | MTTP | 6040 |
| 4 | 101389135 | 101389693 | − | EMCN | 6041 |
| 4 | 101578110 | 101579096 | + | int | 6042 |
| 4 | 102468058 | 102468412 | + | int | 6043 |
| 4 | 102901568 | 102903311 | + | BANK1 | 6044 |
| 4 | 102901568 | 102903311 | + | BANK1 | 6045 |
| 4 | 104545444 | 104545951 | − | TACR3 | 6046 |
| 4 | 105148699 | 105149825 | + | int | 6047 |
| 4 | 105508056 | 105508696 | + | int | 6048 |
| 4 | 108038995 | 108040585 | + | int | 6049 |
| 4 | 110637991 | 110638854 | − | PLA2G12A | 6050 |
| 4 | 112325783 | 112326377 | + | int | 6051 |
| 4 | 114281415 | 114282287 | + | ANK2 | 6052 |
| 4 | 114281415 | 114282287 | + | ANK2 | 6053 |
| 4 | 117124496 | 117128503 | + | int | 6054 |
| 4 | 119972273 | 119973555 | + | SYNPO2 | 6055 |
| 4 | 120939601 | 120940313 | + | int | 6056 |
| 4 | 122383369 | 122383737 | + | int | 6057 |
| 4 | 122506756 | 122507163 | + | int | 6058 |
| 4 | 124223481 | 124225405 | + | SPATA5 | 6059 |
| 4 | 125330401 | 125330595 | + | int | 6060 |
| 4 | 126112110 | 126114626 | + | int | 6061 |
| 4 | 126507320 | 126508297 | + | int | 6062 |
| 4 | 130746537 | 130747438 | + | int | 6063 |
| 4 | 131131938 | 131132367 | + | int | 6064 |
| 4 | 131234894 | 131235716 | + | int | 6065 |
| 4 | 131481315 | 131481788 | + | int | 6066 |
| 4 | 131506117 | 131506298 | + | int | 6067 |
| 4 | 133098056 | 133098319 | + | int | 6068 |
| 4 | 134272116 | 134272261 | + | int | 6069 |
| 4 | 135514665 | 135515217 | + | int | 6070 |
| 4 | 136898188 | 136898411 | + | int | 6071 |
| 4 | 138212610 | 138213490 | + | int | 6072 |
| 4 | 138926778 | 138927123 | + | int | 6073 |
| 4 | 139778622 | 139779613 | + | int | 6074 |
| 4 | 141530634 | 141531471 | + | int | 6075 |
| 4 | 141858842 | 141858977 | − | RNF150 | 6076 |
| 4 | 142267120 | 142267711 | + | int | 6077 |
| 4 | 144270396 | 144271082 | + | GAB1 | 6078 |
| 4 | 145658288 | 145659343 | + | HHIP | 6079 |
| 4 | 151186669 | 151188014 | − | LRBA | 6080 |
| 4 | 151186669 | 151188014 | − | LRBA | 6081 |
| 4 | 151246639 | 151247842 | − | LRBA | 6082 |
| 4 | 151246639 | 151247842 | − | LRBA | 6083 |
| 4 | 151319353 | 151320288 | − | LRBA | 6084 |
| 4 | 151319353 | 151320288 | − | LRBA | 6085 |
| 4 | 151493790 | 151494775 | − | LRBA | 6086 |

TABLE 2-continued

| chromosome | start | stop | strand | nearest gene | ID |
|---|---|---|---|---|---|
| 4 | 151493790 | 151494775 | − | LRBA | 6087 |
| 4 | 156135079 | 156136079 | + | NPY2R | 6088 |
| 4 | 157515550 | 157516135 | + | int | 6089 |
| 4 | 157594758 | 157595214 | + | int | 6090 |
| 4 | 157992506 | 157992681 | + | int | 6091 |
| 4 | 158440797 | 158442429 | + | int | 6092 |
| 4 | 158492373 | 158493060 | + | int | 6093 |
| 4 | 158831481 | 158831846 | + | int | 6094 |
| 4 | 160690327 | 160690459 | + | int | 6095 |
| 4 | 160873266 | 160873477 | + | int | 6096 |
| 4 | 161889618 | 161889841 | + | int | 6097 |
| 4 | 161972140 | 161973436 | + | int | 6098 |
| 4 | 162372826 | 162373138 | − | FSTL5 | 6099 |
| 4 | 163622822 | 163623378 | + | int | 6100 |
| 4 | 164492435 | 164493172 | − | 1-Mar | 6101 |
| 4 | 164492435 | 164493172 | − | 1-Mar | 6102 |
| 4 | 164570641 | 164571035 | − | 1-Mar | 6103 |
| 4 | 164817095 | 164817215 | − | 1-Mar | 6104 |
| 4 | 165431764 | 165432125 | + | MIR5684 | 6105 |
| 4 | 166433580 | 166434390 | + | int | 6106 |
| 4 | 167833206 | 167834349 | − | SPOCK3 | 6107 |
| 4 | 167833206 | 167834349 | − | SPOCK3 | 6108 |
| 4 | 167833206 | 167834349 | − | SPOCK3 | 6109 |
| 4 | 171887430 | 171887634 | + | int | 6110 |
| 4 | 173473395 | 173473878 | + | GALNTL6 | 6111 |
| 4 | 173603422 | 173603679 | + | GALNTL6 | 6112 |
| 4 | 174669261 | 174670436 | + | int | 6113 |
| 4 | 175147672 | 175148266 | + | int | 6114 |
| 4 | 178607327 | 178607800 | + | int | 6115 |
| 4 | 179009095 | 179009829 | + | int | 6116 |
| 4 | 179642030 | 179643289 | + | int | 6117 |
| 4 | 179863872 | 179864287 | + | int | 6118 |
| 4 | 180255132 | 180256172 | + | int | 6119 |
| 4 | 181147106 | 181149133 | + | int | 6120 |
| 4 | 181383123 | 181384058 | + | int | 6121 |
| 4 | 181631512 | 181631734 | + | int | 6122 |
| 4 | 182046126 | 182046318 | − | LINC00290 | 6123 |
| 4 | 184367288 | 184368518 | + | CDKN2AIP | 6124 |
| 4 | 186361423 | 186362490 | + | C4orf47 | 6125 |
| 4 | 189544909 | 189545927 | + | int | 6126 |
| 4 | 190511057 | 190511859 | + | int | 6127 |
| 4 | 190525107 | 190525700 | + | int | 6128 |
| 5 | 411433 | 412096 | + | AHRR | 6129 |
| 5 | 453307 | 454174 | + | EXOC3 | 6130 |
| 5 | 1906893 | 1908059 | + | int | 6131 |
| 5 | 4018006 | 4018930 | + | int | 6132 |
| 5 | 6313910 | 6314411 | − | FLJ33360 | 6133 |
| 5 | 7516963 | 7518645 | + | ADCY2 | 6134 |
| 5 | 9572077 | 9573744 | + | int | 6135 |
| 5 | 11044699 | 11047082 | − | CTNND2 | 6136 |
| 5 | 13178318 | 13178939 | + | int | 6137 |
| 5 | 15141964 | 15142123 | + | int | 6138 |
| 5 | 17420046 | 17420628 | + | int | 6139 |
| 5 | 17830923 | 17831607 | + | int | 6140 |
| 5 | 17972845 | 17973635 | + | int | 6141 |
| 5 | 20514854 | 20515129 | + | int | 6142 |
| 5 | 21595895 | 21596175 | + | int | 6143 |
| 5 | 21772786 | 21773019 | − | CDH12 | 6144 |
| 5 | 22531091 | 22531411 | − | CDH12 | 6145 |
| 5 | 25496389 | 25496795 | + | int | 6146 |
| 5 | 26120632 | 26120980 | + | int | 6147 |
| 5 | 26860950 | 26861518 | + | int | 6148 |
| 5 | 27061454 | 27061982 | + | int | 6149 |
| 5 | 27132803 | 27133513 | + | int | 6150 |
| 5 | 27569230 | 27569775 | + | int | 6151 |
| 5 | 27676221 | 27677734 | + | int | 6152 |
| 5 | 28279056 | 28279277 | + | int | 6153 |
| 5 | 30172894 | 30173205 | + | int | 6154 |
| 5 | 30230066 | 30231197 | + | int | 6155 |
| 5 | 30830653 | 30831722 | + | int | 6156 |
| 5 | 30879436 | 30880235 | + | int | 6157 |
| 5 | 33684753 | 33686101 | − | ADAMTS12 | 6158 |
| 5 | 36099950 | 36100810 | + | int | 6159 |
| 5 | 39030408 | 39030844 | − | RICTOR | 6160 |
| 5 | 43503148 | 43504020 | − | C5orf34 | 6161 |
| 5 | 45822554 | 45823478 | + | int | 6162 |
| 5 | 50338851 | 50339645 | + | int | 6163 |
| 5 | 50468587 | 50469575 | + | int | 6164 |

TABLE 2-continued

| chromosome | start | stop | strand | nearest gene | ID |
|---|---|---|---|---|---|
| 5 | 50483347 | 50484719 | + | int | 6165 |
| 5 | 50911059 | 50911267 | + | int | 6166 |
| 5 | 51838282 | 51839276 | + | int | 6167 |
| 5 | 51966084 | 51966605 | + | int | 6168 |
| 5 | 53217798 | 53218863 | − | ARL15 | 6169 |
| 5 | 54917724 | 54919608 | + | int | 6170 |
| 5 | 56011663 | 56012151 | + | int | 6171 |
| 5 | 56019306 | 56019744 | + | int | 6172 |
| 5 | 56880706 | 56880979 | + | int | 6173 |
| 5 | 57317829 | 57320117 | + | int | 6174 |
| 5 | 63052514 | 63053062 | + | int | 6175 |
| 5 | 63509631 | 63510635 | + | RNF180 | 6176 |
| 5 | 63509631 | 63510635 | + | RNF180 | 6177 |
| 5 | 64771488 | 64772763 | − | ADAMTS6 | 6178 |
| 5 | 65349341 | 65350556 | + | ERBB2IP | 6179 |
| 5 | 65837460 | 65838272 | + | int | 6180 |
| 5 | 66911068 | 66911295 | + | int | 6181 |
| 5 | 66915127 | 66916241 | + | int | 6182 |
| 5 | 66982379 | 66982668 | + | int | 6183 |
| 5 | 67203372 | 67203700 | + | int | 6184 |
| 5 | 67256648 | 67258010 | + | int | 6185 |
| 5 | 67857742 | 67859165 | + | int | 6186 |
| 5 | 68252836 | 68254350 | + | int | 6187 |
| 5 | 71670152 | 71671501 | + | int | 6188 |
| 5 | 71744261 | 71744980 | − | ZNF366 | 6189 |
| 5 | 72842187 | 72842527 | + | int | 6190 |
| 5 | 73538121 | 73539483 | + | int | 6191 |
| 5 | 75430744 | 75432026 | + | SV2C | 6192 |
| 5 | 76822777 | 76823026 | + | int | 6193 |
| 5 | 77261105 | 77262142 | + | int | 6194 |
| 5 | 78416020 | 78417241 | + | BHMT | 6195 |
| 5 | 79901394 | 79903150 | + | int | 6196 |
| 5 | 80278050 | 80279336 | + | RASGRF2 | 6197 |
| 5 | 80825216 | 80826536 | − | SSBP2 | 6198 |
| 5 | 81393616 | 81394578 | + | ATG10 | 6199 |
| 5 | 81765799 | 81767125 | + | int | 6200 |
| 5 | 82807677 | 82808817 | + | VCAN | 6201 |
| 5 | 83088790 | 83095726 | + | int | 6202 |
| 5 | 83113440 | 83114000 | + | int | 6203 |
| 5 | 84023816 | 84023947 | + | int | 6204 |
| 5 | 84082996 | 84083080 | + | int | 6205 |
| 5 | 85074184 | 85074222 | + | int | 6206 |
| 5 | 87058343 | 87059178 | + | int | 6207 |
| 5 | 88187917 | 88188944 | − | MEF2C | 6208 |
| 5 | 88934373 | 88942142 | + | int | 6209 |
| 5 | 89132925 | 89133124 | + | int | 6210 |
| 5 | 89225299 | 89226347 | + | int | 6211 |
| 5 | 89376695 | 89376839 | + | int | 6212 |
| 5 | 89989443 | 89990618 | + | GPR98 | 6213 |
| 5 | 90282532 | 90282826 | + | GPR98 | 6214 |
| 5 | 91073753 | 91074087 | + | int | 6215 |
| 5 | 91542452 | 91543184 | + | int | 6216 |
| 5 | 91787258 | 91788275 | + | int | 6217 |
| 5 | 91803099 | 91804206 | + | int | 6218 |
| 5 | 92196517 | 92197877 | + | int | 6219 |
| 5 | 92424157 | 92425156 | + | int | 6220 |
| 5 | 93148073 | 93148250 | − | FAM172A | 6221 |
| 5 | 93157353 | 93158502 | − | FAM172A | 6222 |
| 5 | 94704021 | 94704778 | + | int | 6223 |
| 5 | 96861937 | 96862117 | + | int | 6224 |
| 5 | 101155716 | 101156156 | + | int | 6225 |
| 5 | 101368727 | 101368996 | + | int | 6226 |
| 5 | 101833101 | 101834884 | − | SLCO6A1 | 6227 |
| 5 | 102630082 | 102630942 | + | int | 6228 |
| 5 | 102911939 | 102912400 | + | int | 6229 |
| 5 | 104098799 | 104099937 | + | int | 6230 |
| 5 | 104482189 | 104482575 | + | int | 6231 |
| 5 | 105012219 | 105013079 | + | int | 6232 |
| 5 | 105753671 | 105754512 | + | int | 6233 |
| 5 | 105773841 | 105774132 | + | int | 6234 |
| 5 | 105852087 | 105853141 | + | int | 6235 |
| 5 | 106058786 | 106059840 | + | int | 6236 |
| 5 | 106058810 | 106059975 | + | int | 6237 |
| 5 | 106087317 | 106087701 | + | int | 6238 |
| 5 | 106087407 | 106087704 | + | int | 6239 |
| 5 | 106280823 | 106282105 | + | int | 6240 |
| 5 | 106390641 | 106390975 | + | int | 6241 |
| 5 | 106551347 | 106551976 | + | int | 6242 |

TABLE 2-continued

| chromosome | start | stop | strand | nearest gene | ID |
|---|---|---|---|---|---|
| 5 | 106605900 | 106607005 | + | int | 6243 |
| 5 | 107650786 | 107651848 | − | FBXL17 | 6244 |
| 5 | 110074053 | 110075318 | + | SLC25A46 | 6245 |
| 5 | 111058996 | 111061057 | + | STARD4-AS1 | 6246 |
| 5 | 112178785 | 112179788 | + | APC | 6247 |
| 5 | 112178785 | 112179788 | + | APC | 6248 |
| 5 | 114719801 | 114721081 | + | int | 6249 |
| 5 | 114910063 | 114910705 | + | int | 6250 |
| 5 | 115342692 | 115346410 | + | AQPEP | 6251 |
| 5 | 115491746 | 115492090 | + | COMMD10 | 6252 |
| 5 | 116440826 | 116442186 | + | int | 6253 |
| 5 | 116821795 | 116822803 | + | LOC728342 | 6254 |
| 5 | 118087362 | 118087897 | + | int | 6255 |
| 5 | 118309256 | 118309932 | − | DTWD2 | 6256 |
| 5 | 118309259 | 118310144 | − | DTWD2 | 6257 |
| 5 | 118508723 | 118509727 | + | DMXL1 | 6258 |
| 5 | 120454161 | 120455363 | + | int | 6259 |
| 5 | 122781552 | 122781963 | + | int | 6260 |
| 5 | 123397311 | 123398649 | + | int | 6261 |
| 5 | 123787358 | 123788028 | + | int | 6262 |
| 5 | 127904166 | 127904464 | + | int | 6263 |
| 5 | 127929084 | 127929388 | + | int | 6264 |
| 5 | 132800154 | 132801650 | − | FSTL4 | 6265 |
| 5 | 135007719 | 135008512 | + | int | 6266 |
| 5 | 135750534 | 135751104 | + | int | 6267 |
| 5 | 136323127 | 136324434 | − | SPOCK1 | 6268 |
| 5 | 137012247 | 137013645 | − | KLHL3 | 6269 |
| 5 | 137012247 | 137013645 | − | KLHL3 | 6270 |
| 5 | 137012247 | 137013645 | − | KLHL3 | 6271 |
| 5 | 140222373 | 140223634 | + | PCDHA1 | 6272 |
| 5 | 140222373 | 140223634 | + | PCDHA2 | 6273 |
| 5 | 140222373 | 140223634 | + | PCDHA3 | 6274 |
| 5 | 140222373 | 140223634 | + | PCDHA4 | 6275 |
| 5 | 140222373 | 140223634 | + | PCDHA5 | 6276 |
| 5 | 140222373 | 140223634 | + | PCDHA6 | 6277 |
| 5 | 140222373 | 140223634 | + | PCDHA7 | 6278 |
| 5 | 140222373 | 140223634 | + | PCDHA8 | 6279 |
| 5 | 140222373 | 140223634 | + | PCDHA8 | 6280 |
| 5 | 140236607 | 140237807 | + | PCDHA1 | 6281 |
| 5 | 140236607 | 140237807 | + | PCDHA10 | 6282 |
| 5 | 140236607 | 140237807 | + | PCDHA10 | 6283 |
| 5 | 140236607 | 140237807 | + | PCDHA2 | 6284 |
| 5 | 140236607 | 140237807 | + | PCDHA3 | 6285 |
| 5 | 140236607 | 140237807 | + | PCDHA4 | 6286 |
| 5 | 140236607 | 140237807 | + | PCDHA5 | 6287 |
| 5 | 140236607 | 140237807 | + | PCDHA6 | 6288 |
| 5 | 140236607 | 140237807 | + | PCDHA7 | 6289 |
| 5 | 140236607 | 140237807 | + | PCDHA8 | 6290 |
| 5 | 140236607 | 140237807 | + | PCDHA9 | 6291 |
| 5 | 144450811 | 144451311 | + | int | 6292 |
| 5 | 151804497 | 151806489 | + | int | 6293 |
| 5 | 155011820 | 155014741 | + | int | 6294 |
| 5 | 156108713 | 156108973 | + | SGCD | 6295 |
| 5 | 156108713 | 156108973 | + | SGCD | 6296 |
| 5 | 158745744 | 158747561 | − | IL12B | 6297 |
| 5 | 161912249 | 161913221 | + | int | 6298 |
| 5 | 162962055 | 162963075 | + | int | 6299 |
| 5 | 163703405 | 163703693 | + | int | 6300 |
| 5 | 164063088 | 164063377 | + | int | 6301 |
| 5 | 165133042 | 165133408 | + | int | 6302 |
| 5 | 165655579 | 165656142 | + | int | 6303 |
| 5 | 165901279 | 165901958 | + | int | 6304 |
| 5 | 166375282 | 166375678 | + | int | 6305 |
| 5 | 166384112 | 166385138 | + | int | 6306 |
| 5 | 170178588 | 170180080 | + | int | 6307 |
| 5 | 170240080 | 170241014 | + | GABRP | 6308 |
| 5 | 171466866 | 171467431 | + | int | 6309 |
| 5 | 176070640 | 176073229 | + | EIF4E1B | 6310 |
| 5 | 176520076 | 176521245 | + | FGFR4 | 6311 |
| 5 | 176520076 | 176521245 | + | FGFR4 | 6312 |
| 5 | 177842520 | 177844546 | − | COL23A1 | 6313 |
| 5 | 178564397 | 178565175 | − | ADAMTS2 | 6314 |
| 6 | 2520487 | 2520856 | + | int | 6315 |
| 6 | 3118828 | 3119624 | + | BPHL | 6316 |
| 6 | 6094103 | 6094375 | + | int | 6317 |
| 6 | 9674785 | 9676246 | + | int | 6318 |
| 6 | 11135676 | 11136822 | + | SMIM13 | 6319 |
| 6 | 12067594 | 12068713 | + | HIVEP1 | 6320 |

TABLE 2-continued

| chromosome | start | stop | strand | nearest gene | ID |
|---|---|---|---|---|---|
| 6 | 12097435 | 12098009 | + | HIVEP1 | 6321 |
| 6 | 13466203 | 13467364 | − | GFOD1 | 6322 |
| 6 | 13466203 | 13467364 | − | GFOD1 | 6323 |
| 6 | 15400236 | 15401199 | + | JARID2 | 6324 |
| 6 | 15400236 | 15401199 | + | JARID2 | 6325 |
| 6 | 16541776 | 16542879 | − | ATXN1 | 6326 |
| 6 | 19097736 | 19098409 | + | int | 6327 |
| 6 | 22040821 | 22041084 | + | LINC00340 | 6328 |
| 6 | 22337437 | 22337704 | + | int | 6329 |
| 6 | 22921651 | 22921966 | + | int | 6330 |
| 6 | 23957942 | 23958133 | + | int | 6331 |
| 6 | 27049476 | 27050681 | + | int | 6332 |
| 6 | 29039338 | 29040221 | + | LOC100129636 | 6333 |
| 6 | 29384984 | 29386188 | + | int | 6334 |
| 6 | 29394489 | 29395508 | − | OR11A1 | 6335 |
| 6 | 31629879 | 31632196 | − | GPANK1 | 6336 |
| 6 | 31629879 | 31632196 | − | GPANK1 | 6337 |
| 6 | 31629879 | 31632196 | − | GPANK1 | 6338 |
| 6 | 31629879 | 31632196 | − | GPANK1 | 6339 |
| 6 | 31750591 | 31753588 | − | VARS | 6340 |
| 6 | 31982825 | 31983597 | + | C4A | 6341 |
| 6 | 31982825 | 31983597 | + | C4B | 6342 |
| 6 | 31982825 | 31983597 | + | C4B_2 | 6343 |
| 6 | 36178162 | 36179684 | + | BRPF3 | 6344 |
| 6 | 36754621 | 36755101 | − | CPNE5 | 6345 |
| 6 | 46986943 | 46987898 | − | GPR110 | 6346 |
| 6 | 46986943 | 46987898 | − | GPR110 | 6347 |
| 6 | 48224935 | 48225228 | + | int | 6348 |
| 6 | 48793707 | 48794243 | + | int | 6349 |
| 6 | 50465564 | 50465751 | + | int | 6350 |
| 6 | 50704310 | 50705508 | + | TFAP2D | 6351 |
| 6 | 51539606 | 51540553 | − | PKHD1 | 6352 |
| 6 | 51932830 | 51933819 | − | PKHD1 | 6353 |
| 6 | 51932830 | 51933819 | − | PKHD1 | 6354 |
| 6 | 52276662 | 52277693 | + | int | 6355 |
| 6 | 53977828 | 53978358 | + | MLIP | 6356 |
| 6 | 54800250 | 54801181 | + | FAM83B | 6357 |
| 6 | 55624063 | 55624331 | − | BMP5 | 6358 |
| 6 | 57760418 | 57761081 | + | int | 6359 |
| 6 | 62512319 | 62512619 | − | KHDRBS2 | 6360 |
| 6 | 62685593 | 62686584 | − | KHDRBS2 | 6361 |
| 6 | 63374229 | 63375189 | + | int | 6362 |
| 6 | 63542718 | 63543134 | + | int | 6363 |
| 6 | 64871769 | 64872505 | − | EYS | 6364 |
| 6 | 65091474 | 65091480 | − | EYS | 6365 |
| 6 | 65139189 | 65140321 | − | EYS | 6366 |
| 6 | 66906946 | 66907548 | + | int | 6367 |
| 6 | 67654542 | 67654664 | + | int | 6368 |
| 6 | 67788915 | 67789199 | + | int | 6369 |
| 6 | 67790340 | 67790936 | + | int | 6370 |
| 6 | 67840178 | 67840414 | + | int | 6371 |
| 6 | 68424057 | 68424552 | + | int | 6372 |
| 6 | 69516636 | 69517061 | + | BAI3 | 6373 |
| 6 | 69563411 | 69564161 | + | BAI3 | 6374 |
| 6 | 69723191 | 69723985 | + | BAI3 | 6375 |
| 6 | 70131859 | 70132988 | + | int | 6376 |
| 6 | 70198613 | 70198951 | + | int | 6377 |
| 6 | 70763026 | 70763514 | + | COL19A1 | 6378 |
| 6 | 72557316 | 72558341 | + | int | 6379 |
| 6 | 72730048 | 72730256 | + | RIMS1 | 6380 |
| 6 | 75911482 | 75912465 | − | COL12A1 | 6381 |
| 6 | 76976715 | 76977316 | + | int | 6382 |
| 6 | 81567340 | 81568024 | + | int | 6383 |
| 6 | 84429341 | 84430387 | + | int | 6384 |
| 6 | 85892527 | 85892999 | + | int | 6385 |
| 6 | 88659936 | 88660338 | + | int | 6386 |
| 6 | 89112651 | 89113864 | + | int | 6387 |
| 6 | 90341842 | 90343216 | + | ANKRD6 | 6388 |
| 6 | 90341842 | 90343216 | + | ANKRD6 | 6389 |
| 6 | 90341842 | 90343216 | + | ANKRD6 | 6390 |
| 6 | 90341842 | 90343216 | − | LYRM2 | 6391 |
| 6 | 90341842 | 90343216 | − | LYRM2 | 6392 |
| 6 | 91264712 | 91266590 | − | MAP3K7 | 6393 |
| 6 | 92537279 | 92538089 | + | int | 6394 |
| 6 | 93565693 | 93568772 | + | int | 6395 |
| 6 | 93572345 | 93572558 | + | int | 6396 |
| 6 | 94012062 | 94012891 | − | EPHA7 | 6397 |
| 6 | 94126138 | 94127416 | − | EPHA7 | 6398 |

TABLE 2-continued

| chromosome | start | stop | strand | nearest gene | ID |
|---|---|---|---|---|---|
| 6 | 95958786 | 95959277 | + | int | 6399 |
| 6 | 96650823 | 96651990 | + | FUT9 | 6400 |
| 6 | 98147862 | 98148282 | + | int | 6401 |
| 6 | 98664881 | 98665155 | + | int | 6402 |
| 6 | 98881434 | 98881924 | + | int | 6403 |
| 6 | 99243221 | 99244290 | + | int | 6404 |
| 6 | 100738133 | 100738409 | + | int | 6405 |
| 6 | 100837981 | 100839404 | − | SIM1 | 6406 |
| 6 | 101021760 | 101021948 | − | ASCC3 | 6407 |
| 6 | 102074220 | 102074802 | + | GRIK2 | 6408 |
| 6 | 102080679 | 102083061 | + | GRIK2 | 6409 |
| 6 | 102110512 | 102111866 | + | GRIK2 | 6410 |
| 6 | 102265421 | 102266300 | + | GRIK2 | 6411 |
| 6 | 102513725 | 102514741 | + | GRIK2 | 6412 |
| 6 | 103017837 | 103017999 | + | int | 6413 |
| 6 | 103162056 | 103162688 | + | int | 6414 |
| 6 | 103855190 | 103855311 | + | int | 6415 |
| 6 | 104171488 | 104172492 | + | int | 6416 |
| 6 | 105388366 | 105389856 | − | LINC00577 | 6417 |
| 6 | 110664137 | 110664247 | − | METTL24 | 6418 |
| 6 | 111587075 | 111588093 | + | KIAA1919 | 6419 |
| 6 | 113142189 | 113142318 | + | int | 6420 |
| 6 | 113337202 | 113337395 | + | int | 6421 |
| 6 | 114384949 | 114385489 | + | int | 6422 |
| 6 | 115151091 | 115151645 | + | int | 6423 |
| 6 | 116062270 | 116062540 | + | int | 6424 |
| 6 | 118556982 | 118558192 | + | SLC35F1 | 6425 |
| 6 | 120711284 | 120711618 | + | int | 6426 |
| 6 | 120869251 | 120869795 | + | int | 6427 |
| 6 | 121547809 | 121548098 | − | C6orf170 | 6428 |
| 6 | 121992616 | 121992780 | + | int | 6429 |
| 6 | 122371062 | 122371835 | + | int | 6430 |
| 6 | 122540242 | 122540652 | + | int | 6431 |
| 6 | 122595057 | 122595450 | + | int | 6432 |
| 6 | 123723730 | 123723936 | − | TRDN | 6433 |
| 6 | 123723730 | 123723936 | − | TRDN | 6434 |
| 6 | 124162774 | 124163111 | + | NKAIN2 | 6435 |
| 6 | 124678438 | 124678894 | + | NKAIN2 | 6436 |
| 6 | 124772563 | 124772926 | + | NKAIN2 | 6437 |
| 6 | 124832365 | 124832598 | + | NKAIN2 | 6438 |
| 6 | 126760449 | 126761337 | + | int | 6439 |
| 6 | 127352019 | 127354264 | + | int | 6440 |
| 6 | 127420885 | 127421098 | + | int | 6441 |
| 6 | 129425614 | 129427003 | + | LAMA2 | 6442 |
| 6 | 130761534 | 130762542 | + | TMEM200A | 6443 |
| 6 | 130761534 | 130762542 | + | TMEM200A | 6444 |
| 6 | 130761534 | 130762542 | + | TMEM200A | 6445 |
| 6 | 132469883 | 132470161 | + | LOC100507254 | 6446 |
| 6 | 132815708 | 132816930 | − | STX7 | 6447 |
| 6 | 132921228 | 132921423 | + | int | 6448 |
| 6 | 133153743 | 133154243 | + | int | 6449 |
| 6 | 133731456 | 133732666 | + | EYA4 | 6450 |
| 6 | 136857975 | 136858418 | − | MAP7 | 6451 |
| 6 | 140134428 | 140134887 | + | LOC100132735 | 6452 |
| 6 | 140643216 | 140644851 | + | int | 6453 |
| 6 | 140646470 | 140664490 | + | int | 6454 |
| 6 | 140982791 | 140983126 | + | int | 6455 |
| 6 | 141004989 | 141005589 | + | MIR4465 | 6456 |
| 6 | 141140157 | 141140638 | + | int | 6457 |
| 6 | 141653382 | 141653715 | + | int | 6458 |
| 6 | 141674150 | 141674486 | + | int | 6459 |
| 6 | 141754905 | 141756527 | + | int | 6460 |
| 6 | 142038274 | 142038529 | + | int | 6461 |
| 6 | 145381863 | 145382238 | + | int | 6462 |
| 6 | 145897384 | 145897588 | + | int | 6463 |
| 6 | 147228176 | 147228848 | − | STXBP5-AS1 | 6464 |
| 6 | 151365907 | 151367099 | + | MTHFD1L | 6465 |
| 6 | 151365907 | 151367099 | + | MTHFD1L | 6466 |
| 6 | 152237896 | 152238905 | + | ESR1 | 6467 |
| 6 | 152237896 | 152238905 | + | ESR1 | 6468 |
| 6 | 152237896 | 152238905 | + | ESR1 | 6469 |
| 6 | 152237896 | 152238905 | + | ESR1 | 6470 |
| 6 | 153631840 | 153632691 | + | int | 6471 |
| 6 | 156692994 | 156693562 | + | int | 6472 |
| 6 | 157396844 | 157397403 | + | ARID1B | 6473 |
| 6 | 158921439 | 158922875 | + | TULP4 | 6474 |
| 6 | 158932957 | 158935524 | + | int | 6475 |
| 6 | 159026914 | 159028296 | + | TMEM181 | 6476 |

TABLE 2-continued

| chromosome | start | stop | strand | nearest gene | ID |
|---|---|---|---|---|---|
| 6 | 159045270 | 159046532 | + | TMEM181 | 6477 |
| 6 | 159085235 | 159085754 | + | SYTL3 | 6478 |
| 6 | 159085235 | 159085754 | + | SYTL3 | 6479 |
| 6 | 159139724 | 159141869 | + | SYTL3 | 6480 |
| 6 | 159370777 | 159374306 | + | int | 6481 |
| 6 | 162624080 | 162624905 | − | PARK2 | 6482 |
| 6 | 163846824 | 163847276 | + | QKI | 6483 |
| 6 | 164347628 | 164349243 | + | int | 6484 |
| 6 | 166342574 | 166343292 | − | LINC00473 | 6485 |
| 6 | 167570865 | 167571929 | − | GPR31 | 6486 |
| 6 | 167570973 | 167571929 | − | GPR31 | 6487 |
| 6 | 167723956 | 167725135 | + | UNC93A | 6488 |
| 6 | 167744131 | 167753631 | + | TTLL2 | 6489 |
| 6 | 167744131 | 167753684 | + | TTLL2 | 6490 |
| 6 | 168366073 | 168367094 | + | MLLT4 | 6491 |
| 6 | 170160499 | 170166728 | + | C6orf70 | 6492 |
| 6 | 170160658 | 170166697 | + | C6orf70 | 6493 |
| 7 | 8950599 | 8950793 | + | int | 6494 |
| 7 | 8965227 | 8965681 | + | int | 6495 |
| 7 | 9157021 | 9157914 | + | int | 6496 |
| 7 | 9185161 | 9186225 | + | int | 6497 |
| 7 | 10281343 | 10283294 | + | int | 6498 |
| 7 | 10458497 | 10459160 | + | int | 6499 |
| 7 | 10837165 | 10838117 | + | int | 6500 |
| 7 | 11514737 | 11515808 | − | THSD7A | 6501 |
| 7 | 14412888 | 14413905 | − | DGKB | 6502 |
| 7 | 14412888 | 14413905 | − | DGKB | 6503 |
| 7 | 14822694 | 14823340 | − | DGKB | 6504 |
| 7 | 14822694 | 14823340 | − | DGKB | 6505 |
| 7 | 15539458 | 15540002 | − | AGMO | 6506 |
| 7 | 15651764 | 15652620 | − | MEOX2 | 6507 |
| 7 | 17471730 | 17472041 | + | int | 6508 |
| 7 | 17815327 | 17815847 | + | int | 6509 |
| 7 | 18874694 | 18876199 | + | HDAC9 | 6510 |
| 7 | 18874694 | 18876199 | + | HDAC9 | 6511 |
| 7 | 18874694 | 18876199 | + | HDAC9 | 6512 |
| 7 | 19820501 | 19825293 | + | int | 6513 |
| 7 | 20068358 | 20068772 | + | int | 6514 |
| 7 | 20104434 | 20105810 | + | int | 6515 |
| 7 | 20148512 | 20149240 | + | int | 6516 |
| 7 | 21179439 | 21180389 | + | int | 6517 |
| 7 | 21412363 | 21414161 | + | int | 6518 |
| 7 | 23512974 | 23514838 | + | int | 6519 |
| 7 | 25600507 | 25600864 | + | int | 6520 |
| 7 | 25804458 | 25805684 | + | int | 6521 |
| 7 | 26231795 | 26236097 | − | HNRNPA2B1 | 6522 |
| 7 | 26593528 | 26594726 | + | int | 6523 |
| 7 | 29385891 | 29386887 | + | CHN2 | 6524 |
| 7 | 29909724 | 29911079 | + | WIPF3 | 6525 |
| 7 | 31682480 | 31683976 | + | CCDC129 | 6526 |
| 7 | 31682480 | 31683976 | + | CCDC129 | 6527 |
| 7 | 31682480 | 31683976 | + | CCDC129 | 6528 |
| 7 | 31682480 | 31683976 | + | CCDC129 | 6529 |
| 7 | 31961290 | 31961850 | − | PDE1C | 6530 |
| 7 | 31961290 | 31961850 | − | PDE1C | 6531 |
| 7 | 31961290 | 31961850 | − | PDE1C | 6532 |
| 7 | 31961290 | 31961850 | − | PDE1C | 6533 |
| 7 | 31961290 | 31961850 | − | PDE1C | 6534 |
| 7 | 35522088 | 35522888 | + | int | 6535 |
| 7 | 37768761 | 37769858 | + | int | 6536 |
| 7 | 38449340 | 38449488 | − | AMPH | 6537 |
| 7 | 39180263 | 39181373 | + | POU6F2 | 6538 |
| 7 | 41245499 | 41245615 | + | int | 6539 |
| 7 | 42433062 | 42435724 | + | NUDCD3 | 6540 |
| 7 | 44507439 | 44507962 | − | NUDCD3 | 6541 |
| 7 | 48074760 | 48076312 | + | C7orf57 | 6542 |
| 7 | 50122472 | 50122918 | − | ZPBP | 6543 |
| 7 | 51417478 | 51418591 | + | int | 6544 |
| 7 | 53998338 | 53998630 | + | int | 6545 |
| 7 | 54087664 | 54087985 | + | int | 6546 |
| 7 | 54122728 | 54123050 | + | int | 6547 |
| 7 | 54613953 | 54614746 | + | VSTM2A | 6548 |
| 7 | 54710344 | 54711645 | + | int | 6549 |
| 7 | 65705217 | 65706321 | + | TPST1 | 6550 |
| 7 | 66927614 | 66928652 | + | int | 6551 |
| 7 | 66949150 | 66949865 | + | int | 6552 |
| 7 | 73096550 | 73097720 | − | DNAJC30 | 6553 |
| 7 | 73399859 | 73400514 | + | int | 6554 |

TABLE 2-continued

| chromosome | start | stop | strand | nearest gene | ID |
|---|---|---|---|---|---|
| 7 | 79999579 | 79999916 | + | int | 6555 |
| 7 | 80412150 | 80413593 | − | SEMA3C | 6556 |
| 7 | 81866949 | 81867718 | − | CACNA2D1 | 6557 |
| 7 | 83590260 | 83591305 | − | SEMA3A | 6558 |
| 7 | 83660027 | 83661507 | − | SEMA3A | 6559 |
| 7 | 83913220 | 83914205 | + | int | 6560 |
| 7 | 85272859 | 85273621 | + | int | 6561 |
| 7 | 85556776 | 85556905 | + | int | 6562 |
| 7 | 87154148 | 87159767 | − | ABCB1 | 6563 |
| 7 | 87671866 | 87671986 | + | ADAM22 | 6564 |
| 7 | 87671866 | 87671986 | + | ADAM22 | 6565 |
| 7 | 89285815 | 89285949 | + | int | 6566 |
| 7 | 91241010 | 91241798 | + | int | 6567 |
| 7 | 91275858 | 91280740 | + | int | 6568 |
| 7 | 92138296 | 92139078 | − | PEX1 | 6569 |
| 7 | 92462386 | 92466442 | − | CDK6 | 6570 |
| 7 | 92462386 | 92466442 | − | CDK6 | 6571 |
| 7 | 92462416 | 92466470 | − | CDK6 | 6572 |
| 7 | 92462416 | 92466470 | − | CDK6 | 6573 |
| 7 | 92542306 | 92544684 | + | int | 6574 |
| 7 | 92673061 | 92674580 | + | int | 6575 |
| 7 | 92932201 | 92933112 | + | CCDC132 | 6576 |
| 7 | 93051369 | 93051566 | + | int | 6577 |
| 7 | 94138044 | 94139428 | + | CASD1 | 6578 |
| 7 | 94147971 | 94149219 | + | CASD1 | 6579 |
| 7 | 94528029 | 94528246 | + | int | 6580 |
| 7 | 95401670 | 95402755 | + | DYNC1I1 | 6581 |
| 7 | 98237302 | 98237443 | + | int | 6582 |
| 7 | 99765826 | 99767163 | − | GAL3ST4 | 6583 |
| 7 | 100309077 | 100309558 | + | int | 6584 |
| 7 | 102950795 | 102951024 | + | PMPCB | 6585 |
| 7 | 103324542 | 103325289 | − | RELN | 6586 |
| 7 | 104377292 | 104378198 | + | LHFPL3 | 6587 |
| 7 | 107820262 | 107821052 | − | NRCAM | 6588 |
| 7 | 107820262 | 107821052 | − | NRCAM | 6589 |
| 7 | 107964420 | 107965575 | − | NRCAM | 6590 |
| 7 | 109863976 | 109865022 | + | int | 6591 |
| 7 | 110251763 | 110251913 | + | int | 6592 |
| 7 | 110521959 | 110523007 | − | IMMP2L | 6593 |
| 7 | 110521959 | 110523007 | − | IMMP2L | 6594 |
| 7 | 110829829 | 110830881 | − | IMMP2L | 6595 |
| 7 | 110829829 | 110830881 | − | IMMP2L | 6596 |
| 7 | 112788413 | 112789377 | + | int | 6597 |
| 7 | 113105258 | 113105763 | + | int | 6598 |
| 7 | 114349206 | 114349885 | + | int | 6599 |
| 7 | 114875910 | 114876802 | + | int | 6600 |
| 7 | 115520995 | 115522169 | + | int | 6601 |
| 7 | 116825349 | 116828438 | + | ST7 | 6602 |
| 7 | 116825349 | 116828438 | + | ST7 | 6603 |
| 7 | 116825349 | 116828438 | + | ST7-OT3 | 6604 |
| 7 | 117651642 | 117652244 | + | int | 6605 |
| 7 | 119556816 | 119557483 | + | int | 6606 |
| 7 | 119935871 | 119936432 | + | KCND2 | 6607 |
| 7 | 119980649 | 119981229 | + | KCND2 | 6608 |
| 7 | 120929056 | 120936009 | + | CPED1 | 6609 |
| 7 | 121038776 | 121038879 | + | int | 6610 |
| 7 | 121281549 | 121282063 | + | int | 6611 |
| 7 | 121316315 | 121317100 | + | int | 6612 |
| 7 | 122624654 | 122625029 | + | int | 6613 |
| 7 | 123771455 | 123772651 | + | int | 6614 |
| 7 | 126986838 | 126988191 | + | int | 6615 |
| 7 | 127353470 | 127354435 | + | SND1 | 6616 |
| 7 | 131153643 | 131155888 | + | MKLN1 | 6617 |
| 7 | 131153643 | 131155888 | + | MKLN1 | 6618 |
| 7 | 131834785 | 131835762 | − | PLXNA4 | 6619 |
| 7 | 133017614 | 133017817 | + | EXOC4 | 6620 |
| 7 | 133017614 | 133017817 | + | EXOC4 | 6621 |
| 7 | 133079833 | 133080477 | + | EXOC4 | 6622 |
| 7 | 133079833 | 133080477 | + | EXOC4 | 6623 |
| 7 | 133643548 | 133643738 | + | EXOC4 | 6624 |
| 7 | 134019530 | 134021757 | + | int | 6625 |
| 7 | 135492681 | 135493702 | + | int | 6626 |
| 7 | 136025700 | 136026358 | + | int | 6627 |
| 7 | 137574879 | 137576026 | − | CREB3L2 | 6628 |
| 7 | 139790678 | 139791489 | − | JHDM1D | 6629 |
| 7 | 142229269 | 142229616 | + | int | 6630 |
| 7 | 143185504 | 143185552 | + | EPHA1-AS1 | 6631 |
| 7 | 143657071 | 143657964 | + | OR2F1 | 6632 |

TABLE 2-continued

| chromosome | start | stop | strand | nearest gene | ID |
|---|---|---|---|---|---|
| 7 | 143793594 | 143794281 | + | int | 6633 |
| 7 | 144680390 | 144681438 | + | int | 6634 |
| 7 | 144841967 | 144842466 | + | int | 6635 |
| 7 | 145586081 | 145586752 | + | int | 6636 |
| 7 | 145725000 | 145725133 | + | int | 6637 |
| 7 | 145964896 | 145965109 | + | CNTNAP2 | 6638 |
| 7 | 146409513 | 146409987 | + | CNTNAP2 | 6639 |
| 7 | 146748920 | 146749238 | + | CNTNAP2 | 6640 |
| 7 | 146820722 | 146822585 | + | CNTNAP2 | 6641 |
| 7 | 146876800 | 146877428 | + | CNTNAP2 | 6642 |
| 7 | 155100398 | 155101502 | + | INSIG1 | 6643 |
| 7 | 155246818 | 155247783 | + | int | 6644 |
| 7 | 157373664 | 157373878 | − | PTPRN2 | 6645 |
| 8 | 1999985 | 2001093 | + | MYOM2 | 6646 |
| 8 | 2375326 | 2376050 | + | int | 6647 |
| 8 | 3263003 | 3264138 | − | CSMD1 | 6648 |
| 8 | 3854632 | 3855716 | − | CSMD1 | 6649 |
| 8 | 5560623 | 5561792 | + | int | 6650 |
| 8 | 5715205 | 5716404 | + | int | 6651 |
| 8 | 6068728 | 6069191 | + | int | 6652 |
| 8 | 8739509 | 8741622 | − | MFHAS1 | 6653 |
| 8 | 10772178 | 10773492 | − | XKR6 | 6654 |
| 8 | 14921694 | 14922871 | − | SGCZ | 6655 |
| 8 | 15373524 | 15373989 | + | int | 6656 |
| 8 | 21016360 | 21017295 | + | int | 6657 |
| 8 | 21762162 | 21763736 | + | int | 6658 |
| 8 | 27114630 | 27115730 | − | STMN4 | 6659 |
| 8 | 28625074 | 28625978 | − | INTS9 | 6660 |
| 8 | 28625074 | 28625978 | − | INTS9 | 6661 |
| 8 | 29544755 | 29545677 | + | int | 6662 |
| 8 | 31461424 | 31464559 | + | int | 6663 |
| 8 | 33255494 | 33255714 | − | FUT10 | 6664 |
| 8 | 34170578 | 34172316 | + | int | 6665 |
| 8 | 34357556 | 34358603 | + | int | 6666 |
| 8 | 34423884 | 34424691 | + | int | 6667 |
| 8 | 48105418 | 48106013 | + | int | 6668 |
| 8 | 49430852 | 49431514 | + | int | 6669 |
| 8 | 53173292 | 53173953 | − | ST18 | 6670 |
| 8 | 54718087 | 54718219 | − | ATP6V1H | 6671 |
| 8 | 54718087 | 54718219 | − | ATP6V1H | 6672 |
| 8 | 54957845 | 54958899 | + | int | 6673 |
| 8 | 55729007 | 55729258 | + | int | 6674 |
| 8 | 57066292 | 57066450 | + | int | 6675 |
| 8 | 61633964 | 61634857 | + | CHD7 | 6676 |
| 8 | 62491097 | 62492180 | − | ASPH | 6677 |
| 8 | 62491097 | 62492180 | − | ASPH | 6678 |
| 8 | 63618060 | 63626064 | + | NKAIN3 | 6679 |
| 8 | 64820715 | 64823755 | + | int | 6680 |
| 8 | 67384008 | 67385042 | + | int | 6681 |
| 8 | 67543965 | 67545285 | − | VCPIP1 | 6682 |
| 8 | 70364610 | 70365255 | + | int | 6683 |
| 8 | 75830795 | 75831517 | + | int | 6684 |
| 8 | 76989862 | 76990217 | + | int | 6685 |
| 8 | 77799090 | 77799477 | + | int | 6686 |
| 8 | 78118735 | 78119254 | + | int | 6687 |
| 8 | 78484257 | 78485519 | + | int | 6688 |
| 8 | 79993707 | 79994804 | + | int | 6689 |
| 8 | 81166642 | 81169331 | + | int | 6690 |
| 8 | 81470419 | 81470793 | + | int | 6691 |
| 8 | 82838201 | 82838397 | + | int | 6692 |
| 8 | 83215521 | 83218133 | + | int | 6693 |
| 8 | 83401018 | 83401517 | + | int | 6694 |
| 8 | 83437945 | 83438297 | + | int | 6695 |
| 8 | 84168099 | 84168233 | + | int | 6696 |
| 8 | 85366877 | 85367506 | + | RALYL | 6697 |
| 8 | 85366877 | 85367506 | + | RALYL | 6698 |
| 8 | 85366877 | 85367506 | + | RALYL | 6699 |
| 8 | 86084700 | 86085502 | + | int | 6700 |
| 8 | 86902338 | 86902845 | + | int | 6701 |
| 8 | 88636214 | 88637052 | + | int | 6702 |
| 8 | 88993718 | 88994704 | + | int | 6703 |
| 8 | 89227250 | 89227746 | − | MMP16 | 6704 |
| 8 | 89560106 | 89560773 | + | int | 6705 |
| 8 | 90238565 | 90238973 | + | int | 6706 |
| 8 | 90293015 | 90293388 | + | int | 6707 |
| 8 | 90492310 | 90493228 | + | int | 6708 |
| 8 | 90582702 | 90583056 | + | int | 6709 |
| 8 | 91771384 | 91774733 | + | int | 6710 |

TABLE 2-continued

| chromosome | start | stop | strand | nearest gene | ID |
|---|---|---|---|---|---|
| 8 | 92097106 | 92098484 | + | OTUD6B | 6711 |
| 8 | 92326915 | 92327384 | + | SLC26A7 | 6712 |
| 8 | 92326915 | 92327384 | + | SLC26A7 | 6713 |
| 8 | 93728953 | 93729178 | − | FLJ46284 | 6714 |
| 8 | 93890889 | 93891005 | + | int | 6715 |
| 8 | 97312337 | 97312728 | + | PTDSS1 | 6716 |
| 8 | 97974138 | 97974487 | + | CPQ | 6717 |
| 8 | 98072420 | 98073343 | + | CPQ | 6718 |
| 8 | 98114249 | 98115224 | + | CPQ | 6719 |
| 8 | 102568853 | 102569784 | + | GRHL2 | 6720 |
| 8 | 104897371 | 104898807 | + | RIMS2 | 6721 |
| 8 | 104897371 | 104898807 | + | RIMS2 | 6722 |
| 8 | 104917218 | 104917848 | + | RIMS2 | 6723 |
| 8 | 104917218 | 104917848 | + | RIMS2 | 6724 |
| 8 | 106134096 | 106134778 | + | int | 6725 |
| 8 | 106450489 | 106454147 | + | ZFPM2 | 6726 |
| 8 | 106563713 | 106564941 | + | ZFPM2 | 6727 |
| 8 | 107216842 | 107217414 | + | int | 6728 |
| 8 | 109553309 | 109553685 | + | int | 6729 |
| 8 | 110518363 | 110518727 | + | PKHD1L1 | 6730 |
| 8 | 110636542 | 110637312 | − | SYBU | 6731 |
| 8 | 110636542 | 110637312 | − | SYBU | 6732 |
| 8 | 110636542 | 110637312 | − | SYBU | 6733 |
| 8 | 110636542 | 110637312 | − | SYBU | 6734 |
| 8 | 110636542 | 110637312 | − | SYBU | 6735 |
| 8 | 110636542 | 110637312 | − | SYBU | 6736 |
| 8 | 111213981 | 111215585 | + | int | 6737 |
| 8 | 112824040 | 112824228 | + | int | 6738 |
| 8 | 112942537 | 112942862 | + | int | 6739 |
| 8 | 113155124 | 113155381 | + | int | 6740 |
| 8 | 113789235 | 113789703 | − | CSMD3 | 6741 |
| 8 | 113789235 | 113789703 | − | CSMD3 | 6742 |
| 8 | 114808001 | 114810295 | + | int | 6743 |
| 8 | 114945451 | 114945920 | + | int | 6744 |
| 8 | 114945945 | 114946382 | + | int | 6745 |
| 8 | 114989625 | 115001762 | + | int | 6746 |
| 8 | 115880641 | 115881390 | + | int | 6747 |
| 8 | 116175349 | 116175618 | + | int | 6748 |
| 8 | 116598956 | 116599981 | − | TRPS1 | 6749 |
| 8 | 116631205 | 116632609 | − | TRPS1 | 6750 |
| 8 | 116783876 | 116785167 | + | int | 6751 |
| 8 | 116899782 | 116901024 | + | int | 6752 |
| 8 | 118445882 | 118446273 | + | int | 6753 |
| 8 | 119305892 | 119307108 | − | SAMD12 | 6754 |
| 8 | 119657830 | 119659599 | + | SAMD12-AS1 | 6755 |
| 8 | 120450727 | 120450954 | + | int | 6756 |
| 8 | 122468700 | 122468847 | + | int | 6757 |
| 8 | 122479498 | 122480632 | + | int | 6758 |
| 8 | 124664080 | 124665080 | − | KLHL38 | 6759 |
| 8 | 124952253 | 124955429 | + | FER1L6 | 6760 |
| 8 | 128911760 | 128913191 | + | PVT1 | 6761 |
| 8 | 129483636 | 129484329 | + | int | 6762 |
| 8 | 129497669 | 129497997 | + | int | 6763 |
| 8 | 135422187 | 135422557 | + | int | 6764 |
| 8 | 136284944 | 136286046 | + | LOC286094 | 6765 |
| 8 | 137050481 | 137051433 | + | int | 6766 |
| 8 | 137189535 | 137190834 | + | int | 6767 |
| 8 | 137598203 | 137598757 | + | int | 6768 |
| 8 | 137632256 | 137633435 | + | int | 6769 |
| 8 | 142169638 | 142171148 | + | DENND3 | 6770 |
| 8 | 144620207 | 144623604 | − | ZC3H3 | 6771 |
| 8 | 146067824 | 146068567 | + | ZNF7 | 6772 |
| 9 | 5928164 | 5928637 | − | KIAA2026 | 6773 |
| 9 | 6071795 | 6072372 | + | int | 6774 |
| 9 | 7150464 | 7151261 | + | KDM4C | 6775 |
| 9 | 7150464 | 7151261 | + | KDM4C | 6776 |
| 9 | 7604507 | 7605196 | + | int | 6777 |
| 9 | 7638897 | 7639112 | + | int | 6778 |
| 9 | 8297792 | 8298396 | + | int | 6779 |
| 9 | 9222421 | 9223630 | − | PTPRD | 6780 |
| 9 | 10101155 | 10101561 | − | PTPRD | 6781 |
| 9 | 10130213 | 10131254 | − | PTPRD | 6782 |
| 9 | 10326964 | 10327935 | − | PTPRD | 6783 |
| 9 | 10660977 | 10662112 | + | int | 6784 |
| 9 | 10918241 | 10918539 | + | int | 6785 |
| 9 | 11025215 | 11025459 | + | int | 6786 |
| 9 | 12408382 | 12408652 | + | int | 6787 |
| 9 | 12563721 | 12563988 | + | int | 6788 |

TABLE 2-continued

| chromosome | start | stop | strand | nearest gene | ID |
|---|---|---|---|---|---|
| 9 | 13986155 | 13987338 | + | int | 6789 |
| 9 | 14108578 | 14109672 | − | NFIB | 6790 |
| 9 | 14108578 | 14109672 | − | NFIB | 6791 |
| 9 | 14541678 | 14542558 | + | int | 6792 |
| 9 | 14618529 | 14619528 | − | ZDHHC21 | 6793 |
| 9 | 14920807 | 14922429 | + | int | 6794 |
| 9 | 14920871 | 14922346 | + | int | 6795 |
| 9 | 15980676 | 15980801 | + | int | 6796 |
| 9 | 16759558 | 16761363 | − | BNC2 | 6797 |
| 9 | 18192783 | 18199554 | + | int | 6798 |
| 9 | 23744656 | 23745342 | − | ELAVL2 | 6799 |
| 9 | 23744656 | 23745342 | − | ELAVL2 | 6800 |
| 9 | 23744656 | 23745342 | − | ELAVL2 | 6801 |
| 9 | 23833799 | 23834847 | + | int | 6802 |
| 9 | 24502290 | 24503236 | + | int | 6803 |
| 9 | 25224161 | 25224349 | + | int | 6804 |
| 9 | 25236338 | 25236629 | + | int | 6805 |
| 9 | 25270684 | 25271490 | + | int | 6806 |
| 9 | 26207682 | 26208198 | + | int | 6807 |
| 9 | 26617222 | 26618488 | + | int | 6808 |
| 9 | 27876619 | 27876958 | + | int | 6809 |
| 9 | 28385187 | 28386101 | − | LINGO2 | 6810 |
| 9 | 28385187 | 28386101 | − | LINGO2 | 6811 |
| 9 | 28704581 | 28705677 | − | LINGO2 | 6812 |
| 9 | 28704581 | 28705677 | − | LINGO2 | 6813 |
| 9 | 28845733 | 28846128 | − | LINGO2 | 6814 |
| 9 | 29327750 | 29329960 | + | int | 6815 |
| 9 | 29962475 | 29963172 | + | int | 6816 |
| 9 | 30170421 | 30170708 | + | int | 6817 |
| 9 | 31074583 | 31074932 | + | int | 6818 |
| 9 | 31319195 | 31319532 | + | int | 6819 |
| 9 | 33466218 | 33467263 | − | NOL6 | 6820 |
| 9 | 34824039 | 34824234 | + | int | 6821 |
| 9 | 34824039 | 34824340 | + | int | 6822 |
| 9 | 36669391 | 36671229 | + | MELK | 6823 |
| 9 | 39071521 | 39071998 | + | int | 6824 |
| 9 | 40382480 | 40383308 | + | int | 6825 |
| 9 | 72174788 | 72175275 | − | APBA1 | 6826 |
| 9 | 73375900 | 73376053 | − | TRPM3 | 6827 |
| 9 | 73375900 | 73376053 | − | TRPM3 | 6828 |
| 9 | 73711649 | 73712164 | − | TRPM3 | 6829 |
| 9 | 73880240 | 73880972 | + | int | 6830 |
| 9 | 76282658 | 76283420 | + | int | 6831 |
| 9 | 77107896 | 77109846 | + | int | 6832 |
| 9 | 79095438 | 79102451 | + | GCNT1 | 6833 |
| 9 | 79095438 | 79102451 | + | GCNT1 | 6834 |
| 9 | 79095438 | 79102451 | + | GCNT1 | 6835 |
| 9 | 81247236 | 81248295 | + | int | 6836 |
| 9 | 82089997 | 82090139 | + | int | 6837 |
| 9 | 82749531 | 82750556 | + | int | 6838 |
| 9 | 90498319 | 90499210 | + | SPATA31E1 | 6839 |
| 9 | 91433664 | 91434485 | + | int | 6840 |
| 9 | 93600731 | 93604821 | + | SYK | 6841 |
| 9 | 93600731 | 93604821 | + | SYK | 6842 |
| 9 | 93600731 | 93604821 | + | SYK | 6843 |
| 9 | 95040963 | 95041848 | − | IARS | 6844 |
| 9 | 96434994 | 96435177 | + | PHF2 | 6845 |
| 9 | 101881980 | 101882161 | + | TGFBR1 | 6846 |
| 9 | 104575436 | 104576474 | + | int | 6847 |
| 9 | 104886441 | 104887080 | + | int | 6848 |
| 9 | 105147410 | 105148878 | + | int | 6849 |
| 9 | 106649826 | 106650020 | + | int | 6850 |
| 9 | 107893809 | 107895195 | + | int | 6851 |
| 9 | 108117713 | 108118905 | + | SLC44A1 | 6852 |
| 9 | 118271459 | 118272553 | + | int | 6853 |
| 9 | 118877211 | 118877407 | + | int | 6854 |
| 9 | 119354947 | 119356093 | − | ASTN2 | 6855 |
| 9 | 119354947 | 119356093 | − | ASTN2 | 6856 |
| 9 | 119354947 | 119356093 | − | ASTN2 | 6857 |
| 9 | 120926323 | 120927669 | + | int | 6858 |
| 9 | 121027876 | 121028794 | + | int | 6859 |
| 9 | 121299424 | 121300110 | + | int | 6860 |
| 9 | 121425459 | 121425679 | + | int | 6861 |
| 9 | 121721610 | 121722428 | + | int | 6862 |
| 9 | 122424480 | 122425480 | + | int | 6863 |
| 9 | 124890779 | 124892173 | + | int | 6864 |
| 9 | 125485962 | 125489020 | + | OR1L4 | 6865 |
| 9 | 125511751 | 125512961 | + | OR1L6 | 6866 |

TABLE 2-continued

| chromosome | start | stop | strand | nearest gene | ID |
|---|---|---|---|---|---|
| 9 | 126241138 | 126243210 | − | DENND1A | 6867 |
| 9 | 126241138 | 126243210 | − | DENND1A | 6868 |
| 9 | 129172153 | 129173670 | + | MVB12B | 6869 |
| 9 | 129172153 | 129173670 | − | NRON | 6870 |
| 9 | 132589966 | 132597019 | − | C9orf78 | 6871 |
| 9 | 135680331 | 135681076 | − | AK8 | 6872 |
| 9 | 137409871 | 137410859 | + | int | 6873 |
| 9 | 138803540 | 138804020 | + | int | 6874 |
| 9 | 138881183 | 138882179 | + | int | 6875 |
| 9 | 139411757 | 139412842 | − | NOTCH1 | 6876 |
| 9 | 139478798 | 139479357 | + | int | 6877 |
| 9 | 139917794 | 139918987 | − | ABCA2 | 6878 |
| 9 | 139917794 | 139918987 | − | ABCA2 | 6879 |
| 10 | 2347129 | 2347305 | − | LINC00701 | 6880 |
| 10 | 4154653 | 4155841 | + | int | 6881 |
| 10 | 4649960 | 4650199 | + | int | 6882 |
| 10 | 7986728 | 7992109 | + | TAF3 | 6883 |
| 10 | 10267333 | 10267492 | + | int | 6884 |
| 10 | 10372681 | 10373039 | + | int | 6885 |
| 10 | 11456276 | 11457244 | + | int | 6886 |
| 10 | 11657799 | 11661007 | + | int | 6887 |
| 10 | 12781791 | 12783013 | + | CAMK1D | 6888 |
| 10 | 12781791 | 12783013 | + | CAMK1D | 6889 |
| 10 | 13057582 | 13058723 | + | int | 6890 |
| 10 | 16270745 | 16271460 | + | int | 6891 |
| 10 | 17191022 | 17191828 | − | TRDMT1 | 6892 |
| 10 | 17769104 | 17769920 | + | int | 6893 |
| 10 | 20224126 | 20224604 | + | PLXDC2 | 6894 |
| 10 | 24922013 | 24922695 | − | ARHGAP21 | 6895 |
| 10 | 27388862 | 27389105 | − | ANKRD26 | 6896 |
| 10 | 28286558 | 28288263 | − | ARMC4 | 6897 |
| 10 | 29063010 | 29064250 | + | int | 6898 |
| 10 | 30524996 | 30525626 | + | int | 6899 |
| 10 | 32760883 | 32761130 | + | CCDC7 | 6900 |
| 10 | 33112468 | 33113343 | + | C10orf68 | 6901 |
| 10 | 36831348 | 36831770 | + | int | 6902 |
| 10 | 43492194 | 43493689 | + | MIR5100 | 6903 |
| 10 | 44285047 | 44285872 | − | HNRNPA3P1 | 6904 |
| 10 | 44669621 | 44670144 | + | int | 6905 |
| 10 | 45498422 | 45499693 | + | ZNF22 | 6906 |
| 10 | 49371264 | 49371972 | − | FRMPD2 | 6907 |
| 10 | 49371264 | 49371972 | − | FRMPD2 | 6908 |
| 10 | 49371264 | 49371972 | − | FRMPD2P1 | 6909 |
| 10 | 50189248 | 50190543 | + | WDFY4 | 6910 |
| 10 | 52067017 | 52071177 | − | SGMS1 | 6911 |
| 10 | 52103243 | 52103708 | − | SGMS1 | 6912 |
| 10 | 52267340 | 52268825 | − | SGMS1 | 6913 |
| 10 | 57275444 | 57276858 | + | int | 6914 |
| 10 | 57430573 | 57431225 | + | int | 6915 |
| 10 | 58798440 | 58799788 | + | int | 6916 |
| 10 | 58959274 | 58959997 | + | int | 6917 |
| 10 | 62682651 | 62689467 | − | RHOBTB1 | 6918 |
| 10 | 62682651 | 62689467 | − | RHOBTB1 | 6919 |
| 10 | 62682651 | 62689467 | − | RHOBTB1 | 6920 |
| 10 | 62870773 | 62871204 | + | int | 6921 |
| 10 | 63487670 | 63488701 | + | C10orf107 | 6922 |
| 10 | 63510339 | 63511068 | + | C10orf107 | 6923 |
| 10 | 65968884 | 65969030 | + | int | 6924 |
| 10 | 67679295 | 67680268 | − | CTNNA3 | 6925 |
| 10 | 67679295 | 67680268 | − | CTNNA3 | 6926 |
| 10 | 72099273 | 72100708 | − | LRRC20 | 6927 |
| 10 | 72099273 | 72100708 | − | LRRC20 | 6928 |
| 10 | 77172579 | 77172893 | + | int | 6929 |
| 10 | 77251007 | 77252240 | + | int | 6930 |
| 10 | 79613241 | 79615028 | − | DLG5 | 6931 |
| 10 | 80022208 | 80023149 | + | int | 6932 |
| 10 | 81631284 | 81631796 | + | int | 6933 |
| 10 | 83366360 | 83366956 | + | int | 6934 |
| 10 | 83491653 | 83492041 | + | int | 6935 |
| 10 | 83508923 | 83509334 | + | int | 6936 |
| 10 | 84024359 | 84027789 | + | NRG3 | 6937 |
| 10 | 84024359 | 84027789 | + | NRG3 | 6938 |
| 10 | 84646496 | 84647508 | + | NRG3 | 6939 |
| 10 | 84646496 | 84647508 | + | NRG3 | 6940 |
| 10 | 85481394 | 85481788 | + | int | 6941 |
| 10 | 85961836 | 85962831 | + | CDHR1 | 6942 |
| 10 | 85961836 | 85962831 | + | CDHR1 | 6943 |
| 10 | 86282547 | 86284456 | + | int | 6944 |

TABLE 2-continued

| chromosome | start | stop | strand | nearest gene | ID |
|---|---|---|---|---|---|
| 10 | 86309333 | 86310291 | + | int | 6945 |
| 10 | 87746572 | 87748079 | − | GRID1 | 6946 |
| 10 | 92005324 | 92006715 | + | int | 6947 |
| 10 | 92498583 | 92499216 | + | int | 6948 |
| 10 | 96802606 | 96803445 | − | CYP2C8 | 6949 |
| 10 | 96805002 | 96805262 | − | CYP2C8 | 6950 |
| 10 | 98446331 | 98447583 | − | PIK3AP1 | 6951 |
| 10 | 101578833 | 101579392 | + | ABCC2 | 6952 |
| 10 | 102472319 | 102473835 | + | int | 6953 |
| 10 | 107734141 | 107735267 | + | int | 6954 |
| 10 | 110245953 | 110246443 | + | int | 6955 |
| 10 | 112140940 | 112141352 | + | int | 6956 |
| 10 | 114380143 | 114381730 | + | VTI1A | 6957 |
| 10 | 114549798 | 114550603 | + | VTI1A | 6958 |
| 10 | 116708357 | 116708999 | + | TRUB1 | 6959 |
| 10 | 118131041 | 118132139 | + | CCDC172 | 6960 |
| 10 | 119712529 | 119713526 | + | int | 6961 |
| 10 | 120629973 | 120630906 | + | int | 6962 |
| 10 | 124007831 | 124009237 | + | TACC2 | 6963 |
| 10 | 124007831 | 124009237 | + | TACC2 | 6964 |
| 10 | 124106820 | 124108589 | + | int | 6965 |
| 10 | 124751354 | 124752355 | − | IKZF5 | 6966 |
| 10 | 124751354 | 124752355 | − | IKZF5 | 6967 |
| 10 | 125103900 | 125105084 | + | int | 6968 |
| 10 | 125664006 | 125664537 | + | int | 6969 |
| 10 | 126857840 | 126858092 | + | int | 6970 |
| 10 | 127355404 | 127356418 | − | TEX36 | 6971 |
| 10 | 132625678 | 132626199 | + | int | 6972 |
| 11 | 711054 | 713375 | + | EPS8L2 | 6973 |
| 11 | 1016985 | 1018532 | − | MUC6 | 6974 |
| 11 | 1215407 | 1216872 | + | int | 6975 |
| 11 | 1480169 | 1481163 | + | BRSK2 | 6976 |
| 11 | 1480169 | 1481163 | + | BRSK2 | 6977 |
| 11 | 1480169 | 1481163 | + | BRSK2 | 6978 |
| 11 | 3124474 | 3125652 | − | OSBPL5 | 6979 |
| 11 | 4681664 | 4682529 | + | int | 6980 |
| 11 | 4682529 | 4683072 | + | int | 6981 |
| 11 | 4682532 | 4683074 | + | int | 6982 |
| 11 | 4824313 | 4825542 | − | OR52R1 | 6983 |
| 11 | 4824622 | 4825843 | − | OR52R1 | 6984 |
| 11 | 5220970 | 5221870 | − | OR51V1 | 6985 |
| 11 | 5322224 | 5323227 | − | OR51B4 | 6986 |
| 11 | 5443392 | 5444381 | + | OR51Q1 | 6987 |
| 11 | 5443392 | 5444381 | − | OR51B5 | 6988 |
| 11 | 5443392 | 5444381 | − | OR51B5 | 6989 |
| 11 | 5988758 | 5989719 | − | OR56A5 | 6990 |
| 11 | 6424184 | 6425409 | − | APBB1 | 6991 |
| 11 | 6424184 | 6425409 | − | APBB1 | 6992 |
| 11 | 6424184 | 6425409 | − | APBB1 | 6993 |
| 11 | 6424184 | 6425409 | − | APBB1 | 6994 |
| 11 | 6424184 | 6425409 | − | APBB1 | 6995 |
| 11 | 6424184 | 6425409 | − | APBB1 | 6996 |
| 11 | 6424184 | 6425409 | − | APBB1 | 6997 |
| 11 | 6632075 | 6633308 | + | ILK | 6998 |
| 11 | 6632075 | 6633308 | + | ILK | 6999 |
| 11 | 6632075 | 6633308 | − | TAF10 | 7000 |
| 11 | 6814846 | 6817215 | − | OR6A2 | 7001 |
| 11 | 7817722 | 7818706 | − | OR5P2 | 7002 |
| 11 | 7869800 | 7871301 | + | OR5E1P | 7003 |
| 11 | 8230799 | 8231431 | + | int | 7004 |
| 11 | 8237344 | 8238026 | + | int | 7005 |
| 11 | 8804861 | 8810696 | − | ST5 | 7006 |
| 11 | 8804861 | 8810696 | − | ST5 | 7007 |
| 11 | 8804861 | 8810696 | − | ST5 | 7008 |
| 11 | 10718385 | 10719371 | + | int | 7009 |
| 11 | 17032956 | 17033337 | − | PLEKHA7 | 7010 |
| 11 | 17411919 | 17412831 | + | int | 7011 |
| 11 | 17840917 | 17842597 | − | SERGEF | 7012 |
| 11 | 18908107 | 18909344 | + | int | 7013 |
| 11 | 21050814 | 21051005 | + | NELL1 | 7014 |
| 11 | 21207748 | 21208037 | + | NELL1 | 7015 |
| 11 | 21592065 | 21592716 | + | NELL1 | 7016 |
| 11 | 21746092 | 21746302 | + | int | 7017 |
| 11 | 23099956 | 23100201 | + | int | 7018 |
| 11 | 24524244 | 24524611 | + | LUZP2 | 7019 |
| 11 | 26528965 | 26529143 | + | ANO3 | 7020 |
| 11 | 28005399 | 28005531 | + | int | 7021 |
| 11 | 28830987 | 28831170 | + | int | 7022 |

TABLE 2-continued

| chromosome | start | stop | strand | nearest gene | ID |
|---|---|---|---|---|---|
| 11 | 28831403 | 28831681 | + | int | 7023 |
| 11 | 29002713 | 29004094 | + | int | 7024 |
| 11 | 29171726 | 29172654 | + | int | 7025 |
| 11 | 29292424 | 29293643 | + | int | 7026 |
| 11 | 31804948 | 31805525 | + | ELP4 | 7027 |
| 11 | 35569092 | 35570672 | + | int | 7028 |
| 11 | 35613353 | 35615106 | + | int | 7029 |
| 11 | 36946631 | 36947523 | + | int | 7030 |
| 11 | 39385843 | 39386023 | + | int | 7031 |
| 11 | 39442253 | 39442473 | + | int | 7032 |
| 11 | 39492621 | 39493316 | + | int | 7033 |
| 11 | 39511582 | 39512068 | + | int | 7034 |
| 11 | 40029492 | 40030963 | + | int | 7035 |
| 11 | 40219360 | 40220605 | − | LRRC4C | 7036 |
| 11 | 40219360 | 40220605 | − | LRRC4C | 7037 |
| 11 | 41102732 | 41103073 | − | LRRC4C | 7038 |
| 11 | 41496762 | 41498264 | + | int | 7039 |
| 11 | 44038068 | 44039672 | + | int | 7040 |
| 11 | 44522951 | 44523741 | + | int | 7041 |
| 11 | 48181355 | 48182443 | + | PTPRJ | 7042 |
| 11 | 48453262 | 48455080 | + | int | 7043 |
| 11 | 49971827 | 49972751 | + | int | 7044 |
| 11 | 55339114 | 55340764 | + | OR4C16 | 7045 |
| 11 | 55339512 | 55340328 | + | OR4C16 | 7046 |
| 11 | 55440592 | 55441798 | + | int | 7047 |
| 11 | 55715647 | 55716399 | + | int | 7048 |
| 11 | 55735035 | 55735861 | − | OR10AG1 | 7049 |
| 11 | 55926812 | 55927951 | − | OR8K5 | 7050 |
| 11 | 55926951 | 55927957 | − | OR8K5 | 7051 |
| 11 | 56085500 | 56085718 | + | int | 7052 |
| 11 | 56085794 | 56085843 | + | OR8K3 | 7053 |
| 11 | 56400672 | 56401589 | + | OR8U8 | 7054 |
| 11 | 56408881 | 56410178 | + | OR8U8 | 7055 |
| 11 | 56408881 | 56410178 | − | OR5AP2 | 7056 |
| 11 | 56408977 | 56410221 | + | OR8U8 | 7057 |
| 11 | 56408977 | 56410221 | − | OR5AP2 | 7058 |
| 11 | 56466985 | 56468688 | + | OR8U8 | 7059 |
| 11 | 56466985 | 56468688 | + | OR9G1 | 7060 |
| 11 | 56466985 | 56468688 | + | OR9G9 | 7061 |
| 11 | 56467779 | 56468902 | + | OR8U8 | 7062 |
| 11 | 56467779 | 56468902 | + | OR9G1 | 7063 |
| 11 | 56467779 | 56468902 | + | OR9G9 | 7064 |
| 11 | 56517800 | 56517934 | + | int | 7065 |
| 11 | 56858191 | 56859228 | + | int | 7066 |
| 11 | 58000244 | 58001485 | + | int | 7067 |
| 11 | 58174247 | 58174937 | + | int | 7068 |
| 11 | 58206796 | 58207934 | − | OR5B12 | 7069 |
| 11 | 58206827 | 58207848 | − | OR5B12 | 7070 |
| 11 | 62140847 | 62142008 | + | ASRGL1 | 7071 |
| 11 | 63149547 | 63149769 | + | SLC22A9 | 7072 |
| 11 | 63149547 | 63149769 | − | MIR3680-1 | 7073 |
| 11 | 63149547 | 63149769 | − | MIR3680-2 | 7074 |
| 11 | 65622271 | 65625648 | − | CFL1 | 7075 |
| 11 | 74424204 | 74425324 | − | CHRDL2 | 7076 |
| 11 | 75430586 | 75431738 | + | MOGAT2 | 7077 |
| 11 | 75511099 | 75512755 | + | DGAT2 | 7078 |
| 11 | 76817372 | 76818689 | + | CAPN5 | 7079 |
| 11 | 88294764 | 88295276 | − | GRM5 | 7080 |
| 11 | 88294764 | 88295276 | − | GRM5 | 7081 |
| 11 | 90581540 | 90581920 | + | int | 7082 |
| 11 | 91060667 | 91061683 | + | int | 7083 |
| 11 | 96746091 | 96746286 | + | int | 7084 |
| 11 | 97231722 | 97232546 | + | int | 7085 |
| 11 | 98979718 | 98980130 | + | CNTN5 | 7086 |
| 11 | 98979718 | 98980130 | + | CNTN5 | 7087 |
| 11 | 99160095 | 99161529 | + | CNTN5 | 7088 |
| 11 | 99160095 | 99161529 | + | CNTN5 | 7089 |
| 11 | 99244906 | 99249008 | + | CNTN5 | 7090 |
| 11 | 99244906 | 99249008 | + | CNTN5 | 7091 |
| 11 | 100265374 | 100266792 | + | int | 7092 |
| 11 | 104331409 | 104332086 | + | int | 7093 |
| 11 | 104719467 | 104719653 | + | int | 7094 |
| 11 | 106882192 | 106883610 | − | GUCY1A2 | 7095 |
| 11 | 109689671 | 109690969 | + | int | 7096 |
| 11 | 111148009 | 111148762 | + | C11orf53 | 7097 |
| 11 | 113669381 | 113670177 | − | USP28 | 7098 |
| 11 | 115045559 | 115046543 | − | CADM1 | 7099 |
| 11 | 115240456 | 115241596 | − | CADM1 | 7100 |

TABLE 2-continued

| chromosome | start | stop | strand | nearest gene | ID |
|---|---|---|---|---|---|
| 11 | 118523450 | 118524750 | + | PHLDB1 | 7101 |
| 11 | 118523450 | 118524750 | + | PHLDB1 | 7102 |
| 11 | 118635819 | 118637987 | − | DDX6 | 7103 |
| 11 | 118635819 | 118637987 | − | DDX6 | 7104 |
| 11 | 119764364 | 119766191 | + | int | 7105 |
| 11 | 121318732 | 121319036 | + | int | 7106 |
| 11 | 123207926 | 123214588 | + | int | 7107 |
| 11 | 123908500 | 123909973 | − | OR10G7 | 7108 |
| 11 | 123964346 | 123965339 | + | int | 7109 |
| 11 | 123964349 | 123965340 | + | int | 7110 |
| 11 | 123975756 | 123976763 | + | int | 7111 |
| 11 | 124085364 | 124086446 | + | int | 7112 |
| 11 | 124095497 | 124096319 | + | OR8G2 | 7113 |
| 11 | 124119317 | 124119462 | + | int | 7114 |
| 11 | 124120315 | 124120853 | + | OR8G1 | 7115 |
| 11 | 124120315 | 124120853 | + | OR8G1 | 7116 |
| 11 | 124179579 | 124180877 | − | OR8D1 | 7117 |
| 11 | 124179597 | 124180820 | − | OR8D1 | 7118 |
| 11 | 124248947 | 124249256 | + | int | 7119 |
| 11 | 126511203 | 126512248 | − | KIRREL3 | 7120 |
| 11 | 126511203 | 126512248 | − | KIRREL3 | 7121 |
| 11 | 127810978 | 127811672 | + | int | 7122 |
| 11 | 128558967 | 128560049 | + | FLI1 | 7123 |
| 11 | 129308823 | 129310121 | + | BARX2 | 7124 |
| 11 | 130668795 | 130672104 | + | int | 7125 |
| 11 | 132518337 | 132519425 | − | OPCML | 7126 |
| 11 | 132518337 | 132519425 | − | OPCML | 7127 |
| 11 | 133271587 | 133272968 | − | OPCML | 7128 |
| 12 | 374618 | 375558 | + | int | 7129 |
| 12 | 1397266 | 1397936 | + | ERC1 | 7130 |
| 12 | 1900098 | 1900772 | + | int | 7131 |
| 12 | 1908829 | 1909238 | − | CACNA2D4 | 7132 |
| 12 | 2282575 | 2283539 | + | CACNA1C | 7133 |
| 12 | 3331196 | 3332486 | + | TSPAN9 | 7134 |
| 12 | 6672645 | 6677088 | − | NOP2 | 7135 |
| 12 | 6775804 | 6776423 | − | ZNF384 | 7136 |
| 12 | 6775804 | 6776423 | − | ZNF384 | 7137 |
| 12 | 8925889 | 8927004 | + | RIMKLB | 7138 |
| 12 | 11421933 | 11422377 | − | PRB3 | 7139 |
| 12 | 11548287 | 11548569 | − | PRB2 | 7140 |
| 12 | 11954602 | 11955731 | + | ETV6 | 7141 |
| 12 | 11954602 | 11955731 | − | RNU6-19 | 7142 |
| 12 | 15336305 | 15337474 | − | RERG | 7143 |
| 12 | 15785463 | 15787437 | − | EPS8 | 7144 |
| 12 | 15847939 | 15848578 | − | EPS8 | 7145 |
| 12 | 16187562 | 16188428 | + | DERA | 7146 |
| 12 | 16934331 | 16934880 | + | int | 7147 |
| 12 | 17479042 | 17480525 | + | int | 7148 |
| 12 | 17835975 | 17836505 | + | int | 7149 |
| 12 | 20565410 | 20566743 | + | PDE3A | 7150 |
| 12 | 20849462 | 20850260 | + | SLCO1C1 | 7151 |
| 12 | 20849462 | 20850260 | + | SLCO1C1 | 7152 |
| 12 | 25156994 | 25157874 | + | int | 7153 |
| 12 | 25781674 | 25782265 | − | IFLTD1 | 7154 |
| 12 | 25981000 | 25991734 | + | int | 7155 |
| 12 | 26256631 | 26257722 | + | int | 7156 |
| 12 | 27006478 | 27006889 | + | int | 7157 |
| 12 | 40668151 | 40668283 | + | LRRK2 | 7158 |
| 12 | 40668294 | 40668873 | + | LRRK2 | 7159 |
| 12 | 45697822 | 45698736 | + | ANO6 | 7160 |
| 12 | 45697822 | 45698736 | + | ANO6 | 7161 |
| 12 | 45697822 | 45698736 | + | ANO6 | 7162 |
| 12 | 48123221 | 48123790 | + | int | 7163 |
| 12 | 49444259 | 49445316 | − | MLL2 | 7164 |
| 12 | 50523409 | 50524804 | − | CERS5 | 7165 |
| 12 | 51385683 | 51387065 | − | SLC11A2 | 7166 |
| 12 | 51385683 | 51387065 | − | SLC11A2 | 7167 |
| 12 | 51385683 | 51387065 | − | SLC11A2 | 7168 |
| 12 | 51385683 | 51387065 | − | SLC11A2 | 7169 |
| 12 | 51385683 | 51387065 | − | SLC11A2 | 7170 |
| 12 | 51914864 | 51915978 | + | int | 7171 |
| 12 | 54323904 | 54325045 | + | int | 7172 |
| 12 | 54675210 | 54677020 | + | HNRNPA1 | 7173 |
| 12 | 54675210 | 54677020 | + | HNRNPA1P10 | 7174 |
| 12 | 55430890 | 55431927 | + | int | 7175 |
| 12 | 55552448 | 55553523 | + | int | 7176 |
| 12 | 55736329 | 55737557 | + | int | 7177 |
| 12 | 55845958 | 55846967 | + | OR6C2 | 7178 |

TABLE 2-continued

| chromosome | start | stop | strand | nearest gene | ID |
|---|---|---|---|---|---|
| 12 | 55868620 | 55870221 | + | int | 7179 |
| 12 | 57908394 | 57909439 | + | MARS | 7180 |
| 12 | 57977166 | 57978074 | + | KIF5A | 7181 |
| 12 | 58759397 | 58760854 | + | int | 7182 |
| 12 | 62403089 | 62405746 | − | FAM19A2 | 7183 |
| 12 | 64842591 | 64843447 | + | int | 7184 |
| 12 | 68428391 | 68429086 | + | int | 7185 |
| 12 | 68709684 | 68710623 | − | MDM1 | 7186 |
| 12 | 68782509 | 68783065 | + | int | 7187 |
| 12 | 70367271 | 70368213 | + | int | 7188 |
| 12 | 71181851 | 71182909 | − | PTPRR | 7189 |
| 12 | 71181851 | 71182909 | − | PTPRR | 7190 |
| 12 | 71629180 | 71630354 | + | int | 7191 |
| 12 | 72651386 | 72652128 | − | TRHDE-AS1 | 7192 |
| 12 | 73004905 | 73005378 | + | TRHDE | 7193 |
| 12 | 73500021 | 73500391 | + | int | 7194 |
| 12 | 74129067 | 74130604 | + | int | 7195 |
| 12 | 74315268 | 74316634 | + | int | 7196 |
| 12 | 75309590 | 75311564 | + | int | 7197 |
| 12 | 75666669 | 75666987 | + | int | 7198 |
| 12 | 75718709 | 75719304 | − | CAPS2 | 7199 |
| 12 | 79293608 | 79294470 | + | SYT1 | 7200 |
| 12 | 79293608 | 79294470 | + | SYT1 | 7201 |
| 12 | 79385857 | 79386839 | + | SYT1 | 7202 |
| 12 | 79385857 | 79386839 | + | SYT1 | 7203 |
| 12 | 80499114 | 80499244 | + | int | 7204 |
| 12 | 81006831 | 81007904 | + | PTPRQ | 7205 |
| 12 | 81072819 | 81073817 | + | PTPRQ | 7206 |
| 12 | 81085700 | 81086232 | + | int | 7207 |
| 12 | 81539061 | 81539691 | + | ACSS3 | 7208 |
| 12 | 81829504 | 81831925 | − | PPFIA2 | 7209 |
| 12 | 81829504 | 81831925 | − | PPFIA2 | 7210 |
| 12 | 81829504 | 81831925 | − | PPFIA2 | 7211 |
| 12 | 81829504 | 81831925 | − | PPFIA2 | 7212 |
| 12 | 81829504 | 81831925 | − | PPFIA2 | 7213 |
| 12 | 82009270 | 82009941 | − | PPFIA2 | 7214 |
| 12 | 82009270 | 82009941 | − | PPFIA2 | 7215 |
| 12 | 82009270 | 82009941 | − | PPFIA2 | 7216 |
| 12 | 82323124 | 82323508 | + | int | 7217 |
| 12 | 82527850 | 82528164 | + | int | 7218 |
| 12 | 82803811 | 82803966 | + | METTL25 | 7219 |
| 12 | 83594536 | 83595256 | + | int | 7220 |
| 12 | 83628756 | 83628956 | + | int | 7221 |
| 12 | 84071027 | 84071439 | + | int | 7222 |
| 12 | 85304134 | 85306088 | − | SLC6A15 | 7223 |
| 12 | 85304134 | 85306088 | − | SLC6A15 | 7224 |
| 12 | 85977106 | 85977447 | + | int | 7225 |
| 12 | 86477137 | 86477346 | − | MGAT4C | 7226 |
| 12 | 86653836 | 86654824 | − | MGAT4C | 7227 |
| 12 | 86815805 | 86817114 | − | MGAT4C | 7228 |
| 12 | 87135296 | 87135814 | − | MGAT4C | 7229 |
| 12 | 87746550 | 87747635 | + | int | 7230 |
| 12 | 87890187 | 87890679 | + | int | 7231 |
| 12 | 88010466 | 88010616 | + | int | 7232 |
| 12 | 88559806 | 88560213 | + | TMTC3 | 7233 |
| 12 | 89650101 | 89650370 | + | int | 7234 |
| 12 | 89984136 | 89985076 | − | ATP2B1 | 7235 |
| 12 | 90064149 | 90065323 | + | int | 7236 |
| 12 | 90563794 | 90564547 | + | int | 7237 |
| 12 | 90714260 | 90715809 | + | int | 7238 |
| 12 | 91545328 | 91545734 | − | DCN | 7239 |
| 12 | 91545328 | 91545734 | − | DCN | 7240 |
| 12 | 91545328 | 91545734 | − | DCN | 7241 |
| 12 | 91770097 | 91770351 | + | int | 7242 |
| 12 | 91949660 | 91957325 | + | int | 7243 |
| 12 | 92251859 | 92252215 | + | int | 7244 |
| 12 | 96148945 | 96149960 | − | NTN4 | 7245 |
| 12 | 96199120 | 96200274 | + | int | 7246 |
| 12 | 96455122 | 96456142 | + | int | 7247 |
| 12 | 97015759 | 97017244 | + | int | 7248 |
| 12 | 98161083 | 98161913 | + | int | 7249 |
| 12 | 99578910 | 99586295 | − | ANKS1B | 7250 |
| 12 | 100402747 | 100403647 | + | int | 7251 |
| 12 | 102130685 | 102131063 | − | SYCP3 | 7252 |
| 12 | 102130704 | 102130897 | − | SYCP3 | 7253 |
| 12 | 103644136 | 103644549 | + | int | 7254 |
| 12 | 108144971 | 108145971 | − | PRDM4 | 7255 |
| 12 | 108145343 | 108150744 | − | PRDM4 | 7256 |

TABLE 2-continued

| chromosome | start | stop | strand | nearest gene | ID |
|---|---|---|---|---|---|
| 12 | 109522715 | 109523983 | + | USP30 | 7257 |
| 12 | 112186033 | 112186441 | + | ACAD10 | 7258 |
| 12 | 119376190 | 119376892 | + | int | 7259 |
| 12 | 119877396 | 119877664 | + | CCDC60 | 7260 |
| 12 | 125237562 | 125238169 | + | int | 7261 |
| 12 | 126070020 | 126070699 | + | TMEM132B | 7262 |
| 12 | 126440694 | 126441255 | + | int | 7263 |
| 12 | 126607925 | 126608832 | + | int | 7264 |
| 12 | 129100432 | 129101097 | + | TMEM132C | 7265 |
| 12 | 131613283 | 131613388 | + | GPR133 | 7266 |
| 12 | 131613329 | 131613362 | + | GPR133 | 7267 |
| 12 | 131613387 | 131614053 | + | GPR133 | 7268 |
| 12 | 131613389 | 131614079 | + | GPR133 | 7269 |
| 12 | 131613484 | 131614080 | + | GPR133 | 7270 |
| 13 | 20980913 | 20981177 | − | CRYL1 | 7271 |
| 13 | 23335912 | 23336173 | + | int | 7272 |
| 13 | 23773422 | 23778020 | + | SGCG | 7273 |
| 13 | 26912376 | 26912657 | + | CDK8 | 7274 |
| 13 | 27890781 | 27891369 | + | int | 7275 |
| 13 | 28239821 | 28240459 | + | POLR1D | 7276 |
| 13 | 28239821 | 28240459 | + | POLR1D | 7277 |
| 13 | 30091602 | 30092707 | − | SLC7A1 | 7278 |
| 13 | 35267726 | 35268309 | + | int | 7279 |
| 13 | 35814847 | 35815028 | + | NBEA | 7280 |
| 13 | 40642821 | 40643628 | + | int | 7281 |
| 13 | 41705527 | 41706976 | − | KBTBD6 | 7282 |
| 13 | 42613923 | 42615093 | + | DGKH | 7283 |
| 13 | 42614017 | 42615455 | + | DGKH | 7284 |
| 13 | 42614164 | 42615605 | + | DGKH | 7285 |
| 13 | 42614388 | 42615766 | + | DGKH | 7286 |
| 13 | 42622072 | 42623184 | + | DGKH | 7287 |
| 13 | 42622072 | 42623184 | + | DGKH | 7288 |
| 13 | 42622241 | 42623352 | + | DGKH | 7289 |
| 13 | 42622241 | 42623352 | + | DGKH | 7290 |
| 13 | 42626151 | 42626981 | + | DGKH | 7291 |
| 13 | 42626151 | 42626981 | + | DGKH | 7292 |
| 13 | 42626320 | 42627000 | + | DGKH | 7293 |
| 13 | 42626320 | 42627000 | + | DGKH | 7294 |
| 13 | 45112317 | 45112432 | − | TSC22D1 | 7295 |
| 13 | 49088807 | 49089621 | − | RCBTB2 | 7296 |
| 13 | 49532168 | 49532797 | + | int | 7297 |
| 13 | 50305619 | 50306401 | − | KPNA3 | 7298 |
| 13 | 53930508 | 53931109 | + | int | 7299 |
| 13 | 54292910 | 54293143 | + | int | 7300 |
| 13 | 54616935 | 54617633 | + | int | 7301 |
| 13 | 54629210 | 54629955 | + | int | 7302 |
| 13 | 56393559 | 56407212 | + | int | 7303 |
| 13 | 56710705 | 56711643 | + | int | 7304 |
| 13 | 56925111 | 56925323 | + | int | 7305 |
| 13 | 56986536 | 56987402 | + | int | 7306 |
| 13 | 57566469 | 57571334 | + | int | 7307 |
| 13 | 57792569 | 57795406 | + | int | 7308 |
| 13 | 57989560 | 57990251 | + | int | 7309 |
| 13 | 58399739 | 58400159 | + | int | 7310 |
| 13 | 58429208 | 58430730 | + | int | 7311 |
| 13 | 58565060 | 58565245 | + | int | 7312 |
| 13 | 59165798 | 59166399 | + | int | 7313 |
| 13 | 59449435 | 59449693 | + | int | 7314 |
| 13 | 60519049 | 60520004 | − | DIAPH3 | 7315 |
| 13 | 60519049 | 60520004 | − | DIAPH3 | 7316 |
| 13 | 60519049 | 60520004 | − | DIAPH3 | 7317 |
| 13 | 60519049 | 60520004 | − | DIAPH3 | 7318 |
| 13 | 60519049 | 60520004 | − | DIAPH3 | 7319 |
| 13 | 61751552 | 61752024 | + | int | 7320 |
| 13 | 62682314 | 62682683 | + | int | 7321 |
| 13 | 63121628 | 63122166 | + | int | 7322 |
| 13 | 63281109 | 63281493 | + | int | 7323 |
| 13 | 64813998 | 64815168 | + | int | 7324 |
| 13 | 65802987 | 65803533 | + | int | 7325 |
| 13 | 67550990 | 67552060 | + | PCDH9-AS3 | 7326 |
| 13 | 67550990 | 67552060 | − | PCDH9 | 7327 |
| 13 | 67779136 | 67780928 | − | PCDH9 | 7328 |
| 13 | 68235970 | 68236101 | + | int | 7329 |
| 13 | 68295275 | 68296146 | + | int | 7330 |
| 13 | 71439679 | 71440163 | + | int | 7331 |
| 13 | 71731561 | 71732645 | + | LINC00348 | 7332 |
| 13 | 72494869 | 72495441 | + | int | 7333 |
| 13 | 72778389 | 72779538 | + | int | 7334 |

TABLE 2-continued

| chromosome | start | stop | strand | nearest gene | ID |
|---|---|---|---|---|---|
| 13 | 73425149 | 73427762 | + | PIBF1 | 7335 |
| 13 | 73929102 | 73929623 | + | int | 7336 |
| 13 | 74268504 | 74269675 | − | KLF12 | 7337 |
| 13 | 75021746 | 75022309 | + | int | 7338 |
| 13 | 77147178 | 77147784 | + | int | 7339 |
| 13 | 77369756 | 77370634 | + | int | 7340 |
| 13 | 77614040 | 77614780 | + | int | 7341 |
| 13 | 77979741 | 77979889 | + | int | 7342 |
| 13 | 78965615 | 78965801 | + | POU4F1-AS1 | 7343 |
| 13 | 79410846 | 79412086 | − | LINC00331 | 7344 |
| 13 | 81124799 | 81125088 | + | int | 7345 |
| 13 | 81694921 | 81695116 | + | int | 7346 |
| 13 | 82661431 | 82662673 | + | int | 7347 |
| 13 | 86545002 | 86545637 | + | int | 7348 |
| 13 | 88322712 | 88323739 | − | MIR4500HG | 7349 |
| 13 | 88827211 | 88827417 | + | int | 7350 |
| 13 | 89822111 | 89822899 | + | int | 7351 |
| 13 | 90707140 | 90707343 | + | int | 7352 |
| 13 | 91146867 | 91150622 | + | int | 7353 |
| 13 | 91588985 | 91589885 | + | int | 7354 |
| 13 | 91740858 | 91741979 | + | int | 7355 |
| 13 | 92270027 | 92271500 | + | GPC5 | 7356 |
| 13 | 93766554 | 93768253 | + | int | 7357 |
| 13 | 93774227 | 93774829 | + | int | 7358 |
| 13 | 95396023 | 95396630 | + | int | 7359 |
| 13 | 95772357 | 95774351 | − | ABCC4 | 7360 |
| 13 | 95772357 | 95774351 | − | ABCC4 | 7361 |
| 13 | 96542281 | 96542908 | − | UGGT2 | 7362 |
| 13 | 96892159 | 96893200 | + | HS6ST3 | 7363 |
| 13 | 97442953 | 97443609 | + | HS6ST3 | 7364 |
| 13 | 97592975 | 97593494 | + | int | 7365 |
| 13 | 98193307 | 98194302 | + | int | 7366 |
| 13 | 100246541 | 100246742 | + | int | 7367 |
| 13 | 103421855 | 103422048 | − | TEX30 | 7368 |
| 13 | 103501400 | 103501613 | + | BIVM-ERCC5 | 7369 |
| 13 | 103501400 | 103501613 | + | ERCC5 | 7370 |
| 13 | 104076697 | 104077748 | + | int | 7371 |
| 13 | 104416125 | 104416436 | + | int | 7372 |
| 13 | 105515903 | 105516785 | + | int | 7373 |
| 13 | 105619767 | 105619966 | + | int | 7374 |
| 13 | 106028974 | 106030002 | + | int | 7375 |
| 13 | 111329316 | 111329482 | − | CARS2 | 7376 |
| 13 | 112141304 | 112142073 | + | int | 7377 |
| 13 | 114101240 | 114101554 | − | ADPRHL1 | 7378 |
| 13 | 114101240 | 114101554 | − | ADPRHL1 | 7379 |
| 14 | 20482440 | 20483341 | − | OR4K14 | 7380 |
| 14 | 22670374 | 22671700 | + | int | 7381 |
| 14 | 25976704 | 25977813 | + | int | 7382 |
| 14 | 26070247 | 26071473 | + | int | 7383 |
| 14 | 26101080 | 26102304 | + | int | 7384 |
| 14 | 26171509 | 26171674 | + | int | 7385 |
| 14 | 26315308 | 26316353 | + | int | 7386 |
| 14 | 26319011 | 26319629 | + | int | 7387 |
| 14 | 27204263 | 27205881 | + | int | 7388 |
| 14 | 27569754 | 27570130 | + | int | 7389 |
| 14 | 28689459 | 28689973 | + | int | 7390 |
| 14 | 29095523 | 29095855 | + | int | 7391 |
| 14 | 29284345 | 29285041 | + | int | 7392 |
| 14 | 29662165 | 29662457 | + | int | 7393 |
| 14 | 29814627 | 29816017 | + | int | 7394 |
| 14 | 29837989 | 29838162 | + | int | 7395 |
| 14 | 30885297 | 30887111 | + | int | 7396 |
| 14 | 32238545 | 32238660 | + | NUBPL | 7397 |
| 14 | 32238545 | 32238660 | + | NUBPL | 7398 |
| 14 | 32238545 | 32238660 | + | NUBPL | 7399 |
| 14 | 32968103 | 32968377 | + | AKAP6 | 7400 |
| 14 | 33083275 | 33084539 | + | AKAP6 | 7401 |
| 14 | 33645276 | 33645702 | + | NPAS3 | 7402 |
| 14 | 36350158 | 36350485 | + | int | 7403 |
| 14 | 38035486 | 38036844 | + | int | 7404 |
| 14 | 40840334 | 40840825 | + | int | 7405 |
| 14 | 40864055 | 40864611 | + | int | 7406 |
| 14 | 41080976 | 41081198 | + | int | 7407 |
| 14 | 42140306 | 42140586 | + | LRFN5 | 7408 |
| 14 | 46414472 | 46415288 | + | int | 7409 |
| 14 | 46835370 | 46835891 | + | int | 7410 |
| 14 | 47120131 | 47121054 | − | RPL10L | 7411 |
| 14 | 47979567 | 47980588 | − | MDGA2 | 7412 |

TABLE 2-continued

| chromosome | start | stop | strand | nearest gene | ID |
|---|---|---|---|---|---|
| 14 | 51610214 | 51611542 | + | int | 7413 |
| 14 | 56356992 | 56357605 | + | int | 7414 |
| 14 | 60150964 | 60151340 | − | RTN1 | 7415 |
| 14 | 60749887 | 60759227 | + | PPM1A | 7416 |
| 14 | 60749887 | 60759227 | + | PPM1A | 7417 |
| 14 | 60749887 | 60759227 | + | PPM1A | 7418 |
| 14 | 62919513 | 62919890 | + | int | 7419 |
| 14 | 65519369 | 65520335 | + | CHURC1-FNTB | 7420 |
| 14 | 65519369 | 65520335 | + | FNTB | 7421 |
| 14 | 65519369 | 65520335 | − | MAX | 7422 |
| 14 | 68758590 | 68760395 | + | RAD51B | 7423 |
| 14 | 68758590 | 68760395 | + | RAD51B | 7424 |
| 14 | 68758590 | 68760395 | + | RAD51B | 7425 |
| 14 | 70351970 | 70352878 | + | SMOC1 | 7426 |
| 14 | 70351996 | 70352879 | + | SMOC1 | 7427 |
| 14 | 70352055 | 70352880 | + | SMOC1 | 7428 |
| 14 | 75085798 | 75086733 | + | int | 7429 |
| 14 | 77491612 | 77492679 | − | IRF2BPL | 7430 |
| 14 | 78243570 | 78243776 | + | int | 7431 |
| 14 | 78423604 | 78425164 | + | int | 7432 |
| 14 | 79099730 | 79100770 | + | NRXN3 | 7433 |
| 14 | 79099730 | 79100770 | + | NRXN3 | 7434 |
| 14 | 80163612 | 80164605 | + | NRXN3 | 7435 |
| 14 | 80163612 | 80164605 | + | NRXN3 | 7436 |
| 14 | 80163612 | 80164605 | + | NRXN3 | 7437 |
| 14 | 80744712 | 80745223 | + | DIO2-AS1 | 7438 |
| 14 | 82441033 | 82442912 | + | int | 7439 |
| 14 | 84104776 | 84111812 | + | int | 7440 |
| 14 | 84717988 | 84719684 | + | int | 7441 |
| 14 | 85590289 | 85591139 | + | int | 7442 |
| 14 | 86907608 | 86907820 | + | int | 7443 |
| 14 | 87878997 | 87879497 | + | int | 7444 |
| 14 | 90666271 | 90667487 | + | int | 7445 |
| 14 | 91070886 | 91071366 | − | TTC7B | 7446 |
| 14 | 92198679 | 92199007 | + | int | 7447 |
| 14 | 92278449 | 92278663 | − | TC2N | 7448 |
| 14 | 92278449 | 92278663 | − | TC2N | 7449 |
| 14 | 94854470 | 94855581 | − | SERPINA1 | 7450 |
| 14 | 94854470 | 94855581 | − | SERPINA1 | 7451 |
| 14 | 94978456 | 94979357 | − | SERPINA12 | 7452 |
| 14 | 95192580 | 95193442 | + | int | 7453 |
| 14 | 96755688 | 96756350 | − | ATG2B | 7454 |
| 14 | 97417304 | 97418117 | + | int | 7455 |
| 14 | 97548718 | 97550227 | + | int | 7456 |
| 14 | 97550739 | 97550881 | + | int | 7457 |
| 14 | 98858092 | 98859016 | + | int | 7458 |
| 14 | 99638892 | 99639913 | − | BCL11B | 7459 |
| 14 | 101250334 | 101252301 | + | int | 7460 |
| 14 | 101794698 | 101795549 | + | int | 7461 |
| 14 | 102232365 | 102233352 | + | PPP2R5C | 7462 |
| 14 | 103407235 | 103408765 | − | CDC42BPB | 7463 |
| 14 | 106966939 | 106967768 | + | int | 7464 |
| 14 | 106966960 | 106967744 | + | int | 7465 |
| 14 | 107183321 | 107183993 | + | int | 7466 |
| 15 | 20177954 | 20178692 | + | int | 7467 |
| 15 | 25749853 | 25750007 | + | int | 7468 |
| 15 | 26326506 | 26326984 | + | int | 7469 |
| 15 | 26343558 | 26344266 | + | int | 7470 |
| 15 | 29134553 | 29135302 | + | int | 7471 |
| 15 | 31015477 | 31015790 | + | LOC100288637 | 7472 |
| 15 | 31015477 | 31015790 | + | LOC100288637 | 7473 |
| 15 | 31973925 | 31975181 | + | int | 7474 |
| 15 | 35829748 | 35830618 | − | ATPBD4 | 7475 |
| 15 | 35829748 | 35830618 | − | ATPBD4 | 7476 |
| 15 | 35879193 | 35880116 | + | ATPBD4-AS1 | 7477 |
| 15 | 36180943 | 36181768 | + | int | 7478 |
| 15 | 36463100 | 36463418 | + | int | 7479 |
| 15 | 38750173 | 38751114 | + | FAM98B | 7480 |
| 15 | 38750173 | 38751114 | + | FAM98B | 7481 |
| 15 | 40328870 | 40331152 | − | SRP14 | 7482 |
| 15 | 42152715 | 42154897 | − | SPTBN5 | 7483 |
| 15 | 44408727 | 44409383 | − | FRMD5 | 7484 |
| 15 | 44413538 | 44413856 | − | FRMD5 | 7485 |
| 15 | 45116509 | 45117617 | + | int | 7486 |
| 15 | 49299937 | 49300862 | − | SECISBP2L | 7487 |
| 15 | 49611805 | 49612915 | + | GALK2 | 7488 |
| 15 | 49611805 | 49612915 | + | GALK2 | 7489 |
| 15 | 49926436 | 49928736 | + | DTWD1 | 7490 |

TABLE 2-continued

| chromosome | start | stop | strand | nearest gene | ID |
|---|---|---|---|---|---|
| 15 | 51365122 | 51366001 | − | TNFAIP8L3 | 7491 |
| 15 | 52387467 | 52387979 | + | int | 7492 |
| 15 | 63837324 | 63837594 | + | USP3 | 7493 |
| 15 | 67530526 | 67531552 | − | AAGAB | 7494 |
| 15 | 67530526 | 67531552 | − | AAGAB | 7495 |
| 15 | 69693507 | 69695505 | + | PAQR5 | 7496 |
| 15 | 69693507 | 69695505 | + | PAQR5 | 7497 |
| 15 | 70222909 | 70224083 | + | int | 7498 |
| 15 | 71633383 | 71634085 | + | THSD4 | 7499 |
| 15 | 73614585 | 73615797 | − | HCN4 | 7500 |
| 15 | 77420728 | 77422180 | − | PEAK1 | 7501 |
| 15 | 79858010 | 79863368 | + | int | 7502 |
| 15 | 82458398 | 82458791 | − | EFTUD1 | 7503 |
| 15 | 83542461 | 83547028 | − | HOMER2 | 7504 |
| 15 | 86101677 | 86101856 | + | AKAP13 | 7505 |
| 15 | 87196176 | 87197425 | + | AGBL1 | 7506 |
| 15 | 89147798 | 89148922 | + | int | 7507 |
| 15 | 94198990 | 94199233 | + | int | 7508 |
| 15 | 95248130 | 95248682 | + | int | 7509 |
| 15 | 98106249 | 98106383 | + | int | 7510 |
| 15 | 98907573 | 98908013 | + | int | 7511 |
| 15 | 100174178 | 100174943 | + | MEF2A | 7512 |
| 15 | 100174178 | 100174943 | + | MEF2A | 7513 |
| 15 | 101681695 | 101682273 | + | int | 7514 |
| 16 | 3777637 | 3778311 | − | CREBBP | 7515 |
| 16 | 3860547 | 3861185 | − | CREBBP | 7516 |
| 16 | 4003558 | 4004509 | + | int | 7517 |
| 16 | 5806501 | 5808259 | + | int | 7518 |
| 16 | 7951973 | 7954593 | + | int | 7519 |
| 16 | 9545918 | 9549063 | + | int | 7520 |
| 16 | 11854238 | 11854984 | − | ZC3H7A | 7521 |
| 16 | 12186573 | 12187029 | + | SNX29 | 7522 |
| 16 | 14114790 | 14116975 | + | int | 7523 |
| 16 | 15901518 | 15902083 | − | MYH11 | 7524 |
| 16 | 20812489 | 20812926 | − | ERI2 | 7525 |
| 16 | 20812489 | 20812926 | − | ERI2 | 7526 |
| 16 | 22583663 | 22585454 | + | LOC653786 | 7527 |
| 16 | 23867700 | 23869009 | + | PRKCB | 7528 |
| 16 | 24919223 | 24919539 | + | SLC5A11 | 7529 |
| 16 | 24919223 | 24919539 | + | SLC5A11 | 7530 |
| 16 | 26043212 | 26044231 | + | HS3ST4 | 7531 |
| 16 | 28847837 | 28848553 | + | ATXN2L | 7532 |
| 16 | 31193831 | 31202834 | + | FUS | 7533 |
| 16 | 34321734 | 34322241 | + | int | 7534 |
| 16 | 49166239 | 49166759 | + | int | 7535 |
| 16 | 49991921 | 49992229 | + | int | 7536 |
| 16 | 50416571 | 50417300 | + | int | 7537 |
| 16 | 53102081 | 53102710 | + | CHD9 | 7538 |
| 16 | 53357930 | 53358940 | + | CHD9 | 7539 |
| 16 | 55410370 | 55411287 | + | int | 7540 |
| 16 | 61113099 | 61114193 | + | int | 7541 |
| 16 | 61411936 | 61412884 | + | int | 7542 |
| 16 | 61649332 | 61649639 | + | int | 7543 |
| 16 | 61771187 | 61772008 | − | CDH8 | 7544 |
| 16 | 62329454 | 62329606 | + | int | 7545 |
| 16 | 62596491 | 62598253 | + | int | 7546 |
| 16 | 62782215 | 62782862 | + | int | 7547 |
| 16 | 63074439 | 63075192 | + | int | 7548 |
| 16 | 63554338 | 63554941 | + | int | 7549 |
| 16 | 64074455 | 64075328 | + | int | 7550 |
| 16 | 64185662 | 64186628 | + | int | 7551 |
| 16 | 64981492 | 64982597 | − | CDH11 | 7552 |
| 16 | 65022085 | 65022350 | − | CDH11 | 7553 |
| 16 | 65022085 | 65022418 | − | CDH11 | 7554 |
| 16 | 65022085 | 65022553 | − | CDH11 | 7555 |
| 16 | 65037974 | 65039575 | − | CDH11 | 7556 |
| 16 | 65038354 | 65039527 | − | CDH11 | 7557 |
| 16 | 65040965 | 65041519 | − | CDH11 | 7558 |
| 16 | 66390836 | 66392394 | + | int | 7559 |
| 16 | 66390879 | 66392450 | + | int | 7560 |
| 16 | 68224505 | 68225686 | + | NFATC3 | 7561 |
| 16 | 73266538 | 73267495 | + | int | 7562 |
| 16 | 73424807 | 73425864 | + | LOC100506172 | 7563 |
| 16 | 76569230 | 76570525 | + | CNTNAP4 | 7564 |
| 16 | 76569230 | 76570525 | + | CNTNAP4 | 7565 |
| 16 | 76900682 | 76901425 | + | int | 7566 |
| 16 | 77254302 | 77255232 | + | int | 7567 |
| 16 | 86430292 | 86431049 | + | int | 7568 |

TABLE 2-continued

| chromosome | start | stop | strand | nearest gene | ID |
|---|---|---|---|---|---|
| 16 | 90072762 | 90073576 | − | DBNDD1 | 7569 |
| 16 | 90072762 | 90073576 | − | DBNDD1 | 7570 |
| 17 | 648284 | 649363 | − | GEMIN4 | 7571 |
| 17 | 3119030 | 3120438 | + | OR1A1 | 7572 |
| 17 | 4927384 | 4927994 | + | KIF1C | 7573 |
| 17 | 18743147 | 18743272 | + | int | 7574 |
| 17 | 26655417 | 26658999 | + | TMEM97 | 7575 |
| 17 | 26655417 | 26658999 | − | IFT20 | 7576 |
| 17 | 40066053 | 40067045 | − | ACLY | 7577 |
| 17 | 44913020 | 44914255 | + | int | 7578 |
| 17 | 47500645 | 47502239 | + | int | 7579 |
| 17 | 48009704 | 48010998 | + | int | 7580 |
| 17 | 50378718 | 50379222 | + | int | 7581 |
| 17 | 50679664 | 50680024 | + | int | 7582 |
| 17 | 50865875 | 50867108 | + | int | 7583 |
| 17 | 51221272 | 51225296 | + | int | 7584 |
| 17 | 51372480 | 51372981 | + | int | 7585 |
| 17 | 51408103 | 51409018 | + | int | 7586 |
| 17 | 53225809 | 53227153 | + | STXBP4 | 7587 |
| 17 | 58951818 | 58952165 | + | BCAS3 | 7588 |
| 17 | 59838596 | 59838965 | − | BRIP1 | 7589 |
| 17 | 63274321 | 63275310 | + | int | 7590 |
| 17 | 63444295 | 63445350 | + | int | 7591 |
| 17 | 63822244 | 63824007 | − | CEP112 | 7592 |
| 17 | 63822244 | 63824007 | − | CEP112 | 7593 |
| 17 | 63822244 | 63824007 | − | CEP112 | 7594 |
| 17 | 64971195 | 64972375 | + | CACNG4 | 7595 |
| 17 | 71012225 | 71013388 | − | SLC39A11 | 7596 |
| 17 | 74140710 | 74141949 | + | RNF157-AS1 | 7597 |
| 17 | 74140710 | 74141949 | − | RNF157 | 7598 |
| 17 | 76967150 | 76968150 | − | LGALS3BP | 7599 |
| 17 | 77355604 | 77356228 | − | RBFOX3 | 7600 |
| 17 | 79477100 | 79477997 | − | ACTG1 | 7601 |
| 17 | 79477594 | 79479387 | − | ACTG1 | 7602 |
| 17 | 79845711 | 79849340 | − | ALYREF | 7603 |
| 18 | 1052905 | 1053398 | + | int | 7604 |
| 18 | 1071540 | 1072282 | + | int | 7605 |
| 18 | 1581074 | 1581354 | + | int | 7606 |
| 18 | 3305890 | 3306089 | + | int | 7607 |
| 18 | 6462115 | 6463126 | + | int | 7608 |
| 18 | 8481941 | 8483862 | + | int | 7609 |
| 18 | 8856769 | 8856944 | + | int | 7610 |
| 18 | 11246524 | 11247623 | + | int | 7611 |
| 18 | 11377525 | 11377838 | + | int | 7612 |
| 18 | 12484622 | 12486276 | − | SPIRE1 | 7613 |
| 18 | 12484622 | 12486276 | − | SPIRE1 | 7614 |
| 18 | 14090515 | 14091003 | − | ZNF519 | 7615 |
| 18 | 19989388 | 19989602 | + | int | 7616 |
| 18 | 20427208 | 20428243 | + | int | 7617 |
| 18 | 20555715 | 20556172 | + | RBBP8 | 7618 |
| 18 | 20555715 | 20556172 | + | RBBP8 | 7619 |
| 18 | 24720669 | 24721706 | − | CHST9 | 7620 |
| 18 | 26645111 | 26645342 | + | int | 7621 |
| 18 | 26721697 | 26721832 | + | int | 7622 |
| 18 | 27837549 | 27837873 | + | int | 7623 |
| 18 | 31996446 | 31997204 | + | int | 7624 |
| 18 | 34119073 | 34120102 | + | FHOD3 | 7625 |
| 18 | 35893150 | 35894133 | + | int | 7626 |
| 18 | 38564856 | 38565888 | + | int | 7627 |
| 18 | 40557831 | 40559027 | − | RIT2 | 7628 |
| 18 | 41775117 | 41775379 | + | int | 7629 |
| 18 | 44347544 | 44349152 | + | int | 7630 |
| 18 | 44554564 | 44554941 | + | KATNAL2 | 7631 |
| 18 | 44554564 | 44554941 | − | TCEB3C | 7632 |
| 18 | 44554564 | 44554941 | − | TCEB3CL | 7633 |
| 18 | 44800545 | 44801552 | + | int | 7634 |
| 18 | 47910107 | 47911752 | + | SKA1 | 7635 |
| 18 | 49012986 | 49014020 | + | LOC100287225 | 7636 |
| 18 | 49103135 | 49104542 | + | int | 7637 |
| 18 | 49405143 | 49405387 | + | int | 7638 |
| 18 | 50014395 | 50014584 | + | DCC | 7639 |
| 18 | 50616576 | 50620507 | + | DCC | 7640 |
| 18 | 50661077 | 50662327 | + | DCC | 7641 |
| 18 | 51819574 | 51820616 | + | POLI | 7642 |
| 18 | 52508757 | 52509497 | + | RAB27B | 7643 |
| 18 | 52515568 | 52517133 | + | RAB27B | 7644 |
| 18 | 58632817 | 58633449 | + | int | 7645 |
| 18 | 61885360 | 61885748 | + | LOC284294 | 7646 |

TABLE 2-continued

| chromosome | start | stop | strand | nearest gene | ID |
|---|---|---|---|---|---|
| 18 | 61885360 | 61885748 | − | LOC400654 | 7647 |
| 18 | 62395091 | 62395599 | + | int | 7648 |
| 18 | 62396091 | 62396352 | + | int | 7649 |
| 18 | 62972025 | 62974700 | + | int | 7650 |
| 18 | 63420149 | 63421308 | + | CDH7 | 7651 |
| 18 | 63420149 | 63421308 | + | CDH7 | 7652 |
| 18 | 63685707 | 63686273 | + | int | 7653 |
| 18 | 63969826 | 63970700 | + | int | 7654 |
| 18 | 64741770 | 64742261 | + | int | 7655 |
| 18 | 67991779 | 67992891 | + | SOCS6 | 7656 |
| 18 | 68264043 | 68264252 | + | int | 7657 |
| 18 | 69027365 | 69027650 | + | int | 7658 |
| 18 | 69156760 | 69156963 | + | int | 7659 |
| 18 | 69646243 | 69646631 | + | int | 7660 |
| 18 | 70418146 | 70418146 | − | NETO1 | 7661 |
| 18 | 70418146 | 70418146 | − | NETO1 | 7662 |
| 18 | 70818053 | 70818823 | + | int | 7663 |
| 18 | 73575332 | 73576450 | + | int | 7664 |
| 18 | 75705179 | 75706233 | + | int | 7665 |
| 19 | 808382 | 812221 | + | PTBP1 | 7666 |
| 19 | 1434738 | 1435344 | + | DAZAP1 | 7667 |
| 19 | 3976139 | 3977980 | − | EEF2 | 7668 |
| 19 | 3981940 | 3984157 | − | EEF2 | 7669 |
| 19 | 3981940 | 3984157 | − | SNORD37 | 7670 |
| 19 | 5648723 | 5649686 | + | SAFB | 7671 |
| 19 | 7122616 | 7123629 | − | INSR | 7672 |
| 19 | 8548041 | 8551144 | + | HNRNPM | 7673 |
| 19 | 9314887 | 9315905 | + | int | 7674 |
| 19 | 10148083 | 10148739 | + | int | 7675 |
| 19 | 11226715 | 11227746 | + | LDLR | 7676 |
| 19 | 12575001 | 12576141 | − | ZNF709 | 7677 |
| 19 | 13004923 | 13005057 | + | GCDH | 7678 |
| 19 | 13355257 | 13356430 | − | CACNA1A | 7679 |
| 19 | 14224504 | 14225581 | − | PRKACA | 7680 |
| 19 | 14224504 | 14225581 | − | PRKACA | 7681 |
| 19 | 17831696 | 17835329 | + | MAP1S | 7682 |
| 19 | 19243047 | 19244084 | − | TMEM161A | 7683 |
| 19 | 20235972 | 20236367 | + | int | 7684 |
| 19 | 23543102 | 23544593 | − | ZNF91 | 7685 |
| 19 | 29647756 | 29648765 | + | int | 7686 |
| 19 | 30033329 | 30034267 | + | VSTM2B | 7687 |
| 19 | 30693247 | 30693882 | + | int | 7688 |
| 19 | 30807465 | 30809236 | + | int | 7689 |
| 19 | 31324522 | 31326134 | + | int | 7690 |
| 19 | 32874922 | 32875805 | + | ZNF507 | 7691 |
| 19 | 33851181 | 33852185 | + | int | 7692 |
| 19 | 36053644 | 36055854 | − | ATP4A | 7693 |
| 19 | 38572484 | 38573487 | + | SIPA1L3 | 7694 |
| 19 | 38741426 | 38742270 | − | PPP1R14A | 7695 |
| 19 | 38846546 | 38847639 | + | CATSPERG | 7696 |
| 19 | 40353893 | 40354724 | − | FCGBP | 7697 |
| 19 | 44133138 | 44133438 | − | CADM4 | 7698 |
| 19 | 45777965 | 45778215 | + | MARK4 | 7699 |
| 19 | 46076848 | 46078346 | − | OPA3 | 7700 |
| 19 | 46076848 | 46078346 | − | OPA3 | 7701 |
| 19 | 51745522 | 51746010 | + | int | 7702 |
| 19 | 52725379 | 52729655 | + | PPP2R1A | 7703 |
| 19 | 53762106 | 53762789 | + | VN1R2 | 7704 |
| 19 | 56614283 | 56614595 | − | ZNF787 | 7705 |
| 19 | 57059163 | 57065178 | + | ZFP28 | 7706 |
| 19 | 57742888 | 57743489 | + | AURKC | 7707 |
| 19 | 57742888 | 57743489 | + | AURKC | 7708 |
| 19 | 57746881 | 57746957 | + | AURKC | 7709 |
| 19 | 57746881 | 57746957 | + | AURKC | 7710 |
| 20 | 1794799 | 1795473 | + | int | 7711 |
| 20 | 4610035 | 4610188 | + | int | 7712 |
| 20 | 5273335 | 5273619 | + | int | 7713 |
| 20 | 6922025 | 6923054 | + | int | 7714 |
| 20 | 9810959 | 9812678 | − | PAK7 | 7715 |
| 20 | 10382259 | 10382495 | + | int | 7716 |
| 20 | 12743475 | 12745331 | + | int | 7717 |
| 20 | 13971215 | 13971566 | − | SEL1L2 | 7718 |
| 20 | 13971215 | 13971566 | − | SEL1L2 | 7719 |
| 20 | 14522634 | 14522964 | + | MACROD2 | 7720 |
| 20 | 14821735 | 14822136 | + | MACROD2 | 7721 |
| 20 | 15688887 | 15689943 | + | MACROD2 | 7722 |
| 20 | 15688887 | 15689943 | + | MACROD2 | 7723 |
| 20 | 15714267 | 15715365 | + | MACROD2 | 7724 |

TABLE 2-continued

| chromosome | start | stop | strand | nearest gene | ID |
|---|---|---|---|---|---|
| 20 | 15714267 | 15715365 | + | MACROD2 | 7725 |
| 20 | 15812792 | 15813406 | + | MACROD2 | 7726 |
| 20 | 15812792 | 15813406 | + | MACROD2 | 7727 |
| 20 | 15908010 | 15908716 | + | MACROD2 | 7728 |
| 20 | 15908010 | 15908716 | + | MACROD2 | 7729 |
| 20 | 16034166 | 16036752 | + | int | 7730 |
| 20 | 16075545 | 16077098 | + | int | 7731 |
| 20 | 34794955 | 34796226 | + | EPB41L1 | 7732 |
| 20 | 34794955 | 34796226 | + | EPB41L1 | 7733 |
| 20 | 34794955 | 34796226 | + | EPB41L1 | 7734 |
| 20 | 35169481 | 35170743 | + | MYL9 | 7735 |
| 20 | 35220909 | 35222342 | + | TGIF2 | 7736 |
| 20 | 35220909 | 35222342 | + | TGIF2 | 7737 |
| 20 | 35220909 | 35222342 | + | TGIF2 | 7738 |
| 20 | 35220909 | 35222342 | + | TGIF2-C20orf24 | 7739 |
| 20 | 36966086 | 36968583 | + | int | 7740 |
| 20 | 38527690 | 38528659 | + | int | 7741 |
| 20 | 39033077 | 39034400 | + | int | 7742 |
| 20 | 39051779 | 39052903 | + | int | 7743 |
| 20 | 40980853 | 40981120 | − | PTPRT | 7744 |
| 20 | 42189157 | 42193085 | + | SGK2 | 7745 |
| 20 | 42468950 | 42469641 | + | int | 7746 |
| 20 | 42603140 | 42604667 | + | TOX2 | 7747 |
| 20 | 42603140 | 42604667 | + | TOX2 | 7748 |
| 20 | 42603140 | 42604667 | + | TOX2 | 7749 |
| 20 | 47835955 | 47836086 | + | DDX27 | 7750 |
| 20 | 50221345 | 50221575 | − | ATP9A | 7751 |
| 20 | 51184085 | 51184858 | + | int | 7752 |
| 20 | 54201207 | 54202083 | + | int | 7753 |
| 20 | 58747666 | 58749127 | + | LOC284757 | 7754 |
| 20 | 59933176 | 59934452 | + | CDH4 | 7755 |
| 21 | 15334187 | 15334995 | − | ANKRD20A11P | 7756 |
| 21 | 15981652 | 15984172 | − | LOC388813 | 7757 |
| 21 | 18210087 | 18210427 | + | int | 7758 |
| 21 | 18514413 | 18515002 | + | int | 7759 |
| 21 | 20626286 | 20626552 | + | int | 7760 |
| 21 | 21385991 | 21386184 | + | int | 7761 |
| 21 | 22321486 | 22322112 | + | int | 7762 |
| 21 | 22372068 | 22373107 | + | NCAM2 | 7763 |
| 21 | 22384873 | 22389111 | + | NCAM2 | 7764 |
| 21 | 22853240 | 22853893 | + | NCAM2 | 7765 |
| 21 | 23232576 | 23233181 | + | int | 7766 |
| 21 | 23822478 | 23823170 | + | int | 7767 |
| 21 | 24235322 | 24236395 | + | int | 7768 |
| 21 | 24248094 | 24251423 | + | int | 7769 |
| 21 | 24599957 | 24601569 | + | int | 7770 |
| 21 | 25831267 | 25831570 | + | int | 7771 |
| 21 | 28678630 | 28679302 | − | MIR5009 | 7772 |
| 21 | 30718420 | 30718469 | + | BACH1 | 7773 |
| 21 | 30718420 | 30718469 | + | BACH1 | 7774 |
| 21 | 30718420 | 30718469 | + | BACH1 | 7775 |
| 21 | 31303528 | 31305871 | − | GRIK1 | 7776 |
| 21 | 31303528 | 31305871 | − | GRIK1 | 7777 |
| 21 | 32558396 | 32559526 | − | TIAM1 | 7778 |
| 21 | 33211830 | 33214376 | + | int | 7779 |
| 21 | 33336530 | 33337378 | + | HUNK | 7780 |
| 21 | 34090993 | 34092191 | − | SYNJ1 | 7781 |
| 21 | 34090993 | 34092191 | − | SYNJ1 | 7782 |
| 21 | 36604577 | 36605470 | + | int | 7783 |
| 21 | 37080660 | 37081727 | + | int | 7784 |
| 21 | 37550745 | 37551588 | + | DOPEY2 | 7785 |
| 21 | 38057290 | 38058248 | + | int | 7786 |
| 21 | 43827956 | 43828865 | + | UBASH3A | 7787 |
| 21 | 44093265 | 44094840 | + | PDE9A | 7788 |
| 22 | 17597226 | 17598024 | − | CECR6 | 7789 |
| 22 | 17597226 | 17598024 | − | CECR6 | 7790 |
| 22 | 25625156 | 25625641 | + | CRYBB2 | 7791 |
| 22 | 28110878 | 28111435 | + | int | 7792 |
| 22 | 28441394 | 28442214 | − | TTC28 | 7793 |
| 22 | 30860717 | 30861972 | − | SEC14L3 | 7794 |
| 22 | 31368966 | 31369980 | + | TUG1 | 7795 |
| 22 | 32007428 | 32009387 | + | SFI1 | 7796 |
| 22 | 32010539 | 32011949 | + | SFI1 | 7797 |
| 22 | 32015854 | 32017269 | − | PISD | 7798 |
| 22 | 32016919 | 32021691 | − | PISD | 7799 |
| 22 | 32020968 | 32022116 | − | PISD | 7800 |
| 22 | 32021094 | 32022116 | − | PISD | 7801 |
| 22 | 35726444 | 35743966 | + | MIR3909 | 7802 |

TABLE 2-continued

| chromosome | start | stop | strand | nearest gene | ID |
|---|---|---|---|---|---|
| 22 | 35726444 | 35743966 | + | TOM1 | 7803 |
| 22 | 35726444 | 35743966 | + | TOM1 | 7804 |
| 22 | 39118496 | 39119525 | + | GTPBP1 | 7805 |
| 22 | 39901918 | 39902480 | + | SMCR7L | 7806 |
| 22 | 43650725 | 43651812 | − | SCUBE1 | 7807 |
| 22 | 44389170 | 44389660 | + | SAMM50 | 7808 |
| 22 | 44680418 | 44681632 | − | KIAA1644 | 7809 |
| 22 | 45993179 | 45996119 | + | FBLN1 | 7810 |
| 22 | 46545814 | 46546921 | + | PPARA | 7811 |
| 22 | 48813172 | 48814314 | + | int | 7812 |
| 22 | 49407925 | 49408917 | + | int | 7813 |
| X | 9934910 | 9937295 | + | LOC100288814 | 7814 |
| X | 10264411 | 10264759 | + | int | 7815 |
| X | 10415590 | 10417999 | − | MID1 | 7816 |
| X | 10415590 | 10417999 | − | MID1 | 7817 |
| X | 10415590 | 10417999 | − | MID1 | 7818 |
| X | 10415590 | 10417999 | − | MID1 | 7819 |
| X | 11030814 | 11030960 | + | int | 7820 |
| X | 11902065 | 11902197 | + | int | 7821 |
| X | 13926576 | 13926873 | − | GPM6B | 7822 |
| X | 14212954 | 14213202 | + | int | 7823 |
| X | 14257984 | 14258249 | + | int | 7824 |
| X | 14272823 | 14273312 | + | int | 7825 |
| X | 14286751 | 14287277 | + | int | 7826 |
| X | 15122623 | 15123118 | + | int | 7827 |
| X | 19497752 | 19500958 | − | MAP3K15 | 7828 |
| X | 19970782 | 19971984 | − | CXorf23 | 7829 |
| X | 21250338 | 21250931 | + | int | 7830 |
| X | 21515891 | 21516185 | + | CNKSR2 | 7831 |
| X | 21515891 | 21516185 | + | CNKSR2 | 7832 |
| X | 21608334 | 21609541 | + | CNKSR2 | 7833 |
| X | 21608334 | 21609541 | + | CNKSR2 | 7834 |
| X | 21874178 | 21875284 | + | MBTPS2 | 7835 |
| X | 21874178 | 21875284 | + | YY2 | 7836 |
| X | 22004525 | 22005076 | + | SMS | 7837 |
| X | 22642669 | 22642967 | − | LOC100873065 | 7838 |
| X | 23295821 | 23297129 | − | LOC100873065 | 7839 |
| X | 25197622 | 25199016 | + | int | 7840 |
| X | 25206553 | 25206758 | + | int | 7841 |
| X | 25290002 | 25290276 | + | int | 7842 |
| X | 25847000 | 25847274 | + | int | 7843 |
| X | 26240374 | 26240598 | + | int | 7844 |
| X | 26481233 | 26481621 | + | int | 7845 |
| X | 26572162 | 26572503 | + | int | 7846 |
| X | 26588583 | 26588998 | + | int | 7847 |
| X | 26620366 | 26621051 | + | int | 7848 |
| X | 27159453 | 27159616 | + | int | 7849 |
| X | 27167913 | 27168489 | + | int | 7850 |
| X | 27702721 | 27702987 | + | int | 7851 |
| X | 28083965 | 28084620 | + | int | 7852 |
| X | 28358168 | 28358480 | + | int | 7853 |
| X | 28394648 | 28394858 | + | int | 7854 |
| X | 28678728 | 28679453 | + | IL1RAPL1 | 7855 |
| X | 28862453 | 28862819 | + | IL1RAPL1 | 7856 |
| X | 28971968 | 28972200 | + | IL1RAPL1 | 7857 |
| X | 29248448 | 29249457 | + | IL1RAPL1 | 7858 |
| X | 29515852 | 29516435 | + | IL1RAPL1 | 7859 |
| X | 29599098 | 29599648 | + | IL1RAPL1 | 7860 |
| X | 29902162 | 29902359 | + | IL1RAPL1 | 7861 |
| X | 29960513 | 29961512 | + | IL1RAPL1 | 7862 |
| X | 30077862 | 30078134 | + | int | 7863 |
| X | 30151514 | 30151725 | + | int | 7864 |
| X | 30577392 | 30578440 | − | CXorf21 | 7865 |
| X | 30878218 | 30878495 | − | TAB3 | 7866 |
| X | 31742976 | 31743175 | − | DMD | 7867 |
| X | 31742976 | 31743175 | − | DMD | 7868 |
| X | 31742976 | 31743175 | − | DMD | 7869 |
| X | 31742976 | 31743175 | − | DMD | 7870 |
| X | 31742976 | 31743175 | − | DMD | 7871 |
| X | 31742976 | 31743175 | − | DMD | 7872 |
| X | 31742976 | 31743175 | − | DMD | 7873 |
| X | 31779912 | 31780938 | − | DMD | 7874 |
| X | 31779912 | 31780938 | − | DMD | 7875 |
| X | 31779912 | 31780938 | − | DMD | 7876 |
| X | 31779912 | 31780938 | − | DMD | 7877 |
| X | 31779912 | 31780938 | − | DMD | 7878 |
| X | 31779912 | 31780938 | − | DMD | 7879 |
| X | 31779912 | 31780938 | − | DMD | 7880 |

TABLE 2-continued

| chromosome | start | stop | strand | nearest gene | ID |
|---|---|---|---|---|---|
| X | 31814625 | 31815882 | − | DMD | 7881 |
| X | 31814625 | 31815882 | − | DMD | 7882 |
| X | 31814625 | 31815882 | − | DMD | 7883 |
| X | 31814625 | 31815882 | − | DMD | 7884 |
| X | 31814625 | 31815882 | − | DMD | 7885 |
| X | 31814625 | 31815882 | − | DMD | 7886 |
| X | 31814625 | 31815882 | − | DMD | 7887 |
| X | 32079093 | 32079565 | − | DMD | 7888 |
| X | 32079093 | 32079565 | − | DMD | 7889 |
| X | 32079093 | 32079565 | − | DMD | 7890 |
| X | 32079093 | 32079565 | − | DMD | 7891 |
| X | 32079093 | 32079565 | − | DMD | 7892 |
| X | 32079093 | 32079565 | − | DMD | 7893 |
| X | 32079093 | 32079565 | − | DMD | 7894 |
| X | 32215822 | 32216035 | − | DMD | 7895 |
| X | 32215822 | 32216035 | − | DMD | 7896 |
| X | 32215822 | 32216035 | − | DMD | 7897 |
| X | 32215822 | 32216035 | − | DMD | 7898 |
| X | 32215822 | 32216035 | − | DMD | 7899 |
| X | 32215822 | 32216035 | − | DMD | 7900 |
| X | 33360377 | 33361355 | + | int | 7901 |
| X | 34294496 | 34294814 | + | int | 7902 |
| X | 34725273 | 34725625 | + | int | 7903 |
| X | 35142638 | 35143065 | + | int | 7904 |
| X | 35876281 | 35877441 | + | int | 7905 |
| X | 36108384 | 36109383 | + | CHDC2 | 7906 |
| X | 36270733 | 36270936 | + | CXorf30 | 7907 |
| X | 37351254 | 37351413 | + | int | 7908 |
| X | 37351268 | 37352029 | + | int | 7909 |
| X | 39646155 | 39647467 | + | int | 7910 |
| X | 39646161 | 39646855 | + | int | 7911 |
| X | 39646188 | 39647467 | + | int | 7912 |
| X | 39646189 | 39647096 | + | int | 7913 |
| X | 39646194 | 39647289 | + | int | 7914 |
| X | 39646262 | 39647260 | + | int | 7915 |
| X | 39646304 | 39647295 | + | int | 7916 |
| X | 39646313 | 39647316 | + | int | 7917 |
| X | 39647261 | 39647467 | + | int | 7918 |
| X | 40364073 | 40364857 | + | int | 7919 |
| X | 42233257 | 42233587 | + | int | 7920 |
| X | 42325918 | 42326436 | + | int | 7921 |
| X | 43597321 | 43598978 | + | MAOA | 7922 |
| X | 43702090 | 43702328 | − | MAOB | 7923 |
| X | 43864258 | 43864430 | + | int | 7924 |
| X | 44887718 | 44888894 | + | KDM6A | 7925 |
| X | 46298977 | 46299956 | + | int | 7926 |
| X | 48758329 | 48759800 | + | PQBP1 | 7927 |
| X | 48758329 | 48759800 | + | PQBP1 | 7928 |
| X | 48758329 | 48759800 | + | PQBP1 | 7929 |
| X | 48758329 | 48759800 | + | PQBP1 | 7930 |
| X | 48758329 | 48759800 | + | PQBP1 | 7931 |
| X | 48972038 | 48972646 | − | GPKOW | 7932 |
| X | 50090293 | 50091312 | + | CCNB3 | 7933 |
| X | 50226433 | 50227480 | + | int | 7934 |
| X | 50328272 | 50329225 | + | int | 7935 |
| X | 50438504 | 50439227 | − | SHROOM4 | 7936 |
| X | 53676775 | 53677571 | − | HUWE1 | 7937 |
| X | 54423586 | 54424379 | + | int | 7938 |
| X | 55481010 | 55482493 | + | int | 7939 |
| X | 55743869 | 55744936 | + | RRAGB | 7940 |
| X | 56772420 | 56772721 | + | LOC550643 | 7941 |
| X | 57145012 | 57146007 | + | int | 7942 |
| X | 57146997 | 57147804 | − | SPIN2B | 7943 |
| X | 57160737 | 57161075 | + | int | 7944 |
| X | 62877290 | 62877823 | − | ARHGEF9 | 7945 |
| X | 62877290 | 62877823 | − | ARHGEF9 | 7946 |
| X | 64738869 | 64739880 | − | LAS1L | 7947 |
| X | 64876292 | 64877641 | + | int | 7948 |
| X | 65482480 | 65482639 | + | HEPH | 7949 |
| X | 65482480 | 65482639 | + | HEPH | 7950 |
| X | 65482480 | 65482639 | + | HEPH | 7951 |
| X | 65841797 | 65842951 | − | EDA2R | 7952 |
| X | 65841797 | 65842951 | − | EDA2R | 7953 |
| X | 67937357 | 67938369 | + | STARD8 | 7954 |
| X | 67937357 | 67938369 | + | STARD8 | 7955 |
| X | 73039824 | 73041018 | + | TSIX | 7956 |
| X | 73039824 | 73041018 | − | XIST | 7957 |
| X | 73045856 | 73047100 | + | TSIX | 7958 |

TABLE 2-continued

| chromosome | start | stop | strand | nearest gene | ID |
|---|---|---|---|---|---|
| X | 73045856 | 73047100 | − | XIST | 7959 |
| X | 73047936 | 73051881 | + | TSIX | 7960 |
| X | 73047936 | 73051881 | − | XIST | 7961 |
| X | 73061761 | 73069426 | − | XIST | 7962 |
| X | 74362435 | 74362959 | − | ABCB7 | 7963 |
| X | 76709050 | 76710645 | + | FGF16 | 7964 |
| X | 77154565 | 77156019 | + | COX7B | 7965 |
| X | 80185099 | 80186175 | + | int | 7966 |
| X | 80423600 | 80425100 | − | HMGN5 | 7967 |
| X | 80850986 | 80851228 | + | int | 7968 |
| X | 82581201 | 82581857 | + | int | 7969 |
| X | 83695691 | 83696634 | − | HDX | 7970 |
| X | 84036908 | 84037115 | + | int | 7971 |
| X | 84340906 | 84342140 | + | APOOL | 7972 |
| X | 84413785 | 84414294 | + | int | 7973 |
| X | 85137686 | 85138537 | − | CHM | 7974 |
| X | 85509235 | 85510253 | + | DACH2 | 7975 |
| X | 85777493 | 85778402 | + | DACH2 | 7976 |
| X | 85777493 | 85778402 | + | DACH2 | 7977 |
| X | 86245525 | 86245871 | + | int | 7978 |
| X | 87768045 | 87768592 | + | int | 7979 |
| X | 87968468 | 87968864 | + | int | 7980 |
| X | 88905456 | 88905826 | + | int | 7981 |
| X | 90001252 | 90001613 | + | int | 7982 |
| X | 90356767 | 90357363 | + | int | 7983 |
| X | 90892493 | 90894503 | + | int | 7984 |
| X | 91104025 | 91104829 | + | PCDH11X | 7985 |
| X | 91104025 | 91104829 | + | PCDH11X | 7986 |
| X | 91104025 | 91104829 | + | PCDH11X | 7987 |
| X | 91104025 | 91104829 | + | PCDH11X | 7988 |
| X | 91151438 | 91151761 | + | PCDH11X | 7989 |
| X | 91151438 | 91151761 | + | PCDH11X | 7990 |
| X | 91609285 | 91610819 | + | PCDH11X | 7991 |
| X | 91609285 | 91610819 | + | PCDH11X | 7992 |
| X | 91753066 | 91753211 | + | PCDH11X | 7993 |
| X | 91753066 | 91753211 | + | PCDH11X | 7994 |
| X | 91873066 | 91874187 | + | PCDH11X | 7995 |
| X | 91873066 | 91874187 | + | PCDH11X | 7996 |
| X | 92619153 | 92619359 | + | int | 7997 |
| X | 92634463 | 92635183 | + | int | 7998 |
| X | 92719720 | 92720152 | + | int | 7999 |
| X | 93042701 | 93042895 | + | int | 8000 |
| X | 93167355 | 93167689 | + | int | 8001 |
| X | 93340437 | 93342023 | + | int | 8002 |
| X | 93367568 | 93368003 | + | int | 8003 |
| X | 93503858 | 93505137 | + | int | 8004 |
| X | 94635217 | 94636016 | + | int | 8005 |
| X | 94898720 | 94899994 | + | int | 8006 |
| X | 95440587 | 95441564 | + | int | 8007 |
| X | 95582132 | 95584420 | + | int | 8008 |
| X | 95625497 | 95625945 | + | int | 8009 |
| X | 95762608 | 95762833 | + | int | 8010 |
| X | 95820455 | 95821003 | + | int | 8011 |
| X | 95827245 | 95827520 | + | int | 8012 |
| X | 96139196 | 96140183 | + | DIAPH2 | 8013 |
| X | 96139196 | 96140183 | + | DIAPH2 | 8014 |
| X | 96139196 | 96140183 | + | RPA4 | 8015 |
| X | 96815904 | 96816839 | + | DIAPH2 | 8016 |
| X | 97106256 | 97107180 | + | int | 8017 |
| X | 97348775 | 97349005 | + | int | 8018 |
| X | 98961900 | 98962360 | − | LOC442459 | 8019 |
| X | 99284617 | 99285306 | + | int | 8020 |
| X | 99446643 | 99447162 | + | int | 8021 |
| X | 99671924 | 99673128 | + | int | 8022 |
| X | 100536707 | 100538583 | − | TAF7L | 8023 |
| X | 100536707 | 100538583 | − | TAF7L | 8024 |
| X | 100852649 | 100853543 | + | int | 8025 |
| X | 101693886 | 101694181 | − | NXF2 | 8026 |
| X | 101693886 | 101694181 | − | NXF2B | 8027 |
| X | 102893114 | 102894204 | + | int | 8028 |
| X | 103776328 | 103777486 | + | int | 8029 |
| X | 104050454 | 104050934 | + | IL1RAPL2 | 8030 |
| X | 104472642 | 104472919 | + | IL1RAPL2 | 8031 |
| X | 104624474 | 104625323 | + | IL1RAPL2 | 8032 |
| X | 106335488 | 106335876 | − | RBM41 | 8033 |
| X | 106335488 | 106335876 | − | RBM41 | 8034 |
| X | 107570697 | 107571014 | − | COL4A6 | 8035 |
| X | 107570697 | 107571014 | − | COL4A6 | 8036 |

TABLE 2-continued

| chromosome | start | stop | strand | nearest gene | ID |
|---|---|---|---|---|---|
| X | 107708231 | 107708502 | + | COL4A5 | 8037 |
| X | 108366501 | 108366665 | + | int | 8038 |
| X | 108718159 | 108719385 | − | GUCY2F | 8039 |
| X | 109315230 | 109325750 | + | MIR3978 | 8040 |
| X | 109315230 | 109325750 | + | TMEM164 | 8041 |
| X | 109315230 | 109325750 | + | TMEM164 | 8042 |
| X | 110365709 | 110366682 | + | PAK3 | 8043 |
| X | 110365709 | 110366682 | + | PAK3 | 8044 |
| X | 110365709 | 110366682 | + | PAK3 | 8045 |
| X | 111782882 | 111783313 | + | int | 8046 |
| X | 112186828 | 112187205 | + | int | 8047 |
| X | 112602488 | 112602681 | + | int | 8048 |
| X | 113276081 | 113276547 | + | int | 8049 |
| X | 114470606 | 114471218 | + | int | 8050 |
| X | 114738890 | 114739141 | + | int | 8051 |
| X | 114738964 | 114739202 | + | int | 8052 |
| X | 117592321 | 117592492 | + | int | 8053 |
| X | 119551635 | 119552955 | + | int | 8054 |
| X | 119672193 | 119672398 | − | CUL4B | 8055 |
| X | 119672193 | 119672398 | − | CUL4B | 8056 |
| X | 119959609 | 119959719 | + | int | 8057 |
| X | 120169044 | 120169222 | + | int | 8058 |
| X | 121313608 | 121314372 | + | int | 8059 |
| X | 121582736 | 121583021 | + | int | 8060 |
| X | 121609260 | 121609550 | + | int | 8061 |
| X | 122116557 | 122117342 | + | int | 8062 |
| X | 122131352 | 122132305 | + | int | 8063 |
| X | 122695776 | 122697082 | + | int | 8064 |
| X | 123232773 | 123233853 | + | STAG2 | 8065 |
| X | 123232773 | 123233853 | + | STAG2 | 8066 |
| X | 123466765 | 123467484 | + | int | 8067 |
| X | 123734094 | 123734446 | − | TENM1 | 8068 |
| X | 123744756 | 123745226 | − | TENM1 | 8069 |
| X | 124054674 | 124054814 | − | TENM1 | 8070 |
| X | 124088523 | 124088880 | − | TENM1 | 8071 |
| X | 124128924 | 124130224 | + | int | 8072 |
| X | 124262222 | 124262524 | + | int | 8073 |
| X | 124532618 | 124532901 | + | int | 8074 |
| X | 124577309 | 124577532 | + | int | 8075 |
| X | 124829887 | 124830540 | + | int | 8076 |
| X | 125893677 | 125895415 | + | int | 8077 |
| X | 125949897 | 125950777 | + | int | 8078 |
| X | 126115054 | 126116196 | + | int | 8079 |
| X | 126126125 | 126126406 | + | int | 8080 |
| X | 126248266 | 126248419 | + | int | 8081 |
| X | 126604249 | 126604423 | + | int | 8082 |
| X | 127107252 | 127107295 | + | int | 8083 |
| X | 128165254 | 128166228 | + | int | 8084 |
| X | 128656784 | 128657781 | − | SMARCA1 | 8085 |
| X | 128944653 | 128945690 | − | ZDHHC9 | 8086 |
| X | 128944653 | 128945690 | − | ZDHHC9 | 8087 |
| X | 129058978 | 129059787 | + | UTP14A | 8088 |
| X | 129726268 | 129726444 | + | int | 8089 |
| X | 130284543 | 130284674 | + | int | 8090 |
| X | 130349150 | 130349381 | + | int | 8091 |
| X | 130398188 | 130399134 | + | int | 8092 |
| X | 130632183 | 130633584 | + | int | 8093 |
| X | 130657289 | 130658369 | + | int | 8094 |
| X | 130718850 | 130719181 | + | int | 8095 |
| X | 135955684 | 135956845 | − | RBMX | 8096 |
| X | 135955684 | 135956845 | − | RBMX | 8097 |
| X | 137052113 | 137052688 | + | int | 8098 |
| X | 139058614 | 139066883 | + | int | 8099 |
| X | 140069151 | 140069693 | + | int | 8100 |
| X | 140384152 | 140384535 | + | int | 8101 |
| X | 140394522 | 140394787 | + | int | 8102 |
| X | 140578209 | 140578373 | + | int | 8103 |
| X | 141327955 | 141328628 | + | int | 8104 |
| X | 141594281 | 141594444 | + | int | 8105 |
| X | 141683617 | 141683931 | + | int | 8106 |
| X | 142167954 | 142168237 | + | int | 8107 |
| X | 142177472 | 142178161 | + | int | 8108 |
| X | 142399415 | 142399705 | + | int | 8109 |
| X | 142721260 | 142722234 | − | SLITRK4 | 8110 |
| X | 142721260 | 142722234 | − | SLITRK4 | 8111 |
| X | 142721260 | 142722234 | − | SLITRK4 | 8112 |
| X | 142744096 | 142745259 | + | int | 8113 |
| X | 143212388 | 143212810 | + | int | 8114 |

TABLE 2-continued

| chromosome | start | stop | strand | nearest gene | ID |
|---|---|---|---|---|---|
| X | 143405020 | 143405595 | + | int | 8115 |
| X | 144067963 | 144069446 | + | int | 8116 |
| X | 144295143 | 144295652 | + | int | 8117 |
| X | 144302247 | 144302770 | + | int | 8118 |
| X | 144355024 | 144355622 | + | int | 8119 |
| X | 144836473 | 144836729 | + | int | 8120 |
| X | 145365447 | 145365618 | + | int | 8121 |
| X | 145763732 | 145769741 | + | int | 8122 |
| X | 145895795 | 145896128 | − | CXorf51A | 8123 |
| X | 145895795 | 145896128 | − | CXorf51B | 8124 |
| X | 147369284 | 147370961 | + | int | 8125 |
| X | 147448127 | 147448492 | + | int | 8126 |
| X | 149924816 | 149928481 | + | MTMR1 | 8127 |
| X | 150161957 | 150162473 | + | int | 8128 |
| X | 152227043 | 152228672 | + | PNMA3 | 8129 |
| X | 152388832 | 152393903 | + | int | 8130 |
| X | 152388836 | 152393446 | + | int | 8131 |
| X | 152388881 | 152393726 | + | int | 8132 |
| X | 152395514 | 152396836 | + | int | 8133 |
| X | 152395546 | 152396836 | + | int | 8134 |
| X | 152535880 | 152536127 | + | int | 8135 |
| X | 152663383 | 152664056 | + | int | 8136 |
| X | 153613453 | 153613876 | + | int | 8137 |
| Un_gl000216 | 138945 | 140026 | + | int | 8138 |

TABLE 4

PRC2 target genes in the Q1 quartile.
Q1 EZH2 Peak genes

| | | | |
|---|---|---|---|
| Tbc1d30 | Snord37 | Obscn | Hdgfl1 |
| Rassf3 | Dapk3 | Gjc2 | Fam50b |
| Agap2 | Tjp3 | Srebf1 | Phactr1 |
| Lrp1 | Pip5k1c | Mapk7 | Nhlrc1 |
| Gpr6 | Tbxa2r | Slc5a10 | Bicd2 |
| 9030612E09Rik | Gipc3 | Fam83g | Cltb |
| Bend3 | Tle2 | F930015N05Rik | Slc34a1 |
| 1700021F05Rik | Ckap4 | Ntn1 | Pfn3 |
| Msl3l2 | Btbd11 | A030009H04Rik | Pcbd2 |
| 4933403O03Rik | Ascl1 | Wscd1 | Pitx1 |
| Dux | Naglu | Pitpnm3 | Neurog1 |
| Spock2 | Hsd17b1 | Atp2a3 | Zap70 |
| Chst3 | Sost | Camkk1 | Irx1 |
| Cdh23 | Fam171a2 | Fcrlb | Irx2 |
| Dnc5b | Adam11 | Vangl2 | Inpp4a |
| Lrrc20 | Wnt9b | Kcnj9 | Nkd2 |
| Tysnd1 | Wnt3 | Vsig8 | Gpr150 |
| Tspan15 | Ace | Dph1 | Pou3f3 |
| Slc16a9 | Cacng4 | Rtn4rl1 | Colg |
| Rtdr1 | Kif19a | Olfr418-ps1 | Gprin2 |
| Gnaz | Btbd17 | Serpinf2 | Syt15 |
| Bcr | Gprc5c | Wdr81 | Rem2 |
| Adora2a | Cd300a | Olfr433 | Slc22a17 |
| Pcnt | Tmem104 | Olfr420 | Efs |
| Col6a2 | Grin2c | Tmem132e | D830015G02Rik |
| Col6a1 | Otop2 | Gas212 | Jph4 |
| Lrrc3 | Ush1g | Tbx2 | Ltb4r1 |
| Pfkl | Ube2o | Mpo | Gm5801 |
| Mier2 | Sept9 | Akap1 | Lats2 |
| Hcn2 | C1qtnf1 | Trim25 | Mir124a-1 |
| BC005764 | D11Bwg0517e | Nog | Fam160b2 |
| Grin3b | Cbx4 | G0s2 | Epb4.9 |
| ORF61 | Nptx1 | Phospho1 | Pcdh8 |
| Hmha1 | Bahcc1 | Abi3 | Oit1 |
| Sbno2 | Aspscr1 | Osbpl7 | Krt81 |
| Dos | Fasn | Srcin1 | Soat2 |
| 2310011J03Rik | Otx1 | E130012A19Rik | Ppp1r1a |
| Pcsk4 | C1ql2 | Igfbp4 | Eif2c2 |
| Reep6 | Pisd-ps1 | Krt27 | Slc45a4 |
| Plk5 | Pisd-ps3 | Ccdc88c | Gpr20 |
| Mex3d | Sfi1 | Hhipl1 | Ptp4a3 |
| Mbd3 | Il9r | Begain | Bai1 |
| Onecut3 | Tlx3 | Amn | Mapk15 |
| Fam108a | Tmcc2 | Akt1 | Scrib |
| Ap3d1 | Etnk2 | Jag2 | Plec |

TABLE 4-continued

PRC2 target genes in the Q1 quartile.
Q1 EZH2 Peak genes

| | | | |
|---|---|---|---|
| Amh | Syt2 | Mta1 | Scrt1 |
| Lingo3 | C1qtnf2 | E2f6 | Ncf4 |
| 3110056O03Rik | Msc | Actn1 | Card10 |
| Timm13 | Col23a1 | Gdf7 | Galr3 |
| Lmnb2 | Shroom1 | Gm1995 | Ankrd54 |
| Diras1 | Ankrd43 | Gm7104 | Pla2g6 |
| Thop1 | Sept8 | Gpr137b | Sun2 |
| Eef2 | | Hist1h2aa | Pdgfb |

TABLE 5

PRC2 target genes in the Q1 quartile.

| | | | |
|---|---|---|---|
| Cacna1i | Rasal3 | 2810459M11Rik | Elmo2 |
| Fam83f | H2-K1 | Nfatc1 | Prex1 |
| Zc3h7b | Tnxb | Ecel1 | Ddx27 |
| A4galt | H2-Q2 | Dagla | Ube2v1 |
| Scube1 | H2-Q6 | Syt7 | Ptpn1 |
| Parvb | H2-Q7 | Lrrc10b | Fam65c |
| Prr5 | Dhx16 | Olfr1494 | Mocs3 |
| Wnt7b | Trim15 | Foxb2 | 2410001C21Rik |
| Celsr1 | Trim10 | Gbx2 | 9030418K01Rik |
| Cerk | Olfr94 | Espnl | Lama5 |
| Trabd | Olfr95 | Traf3ip1 | Bhlhe23 |
| 1300018J18Rik | Tns1 | Twist2 | Grin1 |
| Sbf1 | Slc11a1 | Sfrp5 | Bmyc |
| Shank3 | Ctdsp1 | Pold4 | Lhx3 |
| H1fnt | Tmem151b | Pax2 | Fam163b |
| Mll2 | Slc35b2 | Lzts2 | Brd3 |
| Prph | Mrps18a | Lbx1 | St6galnac6 |
| Kcnh3 | Tjap1 | Trim8 | Fpgs |
| Nckap5l | Ttbk1 | Neurl1a | Fam125b |
| Aqp2 | Klc4 | Dusp28 | Crb2 |
| Zc3h7a | Cul7 | Peli3 | Lhx2 |
| Ndel | Guca1a | Gpam | Nr5a1 |
| Scarf2 | Tcfeb | Gm962 | Evx2 |
| Slc25a1 | B430306N03Rik | Sipa1 | Hoxd11 |
| Rtn4r | Cdk5r2 | Map3k11 | Hoxd4 |
| Zdhhc8 | Ihh | Ltbp3 | Rtn4rl2 |
| Tbx1 | Speg | Trub1 | C1qtnf4 |
| Sept5 | Plin5 | Frmd8 | Alx4 |
| Gp5 | Lrg1 | Csf2ra | Gm13889 |
| Adcy5 | Sema6b | Nrxn2 | Syt6 |

TABLE 5-continued

PRC2 target genes in the Q1 quartile.

| | | | |
|---|---|---|---|
| Zdhhc23 | Dpp9 | Plcb3 | Ppm1j |
| Glis2 | Ptprs | Pak6 | Wnt2b |
| Coro7 | Znrf4 | Bahd1 | Kcna3 |
| Krtap11-1 | Nrtn | Itpka | Kcna2 |
| Rcan1 | Slc25a23 | Ltk | Kcnc4 |
| Clic6 | Crb3 | Mtap1a | Alx3 |
| Setd4 | Dennd1c | Bambi-ps1 | Neurog2 |
| Hlcs | Emilin2 | Eid1 | Gm5712 |
| Ripk4 | Gm10190 | Kcnip3 | Spry1 |
| Dnase1l2 | Sft2d1 | Foxa2 | Pearl |
| E4f1 | Abcg5 | Sstr4 | Ntrk1 |
| Caskin1 | Gm12166 | Tspyl3 | Bcan |
| Tmem8 | Prr18 | 8430427H17Rik | Hapln2 |
| Grm4 | Six3 | Necab3 | Iqgap3 |
| Uhrf1bp1 | Six2 | 1700003F12Rik | Mef2d |
| Anks1 | Ttc7 | Fam83c | Smg5 |
| Fance | Fam53c | 9830001H06Rik | Paqr6 |
| Lhfpl5 | Pura | Vstm2l | Adar |
| Brpf3 | Pcdhb6 | Adig | C2cd4d |
| Cdkn1a | Pcdhb11 | Slc32a1 | Sema6c |
| Mdga1 | Pcdhb12 | Ppp1r16b | Ttc22 |
| Pisd-ps2 | Pcdhb15 | Lpin3 | Glis1 |
| Abcg1 | Pcdhb17 | Emilin3 | Dmrta2 |
| Tmprss3 | Spry4 | L3mbtl | Foxd2 |
| Cbs | St8sia5 | Cdh22 | Dmbx1 |

TABLE 4

PRC2 target genes in the Q1 quartile.

| | | | |
|---|---|---|---|
| Faah | Wscd2 | Ankrd56 | Jph3 |
| Ptch2 | Cmklr1 | Iffo1 | Zfpm1 |
| Edn2 | Msi1 | Tnfrsf1a | Mvd |
| Foxo6 | Pxn | Fkbp4 | Rnf166 |
| Cited4 | Gcnl1 | Flnc | Ctu2 |
| Bmp8a | Ksr2 | Smo | Trappc2l |
| Epha10 | Nos1 | Mir182 | Cbfa2t3 |
| Rspo1 | Lhx5 | Klf14 | Cdh15 |
| Trappc3 | Plbd2 | Podxl | Afg3l1 |
| Trim62 | Ddx54 | Zfp783 | Acta1 |
| Nkain1 | Dtx1 | Sspo | Galnt2 |
| Matn1 | Adam1b | AI854703 | Pgbd5 |
| Ptpru | Sh2b3 | Evx1 | Ttc13 |
| BC013712 | Cux2 | 1200009O22Rik | Trim67 |
| Ahdc1 | Camkk2 | Dlx6 | Sipa1l2 |
| 1810019J16Rik | Hip1r | Dlx6as | BC021891 |
| Aim1l | Dnahc10 | Slc4a5 | Cln8 |
| Nipal3 | Ncor2 | Tet3 | Kbtbd11 |
| Zfp46 | Gpr133 | Atp6v1b1 | Ank1 |
| Ephb2 | Trim50 | Fbxo41 | Zfp358 |
| Rap1gap | Nsun5 | Egr4 | 2310057J16Rik |
| Fam43b | Ywhag | Gpr27 | Hand2 |
| Aldh4a1 | Alkbh4 | Klhl35 | Cilp2 |
| Tas1r2 | Mblac1 | Phox2a | Homer3 |
| Rcc2 | 3110082I17Rik | Rbmxl2 | Gdf1 |
| Padi2 | Uncx | Doc2a | Lass1 |
| Mfap2 | Ints1 | Qprt | Upf1 |
| Epha2 | Elfn1 | Utf1 | Crtc1 |
| Fam131c | Ttyh3 | Mrgpre | Klhl26 |
| 9030409G11Rik | Radil | Fgf3 | Ssbp4 |
| Lrrc38 | Fbxl18 | Rtn2 | Kcnn1 |
| Casz1 | Zfp316 | Apoe | Myo9b |
| Dnajc11 | Grid2ip | Zfp575 | Use1 |
| Klhl21 | Gsx1 | Lypd4 | Nr2f6 |
| Zbtb48 | Kcnh2 | Dmrtc2 | Gtpbp3 |
| Espn | Atg9b | Tmem145 | Fam129c |
| Icmt | Agap3 | Il28a | Unc13a |
| Nphp4 | Gbx1 | Fbxo27 | B3gnt3 |
| Megf6 | En2 | Lrfn3 | Ap1m1 |
| Arhgef16 | Shh | Scn1b | Rasd2 |
| Prdm16 | Mnx1 | A430110N23Rik | Ptger1 |
| Ttc34 | Fam59b | Il4i1 | Lphn1 |
| Hes5 | Kcnk3 | Olfr1344 | 1700067K01Rik |
| Pank4 | Khk | Mesp1 | Rfx1 |
| Plch2 | Cad | Cdh5 | Podnl1 |

TABLE 4-continued

PRC2 target genes in the Q1 quartile.

| | | | |
|---|---|---|---|
| Morn1 | Slc30a3 | Plekhg4 | Cacna1a |
| Cntfr | Sh3bp2 | Zfhx3 | Zfp423 |
| N28178 | Adra2c | Ctrb1 | Adcy7 |
| Coro2a | Hmx1 | Pkd1l2 | Cpne2 |
| Col15a1 | Htra3 | 4933407C03Rik | Ccdc102a |
| Rgs3 | Sh3tc1 | Plcg2 | Grm2 |
| Gdf6 | Nkx3-2 | Adad2 | Cacna2d2 |
| Foxd3 | Slc34a2 | Foxl1 | Ifrd2 |
| Tpst2 | Phox2b | Sox1 | Bsn |
| Asphd2 | Shisa3 | Zcchc14 | Klhdc8b |

TABLE 4

PRC2 target genes in the Q1 quartile.

| |
|---|
| Ccdc71 |
| Als2cl |
| 2900079G21Rik |
| Trim71 |
| Scn5a |
| Csrnp1 |
| Kbtbd5 |
| Hhatl |
| Fut4 |
| Olfm2 |
| S1pr5 |
| BC018242 |
| Acp5 |
| Thy1 |
| Abcg4 |
| Pml |
| Skor1 |
| C2cd4b |
| Bcl2l10 |
| Paqr9 |
| Sox14 |
| Tsix |
| Gprasp2 |
| Bex1 |
| AU022751 |
| Arx |

TABLE 5

List of 100 genes with highest ATRX coverage in MEFs, with coverage values shown.

| | |
|---|---|
| Mir715 | 1427.217121 |
| Pisd-ps1 | 321.1430928 |
| Pisd-ps3 | 321.1430928 |
| Dux | 220.4590578 |
| Sfi1 | 111.6833128 |
| Pisd-ps2 | 100.8392507 |
| 4933403O03Rik | 88.03649585 |
| Snord37 | 78.55112237 |
| Eef2 | 45.82187363 |
| Mir1934 | 36.56676001 |
| Gm1995 | 34.14755288 |
| Mir145 | 33.63285725 |
| Mir877 | 32.59314041 |
| H2-t9 | 32.47932573 |
| Mir1982 | 32.40379644 |
| Snora7a | 32.16285132 |
| Mir134 | 32.00243155 |
| Dnase2a | 31.92076681 |
| Bat4 | 31.74818509 |
| Aurkaip1 | 31.46729226 |
| Mir143 | 31.41370728 |
| Scarna17 | 31.2303471 |
| Olfr365 | 30.6681264 |
| Terc | 30.51142834 |
| 4930488L21Rik | 30.38138664 |
| Mir298 | 30.35580191 |

TABLE 5-continued

List of 100 genes with highest ATRX coverage in MEFs, with coverage values shown.

| Gene | Coverage |
|---|---|
| Pard6a | 29.84551403 |
| 1700054O13Rik | 29.52449212 |
| Snord95 | 29.34471052 |
| Mirlet7c-2 | 29.06906983 |
| Gm12597 | 28.73073046 |
| Mir93 | 28.60961314 |
| Olfr462 | 28.56831114 |
| Bat4 | 28.00932619 |
| Mir425 | 27.90401618 |
| Olfr763 | 27.68198477 |
| Rpl12 | 27.58824136 |
| Hspb9 | 27.54512301 |
| Mir1224 | 27.18980525 |
| Snora21 | 26.9340377 |
| Rps4y2 | 26.26254014 |
| Snord88a | 26.18382286 |
| St6galnac1 | 25.92017977 |
| Krtap31-1 | 25.7416135 |
| Mir468 | 25.68406615 |
| Snord1c | 25.5375116 |
| Pard6a | 25.48566693 |
| Snora61 | 25.06915187 |
| Cldn9 | 25.00241027 |
| Snord88c | 24.9854221 |
| Rnasek | 24.96003138 |
| Olfr26 | 24.77737128 |
| Spryd4 | 24.69324204 |
| Ifna14 | 24.48191929 |
| Snordes | 24.05824418 |
| Ndufb7 | 23.9501058 |
| Mir106b | 23.93319632 |
| Snora5c | 23.9055501 |
| Xist | 23.76041272 |
| Olfr100 | 23.69857639 |
| Mir1188 | 23.68868089 |
| 2310011J03Rik | 23.6447976 |
| Olfr140 | 23.64007538 |
| Tnp2 | 23.50529828 |
| Mir135a-1 | 23.42776706 |
| Mir1-2 | 23.34378638 |
| Gm4659 | 23.30237694 |
| Olfr139 | 23.27140709 |
| Olfr933 | 23.22500646 |
| Mir1969 | 23.19153252 |
| Hist1h1t | 23.05395088 |
| Mir138-2 | 23.00525604 |
| Hspa1a | 23.0032577 |
| Olfr978 | 22.94140336 |
| Mir370 | 22.89847339 |
| 1700018L02Rik | 22.733325 |
| Commd5 | 22.27677301 |
| Vmn1r218 | 22.22145048 |
| Ifna5 | 22.18357068 |
| Mir328 | 22.1366194 |
| Nudt8 | 22.00195785 |
| 1700045I19Rik | 21.67868162 |
| Mir1940 | 21.58958981 |
| Dlx6as | 21.49819505 |
| Mir491 | 21.42686978 |
| Ankrd58 | 21.38735791 |
| Hspa1b | 21.13227414 |
| Mir24-1 | 21.07739882 |
| Cited4 | 21.05289999 |
| Sh3bgrl3 | 20.84861008 |
| Ddx28 | 20.80936906 |
| Mir1-2-as | 20.75111717 |
| Mir720 | 20.69910252 |
| Sprr4 | 20.66268889 |
| Rpl36al | 20.66174897 |
| H2-Q8 | 20.64605333 |
| Olfr1342 | 20.64542986 |
| Oxct2a | 20.64440179 |
| Krtap31-2 | 20.62911256 |
| Mir1968 | 20.60677877 |

TABLE 6

Primer sequences and Antibodies used in this study.

ChIP Primers (5' to 3')

| | Forward | Reverse |
|---|---|---|
| Jarid 1C | CGTGCATCGCCGGTCCATCCGGTAA (SEQ ID NO: 8139) | CGCTGCCACCGCCATCTTGGTTTGTC (SEQ ID NO: 8140) |
| URA | CGGTTCTTCCGTGGTTTCTC (SEQ ID NO: 8141) | GGTAAGTCCACCATACACAC (SEQ ID NO: 8142) |
| URF | CTCGACAGCCCAATCTTTGTT (SEQ ID NO: 8143) | ACCAACACTTCCACTTAGCC (SEQ ID NO: 8144) |
| dRE | CCCAATAGGTCCAGAATGTC (SEQ ID NO: 8145) | TTTTGGTCCTTTTAAATCTC (SEQ ID NO: 8146) | qRT PCR Primers (5' to 3')

| | Forward | Reverse |
|---|---|---|
| Tubulin | CTCGCCTCCGCCATCCACCC (SEQ ID NO: 8147) | CTTGCCAGCTCCTGTCTCAC (SEQ ID NO: 8148) |
| Parp12 | CAGAATGACCCTTCACTTTTGCCA (SEQ ID NO: 8149) | GCTTGTGCCAAACTTGCACTCT (SEQ ID NO: 8150) |
| Rnf19b | CGA GTG CAG CGA GCG GCT CAA (SEQ ID NO: 8151) | GCA ACT GGC ACA GCC ATA GGC (SEQ ID NO: 8152) |
| Osbpl11 | GGCCACAGCAGTGACCCCGAACA (SEQ ID NO: 8153) | CCCGGTGACAAGGTTGGTGTA (SEQ ID NO: 8154) |
| Spock2 | AGCAGCAGGCATGCCTAAGCAGCAAGC (SEQ ID NO: 8155) | AGGAAGAGGTCTCCACTAGTGTCCAGC (SEQ ID NO: 8156) |
| Zc3h11a | GACGATTTCTGTGGCTGAGTGG (SEQ ID NO: 8157) | GACGGAATGGGCAGCTGTCACC (SEQ ID NO: 8158) |
| GAPDH | ATGAATACGGCTACAGCAACAGG (SEQ ID NO: 8159) | CTCTTGCTCAGTGTCCTTGCTG (SEQ ID NO: 8160) |

TABLE 6-continued

Primer sequences and Antibodies used in this study.

| | | | |
|---|---|---|---|
| Tsix | GGTAACAATTTTCCCGCCATGTG (SEQ ID NO: 8161) | | GGAAATAAACGGAACGCAGTACC (SEQ ID NO: 8162) |
| Xist Ex 1-3 | GCTGGTTCGTCTATCTTGTGGG (SEQ ID NO: 8163) | | CAGAGTAGCGAGGACTTGAAGAG (SEQ ID NO: 8164) |

Antibodies

| Name | Company | Catalog number |
|---|---|---|
| H3K27me3 | Active Motif | 61017 |
| H3K27me3 | Abcam | 6002 |
| EZH2 | BD Pharmingen | 612667 |
| EZH2 | Cell Signaling | 5246S |
| FLAG-M2 | Sigma | F1804 |
| CTCF | Cell Signaling | 3418 |
| ATRX | Santa Cruz Biotech | sc15408 |
| PARP-1 | BD Pharmingen | 556362 |

Immunoprecipitation Reagents

| Name | Company | Catalog number |
|---|---|---|
| M2 agarose | Sigma | A2220 |
| M2 peptide | Sigma | F3290 |
| HA agarose | Sigma | A2095 |
| HA peptide | Sigma | I2149 |

ATRX shRNAs

| Name | Sequence | Source |
|---|---|---|
| shATRX-1 | CCTTCTAACTACCAGCAGATT (SEQ ID NO: 8165) | BROAD RNAi Consortium |
| shATRX-2 | CCTGTCACTTTCACCTCTCAA (SEQ ID NO: 8166) | BROAD RNAi Consortium |

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (8179 sequences)

SEQ ID NO: 1 - DNA, 1600 bp, mus musculus
acaagtagaccaatggaatagaattgaagatccagaaatgaacccaagtgctgggattaaaggcgtgtgccaccatgcccggctaaatggtttctcaatataaaaaagtatacactgcttactagtgatgcaggtaaggtcctgcttttctgatgattacttggaattgtgcacacatgcatacacacacacatatataatttagcaaaatgattcatgtgaaattttatttcatttgttcaatagtccctttcttaatttctaacagtcttgatcttatcaaacatttgttgacaagtaaatttatttttaatctcttcaaatccacgaatcattttacatattgttagctagagaaagttttaattcacttaggcagtcaatcatattgatttaaaagtgatgcaaagatcactatgcaatctataggttatattctaatttgcatgcatatatatgtatatatgatacataaatattaaatttcaataaagtggcatgaattattctaattattgttgatagtatgtatgcatgtatgtatatatttgtgtgtgtgtgtgtgtgtgtgtatgtgtatgcttgaagaatactatctgctggagttttctgagcattattttaatattatttacttcataatgttttgtgagaaacaagaaaaagcaaaatatttactcttgtcttcctttatctgtgatttgttttgttttgttttttattttttgagacagggtttttctgtgtagccctggctgtcctggaattcactctgaagaacaggctgtactcaaactcagaaatctgcctgcctctgcctcccaagtgctgggattaaaggcatgtgccaccactgtccagctttatctttgaatatccaacatttccaagataatccatgatctctctagggattcattgtaaagcttactctgagttcttccagtattgtgtgcttatctgtttccggaagtctctacacctttgtttccaatgtcttgatcattacttcaatgcaatgatatactaatttaaatatgtcttgatatttcataagcaagctctggtcttctaattattcactgaagcaaattattatggagtatttagatccaaagtactggttcagtaccagttttttcctcttttggcaatgtgattttggctaacttatcagactctgttcctcagtctctttatctgaaaactcactgtcttggtgttttctgtatcagagttttatagataataaaactatcttcttactaaaagattatatctaacaaagaattcttactaagctttatgtgtgtctacagcaaaccaatagccaacatcaaagtaagtggtgagaagcttgaagcaatcccactataatcagggacttgacaaggctgtccactctcgccctacctattcaacattgtacttgaagtcctagccagagcaattagacaacaaaaggagatcaaggggatacaaattggaaaggaagaaggcaaaatatcactttttgcagatgatatgatagtatatataagtgaccctaaaaattccaccagagaactcctaagcctgataaacagattcaatgaagtag

SEQ ID NO: 2 - DNA, 1000 bp, mus musculus
gactgggagagaaaacccacacctatattcttaaagaacttaaaaatatctgataggagaaaaggcagtcactatagcagtagtgtgccaaagtactataatttacagatccacctcaaatcttagacaatgccttttcaacctcattttaaacattgtaaaacagggaagttcaagtcagaaagagtgctcaaaagacaccattaactagaaaaagtagacagtgagcttcaaacattgtatgtgcaaaatcacactatgttaacccaggctacatgtgaacacatctgaaccaaagtgggaccagaaggttccgtcccgatttctgtgacaattcctagcaggatttaacctggagtctgtagagcctgtggagttgagatcagccagttcaaagtgatgacacgtggagagctgacatagcagaaaaatatcataaacttgggatttatttaggaaagactttcagagtcaactcaatccttgcaaacaccatacagtaactttgagtaatgtattgtttagaaagtgtctcctgacagggtcagaagaccccagaagacaatggagcctgtggctacacattgtgccttttgaagtattgtgtttgccgggcaggcaaaaagtattaagtggacgagtatgcctcctgctcctttgctgaaaattcctcttcatgggacccagccctagaccacaggatcccagcaagctttcccatccatcttcacaatttggctgcatatgaaacactatgagggtaaaatttggatgactacaaagtgtcagttccaaagaaagtttcatgtgactcacacaatggctcctgatcatggagccagatccaattagacattccaggaattttgccccaaatctgtgcatgttaaaatgaagagcagcaagggtgatttttatgatcccatagctggacaatgctaccacaatatttctcagtagagtctcaggactacaggctgagagaagtctattgtcctgc

SEQ ID NO: 3 - DNA, 1200 bp, mus musculus
ggtgggcctggaggcctcccagctgatgtcatccacaatagaccaggttactgactctcactgttagccaggagccagctctgagcaccctctggacaaggttgcctctctgtgggggcgaacagatcagatagagctgccaggcccttcttttgtgtcctgtggacagaataagtgggtgggcaattgccctactcccaaacaggccagatctcaccagctctagggtgggtggcctgtggagacctgctttgttgcatctctatagcgtgtaattttaaaagatccctacttgcctggtgactcgcgaggctgccaccagtctctcactctcactcagcttcgctaatggccagttggccattttcccctggagctgtgattgctcccccatcccctcatggctagctttgtcaaactgtcgccaacaactgccccaatggatagaaaacaccagttttattatcttaaaactagacagataactcaatggctgggtgaagaatttcctgccccaatcttatcaactagctccctcaatcttgcctggccttctgcccacagcagaagctataaactctgtgagccccaagacctacatgtctacagcatcctactcgctccaaagcctggttcaaattctgctttcttctttctttcttctgcctgggacctacaacttcaatctttttcccttcacccaacaattagcttctgcctcctttattgacacaatcaagaatcaattagggaaccaatacctctcactccacatctctgggaagagaaccatgtgatctcttggatggatcttactggacagtttgccctgtggcatgtattctctgagggctgcagcagagttgtctagccccagattagttaccacagtgacagagaatgccagaactcattcccaagggcctgagtggggtttgctgtcatatcaagcaggccttgaattggtaactgtggtccacctggctaggacattccctcaggttttgtttgttttaagacaggttctctctacgtaattcttactgttctggaacttatgatgtagaccagatagacctttaactcacagagctcctccatgcctctgcctttacttctgccccctgagcaatgtgattaaaggcaagtgccactacacccagcttaccttgttcttaaagacctgtctggttctaagaa

SEQ ID NO: 4 - DNA, 1200 bp, mus musculus
ttagcaggaaataatttaatgtctcttattttctcatgttttctattttattgaaaatattttattagcatatatgtatacatacttattctgatgtagtttttaaaataatatgcatactgacccccacagcctgaaagtctcccagaagttctgctgcactcaagaaataggtaagagaccctctcaaagaagcacaacagctgggagctctgaggagaacaggggactcaggacacatcctactccctgaactccatccaccgttccagcctgtgccttccatcagggaaaaccaccagattgtctgttcctctaaagaccccacagtctgaaggccttccaggagttatgtagcatacagggcaacaagtaagggatccttccaaacaaccactgaagctgggaaccccaaggagcctggcagactctggaaccatccgttccccgccaccaaacatcacccgcatttccagacttcccctaggtcagctcaccagcgtgtctcctcttctaatgactccacagtctgaagacatccctggagaacagctacacacagaacaactgcttggctgctcagctgaagacccaacaattcgaaagcctcctaggatatgtgctgcacacaggacaacagatcatcagctagtatgctccccataagaccccacagtctggcggcctcccaggagataaactacatgatgggcaaaagatgagaaaggtgtcagcctctctgaagaccctatagtctgaaggcttcacagaagatctgctacagccagggccacagtccttccaggagacctgcagcaacttaggggcacgggaggcaagctccaaacagagacacctaggccagctaacatcagagataacaagatggtgagaggcaagcacaaaactataagcaatagaaaccaatatactttgatatcataagtacccagttctcccaatacagcaagccctgtttatatcaaaacaccttaaaatcaggatgctgatctaaaatcctatctcatgaaggtatcagagtgctttcagggagatataaataatttcctgaaagaatttcaggaaaacacaggtaaagaggtagaatcacttaaagtgaaaacagataaaccccttaaataaatatagaaaaacaagattgaacaggtgaaggaattgaacaaaacagaccccaaacta

SEQ ID NO: 5 - DNA, 1000 bp, mus musculus
gtacctcgctcaaccttcttttcccctatccctgacactatattctaacccccactttttctttcctccacccctgacactattgtaacccccattttccctacccccacaccagacacattattgtatcacctgctagcattctatctaagctctgccccacagttacctggcaacagccaggtatgcctgactcactataaaggggctgcttgcctcctcctctctctcttgctctctcttgctctttcttttgccttcctgctcttgctctctcattcccttcccctctccctttctcctcatgctcatatcccacctttacttctcatctctctgtctctctgactctgtctctgactctgtctctgtctgtctctgtctctctgtctctctgttctgtctctctctctctctctctttctctctctctctctctctgcctctactactgtcttgactcccctcccatgccctgaataaactctattctatactataccattctgtggctggctctcagggggaagggatgcctcagcattggcctgctgaggcactcactctccctatacctcaccacatagccttaaaaacatatcctccctttatctttttataaacacataacccccagtattcccttcccccacccctgaaattctgttgtaccccagccttcacttcccccacacctgacaccctattgtacactgccaatcttctcacccctgacactctattgtactcccccactcttcccttcccccaccgctgacacactattgtatcctcccagtcttcccatcccccaccctgacactgaattgtactctcctactcttcccttcacccaccctgacactcaattgtaccctctcacattccatactctgctttctgctttcttgtcacttttctcttatttgccccctcctcctggcaactctttttcactgtcttgttcctgctttctcatttcacgacctatacgcacata

SEQ ID NO: 6 - DNA, 1400 bp, mus musculus
tgtaaaggaagaagagtgaacacaggactcttaaaatacttcaatgtcagcatgagttagtaagggtagaattgaaaacacaagtagagagaagtgggcatgtcctgaacatacttgggacacataccctagatacacatacccttttgtatctcctaaaagtgcagttaaaaatagatatagctcactctgtgtgctctgggaactatactctagtcctctgtagaggtaaccattcctcttgactgctgagtatctctctctccagtaaccaatatcacatatgtatctactcaccttctgcttcttgcaatgaaataccacttatgtgatttgttgttttccatgttagagattgtccagttaaggctaagttgggttcactagttcatttattacttttgtgttgctgagcccaacatacctcaaataaaatctttcagtacaattattttatactggctgggcattgtaagccagcccgtggcctacatgaaccgggtatttctggaaggcaggctggggctgaaagagacttagactgcgagaaaagataatgaagccaagacaaatgttctgatcaaggcccacgattttactcagaaactgtgcttataaagggggaaggcctatcctccctactccccacctccagtccattcttggtgtctggagccagcctgcaggtgttgtacaggataggatgtgcctccggaatatctcaggggcctctcagcaggtagcagtaccttggaggagagcagcggcacgtgacagaacaatagagccatataggtcggaaggctccaccataggtaatctccttcttagtggcagcaaggtcaaagtctggatcagcctgcttcaaggctgagggaggctacagctggtaagagtttcagtccactacgttgtgtaggcatggcagtaagtgtgtgtggagaggctgaaatcaaggtctggactcacttaaagcttcaaaggtccacccctgagtacctcaactcacctaacactaagagccaagagaaaaaaaataaaacaaaacactgaaaatcagtcagtggggaacattctagattaggaccagaacatgtaccctttcctgtcctgaatgtacatcagccattttattcaagggtagcactctcttcatactacccttctttgctttcagtggctaataatatttccatggtgcctctatgtacgactttagccttatggagacctcccttgaaagctgctgttattcattttaatggaagtttttttttaatcttttttctgtttttcttttattgaaaaattgatttttcatacaatatattctgactatggattcttctctcccaaattctccaagatcttcctcccttgccctcccatcccatccaaat

SEQ ID NO: 7 - DNA, 1400 bp, mus musculus
ccagtgtcaagtcgtaacatttgggcttactttggaatgatcttctatattgaaagaaggatataataatacaatcatgagaaaatgcattgggagagaaaatttggtgtgatatgattaccttggaatggaactagccatgagaagaaaaaagtattttaacttaattttaatctgctaaaaaattcataacctatttaaaaattcttaaactattgagaaactttattgggtgttttcatctttaatgtagttatcactaggaattttaaataactaccatatgtcagttatccaaatattttttctcttacatattttattaagttctaacttttaccactacaggggtttattcttttgtgtcaaaaagtgtttctggccgggcatggtggcgcacgcctttaatcccagcactcgggaggcaggggaaggcggatttctgactttgaggccagcctggtctacatagtgagttccaggacagccagggctacacagagaaaccctgcctcgaaaaaccaaaaaaaaaaaaaaaaatgtgtttctgtttctggttttaaatacttgaagttgacagcttacccttttgtgattctgcctgtctggttttgatataggtaggagactttgtgatggtttgaagaagaactgtcccccagaggttccatccctagttgctggtgctatctgaaggttacatcgaggggcaggctagccgcaagaagtacatcactgtggtcaggccatgagagttcacagccttgctccactcccagtttgctttcactgcttcaagctgtggttgagttgtgacctctcagcttccagccaccaagcccactgattgcttcaatgccttctcagcaagatgtgactctgtttgtttgtttgtttgtttgtttgtttgtttgtttgagacagggtctctctacatagcttgcctgaccaggctagcctcaaactcacaaagattagcctgcctctgcctcccaagtgctaggattacagatgtgtgccactatgcttcaatagactcttaaccatctagaatagtaagtcaaagtaagctctttttttttctataaattgattttggttgctgttgtatcacagcaacaaaaaagcaaccaatgcagagatgtgtaacaaaaatactgcaatttctaacatccattcttgcagatttaccctaacttcaggtttgatatttatttcatctgctttattttggggaaaaaaatccattccatgtttaattaattgtgtcataaataacagaattttgccagcttttgcagtaggtcttaagttactttttagaaataaatgtatggggctggagagatggctcagtggttaagagcactgactgctcttctgaaggtcctgagttcaat

SEQ ID NO: 8 - DNA, 1000 bp, mus musculus
ataatacatgcaaaggatctcagtttgatccttggtgtggaaggtggttgtgttagttagggtttccattgctatgaagagacaccatggccaaggcaactcttataagggacaacatttaattggggctggcttataggttcagaggttcaatgaccaggcagacaaagtgagggagaagaagccaggagttctacatcttgaactgaaggcaggcaggtagaagactgacttccaggctgctaaaaggagagtctcaaagcccaaccccaaagtgacatacttcctccaaaaaggccacacttcctaatagtaccactccctgggccaagcatattcaaacaaccacagtggcagaggagggaatcaattaccataacttggtctctgcctctcacatgtgttctgaccctccagaaaatgaataagtaaacaaacaaacaacaaacaaagatgcaacaaaaatatttttaaaaagatttgataggttggactaataaaattaaactcttatgtttcaaaggacatcacagagagtgtgaaaaacagcctacaggtaggggaattattcagaagtcatatgtcaggtaaagaatttgtacatagaatatagaaagatctacatgggaacttcatgggttccttgtagtctgggcaggtgccctgatcagaccttgggcatgaactccaaattaagtcccacaacacccagaagaagctcgacccccaggtgctctaacacacccaggatcataagatcagagatgccctaagcaggccttgggcatgaactccgcagccagtcccacaacacctaaaagaagctccactcccaggcgctctaacatgtccaggaccataggatcctacgagcttggtcactccaggatctcagggtcccagaggcaacttggctctcaggagctctgacacaccaggatctcaggatcacaggatcccagaatcacaggatcacagagacagcttgactctgaggagt

SEQ ID NO: 9 - DNA, 1000 bp, mus musculus; identical to SEQ ID NO: 8

SEQ ID NO: 10 - DNA, 1200 bp, mus musculus
atacctatgtaacattaatttttaaaccttatttattttattttgtaaagatttatttattttttatttatgagtacactgcagctgtcttcagacacacctgaagagggcatcggatcccattacagatggttgtgagccaccgtgtggttgctgggaattgaacttaggacctctggcagagcagccagtgctcttaactgctgagccatctctccagccctaaaccttatttttaatgatggttcactttaatctcccttgtagcccaccacccagcagaggtggtgagaaaaaagaatacgagggaagtggacctgcttagaaaggttctttggagcagcttccagctatgttgtctggaaattggcagtttagttcacaggttagcaggcagcagcagcttgatccacttgcaatcacttcaaaggtacaccagcagtccttcagtagagctgggttagcaacagccttgacctgacctagcaaagacagctaggcctcagcctctgcttgagtcagcaggagggaccatccaggagactgctctcagctgtgccttctcagggaagcaaagatgggaggttcacaagtgttacacaactagttgtaccagcaagctaactgtctctgtcattcggtggactcctatttataccctccaaacatcacatgtccttgatgtgccttgcctcagcatgggtcttgcctcaccatgtacattcaatccctgagtctgcagaagtggcaagagactgcagcacaccaccagaagttttttggtgcatttctctctatggattcctgaaaaatgcagctcaactatgcagtgtaaggtggaccaatacatgcaagttgttagcaaagaatccttcatcatatgtcctttcatctgcttgctttagcagaacatcctgtctcttgtgtctgctttagcaaaatgttccttcatgagtctgctttagccttttacacctgtgtccactttaatgaaatgttccttcacatgttagctccagcaaaacaccatcctactgactttccaaagaaccatcaagtttctacttaatagctatatccaaagtggaattttaagtaatggggttatgcaaattttacaatgaatcgccagtcagttttctaagccactttatgactcttcaacaaggtatgagaattccatttgttctagtttcttga

SEQ ID NO: 11 - DNA, 1600 bp, mus musculus
cacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaaaaaaaaaaaaaaaaagaagctgggtcaatgccatttttactttcactttagatgtagttgaacccatatcgtttaaattccctctgtctctatatctaagattcttaatgcttcgtccctttttttccaggaacctgacaggcctgtgctttctttacttacctttgcttaacaacacaatgagttccccgtatgggccaccaattgccacagtctctgcttgctgcagtctccaacctgcagagacaagaatgacatggacaccaagacaggttcacacagcttccttctttacttggggcaagggctattcttacacagtagcagcaacagaattcatctcgctccatgccacctcatccaatcagaatcacacatgctccatgcatgaattgggcaggagttcaggtcggtcacaggctgacatgtctggatcatgaagaataatctaacttggcaggcagattacgcatgcagtttcactgggcatgttcgggcaaggcagtaaatatgtggggttcatggagcctggcaatgggccagagtgccatcttggcccatgtggccgcttctgtttcctcagagtgaaagactggaaaacaatactccaagcaaaaggtccgaagaaacaagctggagtagccattctaatatcgaataaaattgacttccaacccaaagttatcaaaaaaagacaaggaggggcacttcatactcatcaaaggtaaaatctaccaagatgaactctcaattctaaatatctatgctctaaatacaagggtagccacattcttttagtaaagctcaacgcacacattgcacctcacacagtaatagtgggagacttcaacaccccactctcaccaatggacaggtcctggaaacagaaactaaacagagacacatggatactaacagaagttatgaaacaaatggatttagttgatatctacagaacattttatcctaaaacaaaaggatataccttcttatcagcgccacatggtacctcttccaaaattgaccatataattggtcacaaaacaggcctccacagatacaaaattattgaaattatccaatgcatcctatctgatcaccacagattaaggctgatcttcaataacaacataaataatagaaagccaacattcacggggaaactgaactatactcaatgattccttggtcaaggatgaaataaagaaagaaattaaagactttttagagtttaatgaaaatgaagccacaacatacccaaacttatg

SEQ ID NO: 12 - DNA, 1400 bp, mus musculus
cagcttctactaaattgtgccactgctgatgatttgtgtttggtatcctgatactcctgaactggactgctggagtcctgacaatagagattgaaatcacgccaaagaactacttctaaacagattcagatccacatcctcttgtcttatttaccatcttttgtcccctacctttggacggtaggctagaagggggccaaagcatttaagaatcctttgtaaagtggggtttaaaaaacctaagcctacagaccaccatagattagaactttatatcaacaacaatagaaagttcacaagtacatggaaactcaaaagcaaattaaaaataagttaaaagagaaattaaggaattttaaacttttttgaattgaattaaaatgaaaagaacaacatccaagcttttaggacacaatgaaagtggttccacgaataccaaagtgtagacactttgccccttcttagaattgggaacaaaacacccatggaaggagttaaagagacagagacaaagtttggagctgagacaaatggatgaaccatctagagactgccatacccggggatccatcctataatcagcctccaaaccctgacaccattgcacacactagcaagattttgctgaaaggaccctgatatagctgtctcttgtgaggctatgccggggcctagcaaacacagacgtggatgcccacagtcagctattggatggatcacagggcccccagtggaggagctagggaatgtacccaaggagctaaagggatctgcaaccctataggtggaacaacaatatgaactaaccagtacctcctgagctcgtgtctctagctgcatatgtatcagaagatggcctaatcggccatcaatggaaagagaggcccattggtcttgcaaacttcatatgcctcagtacaggggaatgctaaggccaagagatgggagtgggtgggtagggaagttggggggggagggtacgggggacttttgggatagcattggaaatgtaaatgaagaaaatacctaattttttaaaaagtggttctaagaggcaaggtagttagcactaagtatctacattaaatatatatatatatacacacacacacacacacacacattgatgagagtaacatgctagtaacataacaccaacatctagaagaaataacatctaaaaggattagatggcaagaaataatcaaacccagggatgaaatcaataaaatacacacacacaaaatcaaaaatcaatgaaacaaagatgtcgttctctgagaaattgataggacggacaatttcttagtcaaattcactaaatgaaagagagataaaatccaaattaataaaattagggatgaagggagacataacaacatgctccctggaaatccagt

SEQ ID NO: 13 - DNA, 1000 bp, mus musculus
ttcctttctttcgcctttgattgtgtttttctgtaactctttaagggacttttttctttcctctttaagggattctagttgtttacctgtgttttcctgtatttctttaaggaagttatttatgaccttcttaaagtcctctatcatcatcatgagaagtgatattagatctgattcttgcttttcccatgtgatggtgtatccaggacttgccatggtttgagaattgggttctgatgatgccaagtttctgttgtttgtgttcttatgcttgcctcccactatctgattatctctagtgttacctgccctgattatgtgtgactggagcctgtccttcctgtgatcctggttgtgtcagaactcctcagagttcagctgtttctgtgatcctgtgattctgggatctggtgatcctgaattcctgggtatgtcagatctcctagaagtcaagctgcatgtgggatcctgagatccttggtgtgaccaagttcctgggatcctgagatcctgagattctgtgatcctgtggtcctgtacatgttagagtgctttggggtaatgggactggctgtcgagttagcccccaaggtctccacacggaacctctgatcctatgattctggatgtattagatatcctgggagtggagcttccactgggtgttttggtactggctgtggagttcatgtctgcggtctactcaggttacctgctcagacttgaagaaacctgtgccattggttgggtggagttaatggacctgggtgcctgggtcccattaattaagtgagttaattccagtgttgggacagatgttgtgtgctcctcacctctgatcctatgatcctgggagtgttaaagatcctgtgagtggatcttgctctgggggttgtgggactggttatggagtttgtgcccaaggtctgttctggacactggctcagactggaaggaaactgtgccactgtttgtgtggagttcccattttcacaatctt

SEQ ID NO: 14 - DNA, 1000 bp, mus musculus
cagttgtattgtactttcctcttatcagactccctgcctgggtatgtgtgggagatggaaactagtgccttcttttttattgtgttttgttttgttttgttttgttttgttttgttttgttttgttttgttttgttttgttttgttttttgagacaggatttctctgtatagccctggctcctggaactcactttgtagaccaggctggcctcgaactcagaattctgcctgcctctgcctcctgagtgctgggattaaaggcatgtgccatagtgccttctttaaactgctagttgtgacaaccttaaacagacagcagacagcacatgctgaactatgtgcagacccaagatgagcattgaattatgggacatagtcacatccaagacaccctcaattataccatttcttatttttgcctcaattcctgggagttgttccaatatagcctctggtcatgttctctgttcagcaaagtgtaaggaaaacattgtgtgatctctggaattgctgcctgctttacagtgttcaagtagtttatttggacggtttttctttttctcacctccttaaaagtcagagtcagcatcaagcatgcagagcactgctttgttgtcactttcaatcctcggatagtcagtgttggccaacaagcttgcatactttgctcaggctgccttgaccctgccctttctcatccatcctgccttcactgttgttccaaatgctaacaatttagctgtggagacacttactgaaaacacattaatgaaactagtacaaactgcggaagactgtctaagagactctgtggcttgtcaaattatggctagaaggcaacctgaactcaaattacctagaaaatgcatagaaaatgtggtaacttttctaaattatatcataccaggcctgtgttgtctccgaagaaaaccagcttatgactgattgatcttaatctctctctctctctctctctctctctctctctccctccctccc

SEQ ID NO: 15 - DNA, 1000 bp, mus musculus
agaggggattatatttgaccagggtaaggggtaactccagcttaaattaggagtgagtgttcatgtctggaggggagaggggccttctgtgggagatttaggtgacacagctctatatgatgaaggcttcaccccacagcaggtcttgatgagagagacagtccttgcttgtccaaacagtttattctttgttcatcgtgggaaatgggtgcatactatttactcagataaatatttatgtggggtgtcatgaccacatgctccaggataggaactggggagagcgggaactgggtcgggagtagatgaaatgccttccattttcagatatgagaaccagggtttctgaatctgctcaaccttcccagtttttgtctggtgacacagttccacttgccccacagagaaacttgaacttccttcccatttacatcccaggacatgaccatcagtgctccaccaccacacacctgacacaataacaaaaaagaaaggcattacacatgtactccatgtctggccttagtgggagagaacccagactgaaaacaagcaaatgacccagagatcatttcctggccccatggagaggcagagtggcaaagcaaatgcatctgcagtatataacacacaaactcattagagttcattttaaagaattggttacatgattttgttttctatatttagctggccttggaattccctggcttgagaaatcagatgggtgaacttcatttttcctcctgtcctccagttgcaatgttccagtcttatccttagccctgtagcatcacatgtgctgtcgctttccctccttctgtgcccccattcctaggggaacctgcaggtcttttatgcattcactattctttcccaacacccttcctttgcctcagggtctaacacccagaggcactctctgccttgagctctgcttgtctgcggatcaggtagtatatcttcattcttctttctgtctccccagttccaattcacc

SEQ ID NO: 16 - DNA, 1200 bp, mus musculus
atggttgatttgggtctggaatagtcagccagctacaggtaaagggttgacatacttatcatcagggatcatagattaagggaagtgaccaacactattgagacaatggacctatgagctgtattatactttagattgaactgtctcatgtgttgaaagcttatttcccactcatgccttaccaccatagcattcctcaatactggaacatcagtccttcacaggaacaagagcctcttctcccattgatgccagaaaaggccatcctctgctacaactgcagctggaagcgtgggttcctccatgtgtattctttggttgttggtttggtccctgggagctctggggaaaaaggggttgtcctggttggttaatattgttcttcctatagggttgcaaagcccttcttctttagttcttctcctacttcctccattgaggtccctgtgcttagtccgatggttggctgcaaccctccacatttctatctgaaagtctctggtagagcctctcaggagacatccatataaggctcctgtcagaaagcacttcttagaaaccaggaaagaggttgacatttgaaatgttaataaataaagtaaccaataaagattaaaataaaaaggaatctgcatcccattaaaaaaaacaacaaccacaaaaaaaagaagcttagttcccagtgtatcaatatttaaagttaccaatattaaaaaaggggtatgatcacatgtgctctgatttcattagatttgttttcagaattttgaaaatttaatgtttcattagatgttggtggctgtatgtgggaactaaaggggggtgggggaaatagggaagggaagatagcccacatccggccagaattcctcctgtgctctgggccagtggacatggaagggctgccagacactttccacacttggcgcctggtgggcatctcagccactgaccccactcggtggggagggggtggacaaggggcagccccagaaaccaggggccctggggcaacaaccttggcaccagggttatgggagagagggaagtgggagagagattgctatgcaggtgacagtcctaagttgttgggagccgcgcccacattcgccgttacaagatggcgctgacagctgtgttctaagtggtaaacaaataatctgcgcatgtgccgaggctggttctccactccatgtgctc

SEQ ID NO: 17 - DNA, 1000 bp, mus musculus
ctctcatttgccgattctttggaccacccagtcctgctggcacagagggcagccattattctgtttcacccacaaggacatgcagcaggtgtggaaggagtggttacactctcctctccccagaccacgacacagtcctcttgcttgtttttagcttgacatctaagataggcatccatcacctggaccctgcagatggcataggtatcacactcaaggtcccagctccacatggctaccgcattccacttcttgagggagaacatcttgtagcctcccaactcggagcctgcgctcccggagaagaaaggacgcagggttcctcgccgtcctccataacggccatggcggcagtgcagaacccatcgtttttaaatagggttaattgattctctggagtctaacttcttgagttctttgtatatatttgatattagttagcctatgtaatgatttatgtataaaaatatttatctaatctataaactataattagccttacattagctacatttatttttacctttaatacaagattaaaataaacaagccaattactaatacttaaacatattgggttttggtattgaaagtatatatatatatgtgtgtgtgtgtgtgtgtgtgtgtgtgtgtgtgtgcgcgcgtgtatgtgtgtgtaataaatattatatgtatattttgtattaaaatttgagttactcttggcacaaataaaaatacaaataaaagtgcaaaggcagtctctctaactaatatcaaatatatacaaagaactcaagaagttagactccagagaatcaattaaccctatttaaaaacgatgggttctgcactgccgccatggccgttatggaggacggcgaggaaccctgcgtcctttcttctccgggagcgcaggctccgagttgggaggctacaagatgttctccctcaagaagtggaatgcggtagccatgtggagtgggaccttgagtgtgatacctatgccatctgcagg

SEQ ID NO: 18 - DNA, 1000 bp, mus musculus
tattcagttcttccaaaataaaatatcaactaaaataattttaaaatatttggtgaagaagtttgatttcctctcagaaaatgtattaactgaaactagacttgacatctcagtagatacagtgtaattggacttcccatttcaaagcatgatacaactcaaaggtaatgaagaccattgatacctatgggaagatacataaagaatatgactttatgactgtggtttgaatacagtgtttccctacagacttgtttttgaatgtttgaaccttagtagatggcacaatagtagaggttctagaaaccttgccagcaagattttgatgaaggaaccctgttatagctgtccctgtactggggcatataaagtttgtaagaccaaggggcctctcttcccaatgatggccaactgggccatcttctgctacatatgcagctagaaacacaagctctggggttactggttagttcatattgttgttccacctatagggtagcagaccccttcagcttcttgggtactctctctagctcctcatttggaggccctgtgttccatcctatagatgactgtgagcatccacttctgtatttgccaggcactggcataccctcacaagagacagctatatcaggatcctttcagcaaaatcctgctggcatatgcaatagtgtttgcgtttggtggctgattatgggatggatccccaggtggggcagttctttatggtctatcctttggtctcagctccaaactttgtacctgtaactccttccatgggtattttgttccctattctaaggaggaatgaagtatccatgcattggtcttcctttttcttgaaccttattcttatgataaagccacaaaggtaattcactaaaaaaaggattatgtttttagctaatgctaatatagtatttgtctgaggggaaggaccaggtccagctcctaacctttgctactacaatatgttatggtctatttcccttgatgc

SEQ ID NO: 19 - DNA, 1000 bp, mus musculus
acattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaagaaaatacccaataaaaataaattaattaataggaaaaaaatcttattcacagaaacaaaggagcagcctgggataggagtcttacagtttccctctatgcctggacctgatcctctgccacagggatccacacccaaatagtcctgggagagagctaccctcccaggagtgcagacaagcctgtgagcacaggtaagaccaccacttctgcttaaagggacctactcacccagaaccctcaggatacaggaactgaggagcaacttgtgacaagagcattccagtttctgtccacacccagaactgatcctatgtcacagtgctccatacccaaacccaattaccaccaggagaggacttgtctctcaagagtgccaacatatctgtgaacacaggtaagcccaccagttctgttcaagttcctgagccaggaggaaccctcccagagccatcaggacacaggaaccaaggataagatcatactggattttatctgcaccccagagctgacaacgtgccacatgtctccatacctaaatacaacccagagagaactggtttcccatgagtactgacacacaggcttgcaggaaggaaaagccaaagtcaaagacagcatgactagctaacaccagagaaaaacagatgtcaaaaagcaagggcaagaacacaagcaacaggaacaaaggttacttggcatcatcagaacccagttctcccaccacaatgagccctggata

SEQ ID NO: 20 - DNA, 1000 bp, mus musculus
ggaaataagggggaagtatcagatactggaggggacagcagaaaggtacagagggtcaagaaattgaataaaaatatgtagcagtggaggatgaggaactaggggtagcaactggaggattgcagacaccagaggaagagagatgctcccaggactcaaggaggatgactttatgtgcagagatggggagatagaacctgtagagaccacctccagtagataggcatggcttccaggtgaaggatggggccacccacatatctcaaaggttttaacccagaaatgtttctgtccaaaggaaagacagggacacaaaatggagcagagatagatggaatggccatccaggaacagccctacctagggatccatcccatctgcagacactaagccccaacactattactgttgccaagaagcacttgctgacataaacctggtgtggctgttctttgggaggttctgctagcaactgaccaatgcagatgtggatgcttggggccaaccatcagattgagctcagggaccctggtggggaagctggtggaaggactgtaggagcagagggggactgcaacactagaggaagaacatagctggcctgaccacccagtgctcccagggactagaccaccaactaaggagtgtagagggagggatccgtggttccagatacatatgtagcagaggctggccttgtctgacattaatgggacgggaggcctttggacctgtggagacttgatgccccagcatagggggatgctggagagatggggccagagagggtgggtaggtgggggagcaccctcatagaggcaaagagaggggggagaaggcagatgggaatggggaggggtgttgtggagaggtaaccgggaagtggaatatcatttgcgatataaacgaatggaatggttgagaaaaagaaaaggaaaggaaaggaaaggaaaggaaaggaaaggaaaggaaaggaaaggaaaggaaaggaaaggaaagg

SEQ ID NO: 21 - DNA, 1200 bp, mus musculus
caaagatcttcacaggtctccaaagaaaatgatgggacactcagactctatttggatgtgataacactagccatgggccatatccactgcaaatgcattgcctgttgccaggacctggcccaaactgtggataagcaggacattacagagttgattgccccactttgcatagatgaagtaaggtcagtcccacaagttcctcctctgttgggcattgggctatacacagacagtctggtctccagttgagctgagatgttgaacccggagatctggtggtgttaattcacctacatgggatggaaggagttctctcatgtctcctggactctgggtcctgtcgaagttaccaccccctcagcccccagaagagaagcatggctagcagtcaagaagacaatgtcccaagcttctggccttcaggctaaactcctcctcagttacctagcaacggtagagataacagcacactataaggagggctgcttggccccctcctcactctcttactcctctttctccccttactctcttctatcatctcctctctcctttcactctcttcctctctctctccctcttactctctagcctttcttttctctctcgtccccccccccccatctcttctcttggccatggctggtctctctctctctcttctaccttttctctttccccctgcctttctacaataaagcttgaaaatcatagactgtctctgttcatcaaggccagctatgcttactctcgcctgtgtaggaacctttctccctctgccctctcccggggctacagggtatcatcccaggggtccccagttggggtctgcacctgtccaccccctgtcgagtggggtcagtggcttagatgcccactggggccaaatggatctgcctgcccagagcataggaggaactctggccagatgtggactatcctcccttccccctccccccaccccccatctcctctcaccccccccctctttagttcacacactcctccagaagaaagcctctcagaacttctgggcctgggattgaagactcactgccttagggcctataaccacaacaaacccatggagaccacaggagtctgctgttgtgactgtcaagtaatgggcaactctctgtcattttaactttttctttttctttcttttttttttttttctctcttttcttttttcagaga

SEQ ID NO: 22 - DNA, 1400 bp, mus musculus
attttcattattttatttctcagtatgcaaataaatatgacttatcaattggtattatttgagtctgacttaaaattattggccaccacctcctgtagccagacaggtaccccagtggagtgatagagacatcaatcctcctataaaacttttaacccaaaagttatctcatctacaagaaatgcaagcatgggggatggagcagagactgagggaatggccaaccaataaccagcccaaattgagacccatcccatgggcaagcaccaatgcctaacactgttaatgatactctactatgcttgcacacaggagcaagttgtcctctaacaggtttcacccagcaactgactcagacagatgcagacacccacagccaaacagtggatagagtttggggactcttatggaagaataggaggtaggatttcaggtccctagggggataggaactctacaaaaagaccaacaaagtcaactaacctggatctctgggactctcagagtctgaaccaccaaccaaagaacatatatgagctaaacccaggcctccctgctcatatgtagcagatgtgcagcttggcctccatgtggatctggaacactggaaaaggggctatctcaaaagctgttgcctgtacatgggatttgttctggtagctgggctgccttgtctgacctcagtgggggaggaagtgccaagacttgcagagacttgaaatgtcaaggtgggggatactcatgggtccctgactcgctcagaggagaaggggatgcgggatggggaggggagggattgtgactgaggtgaccgggaggggggcagtgaattagtaaaaaaaaaaaaaaatttaaaatttaaaaaatgattggccacgttggatgtgagaatgtgtgccggtggacctttaggtgggatagcatacacctgaaacgccactccccacaaggcaaccagggatcctgttctaaacaacgataaagcaacaaaaatagacattgaatgaaagaagtaaaagggaagagttaaaggacaaaaataaaggagaagagaggaaaagaaacgaagactgtaaacacattaggagacagacaccaggagatcacagtatctcctggctgcactcggctgcatgtggggtgcatgcctgccttggctgtagagctgtggccagggaggggaatcagaacaaaaagctatctaaagtagataacgcctgggataagttgggcatgactgagctttatctagttgggagtccgggagttgagggcattttaggaagaatagatcattttaccaaagcaggacatgagtgagattaaagggaataaggccagtataacaagctatgaaagggttttctctttatatgccccagtacaggggaatgccaggg

SEQ ID NO: 23 - DNA, 1000 bp, mus musculus
ctagagttacaggtttgtttacttggttttcttggcaagggagggagaatgaaaagaatgacattgaagagtccatatgctcttctcatgctccgcgcatggagttatgacagacgacaatgctttcacttacgtcacacatctctaatttacttatgagctaaacactaattcattctaagttgagccacgtcactgtgatttattgtcacatgccacaataagcatgttttgctctcttgtcccttctgcaggaagggctgtgttgagttgggcattgtttgtatagtgctggacacagctgcagggtgtttttacgtgttcaatgaagtaattctgttctcagaaagctcagacaagtacagtatcaaaacagaaagtgtgtgcccaaacactgctttcctggcccctgcaaccccgaaggaagattaatggttgtttggattggaagttgtaccctaatgaagcatgttacccctggggaaaggggtctgagtaggataactgttcacctccaggtcaacactgcacaggctatgattcctgatgcctgcaaccccaacccagacagctgccattaagtgcctggtcctctgggagccattggcacacaaggccattcccatcaaaatggcctggggaagaaggtctcctaagcacagccacagtgaatggaggggaattaggtcttgaggccccagctgaattgatggcagctgctttgggagggcctggtttcttctgctattattcctctgcttttcaacaccactcactctcagattaaatgcagtgtcccttcaaatagcaatgagtgcttgagacgtcccatgtggcgtccctcaggaggctacacccaggacagctaacttcaatcctccattctttatggctttaaatattgaattttaattactttccaatccgtagatttttttttataccttggaaactaaaatactcaagagaaaaggaaaacagcctagaatcccattaccca

SEQ ID NO: 24 - DNA, 1400 bp, mus musculus
ccaataaacacctgaaacatagtttaaggggtggaagatgaaatggctagataggcttgttctttagtttctgagtgaccattcccttggagctaattgtatactactcataatacttggcagtgtcttgtttccttcaacttgagcaattgttcattaccagccttctggacatacactacctttaactgcctggacttcgggtcatcaactcaaacttggtatggttacaaaatggattactgaagaaaaatatttacagtattacttcagtattcagtgaacactgcaaatagaactgaatagctttaagttacagttatgttacttctagggctaaaaaaccatttttacttgagatcacaagctattgtgctgccctgacatagcacagtggtatcacaatggtaaaaatgcatctacactcacataaaatacacaaataatgtttaaaacaaactctctcaaaatttaccccaaaccactaataatctcattcaactgatttgaaatatgttcaagaattctgatgaattctcaaacctgttttttgtttggttgtttgtctgtattttctatcaagggagaacccaaacttttctttatacccaattaagtttctaaccctaaataccactacggtcactagagacaatgaagtattgtcagagattaagtccatcttctaacattcacatgtgcataatttacacgaaattcaagtatttaatagagagataaaattagtctctagccaggcatggtatagtatgccttctagtcccaacacttgggagacggaggcaggcagatctctttttaaggccagcctggtctatagagtgggctccaggccagccaaggctacatagtagtaagaccatgtctggaaaaaacaaaacttgtttctgatactcctactttgagatcctgccagttattaacttaaaataccaagccacagaagagcatctgttaaagcagggtgattatataatttatttgacacagtacattttctgcttattgagcagtttttgtgtacttaaaccaggaaaaaaaattgagaagagtatctcagtggctgactaagccaaaataatagtggttagtggaggggttgggggggcattaaagcacagctaattgttaagaatttggctatcttacttcatgcaaaattagtatatgaaagttatatattttcctggaactttaatataaatgaatgagataaaatatttcaaagtatgatgtgataaacactaacccaggtgtgtgtggtggtgtacattatcttaaactcagctccactttaaaaacatctagattctcccttccttccacattcaacaaagtggactttcagtatgtagactcacttaaagatactatcacag

SEQ ID NO: 25 - DNA, 1000 bp, mus musculus
aacagacaatttgttactgttgctcattaggatgaggatatctaggcaaggatgatgcaccctgaaattagggtagggtatacagtgagtattttctatatcaccatattctagcaatgacagtcagcaggagtgtgataacaactggtcagcattgtttccctacatatggacagagacaaacactggaaaggatgtctgatactggctgaacttggagtggtggagcttctgaagtatcttacctaagtctaagtggtagactaggcatgctagtccaggagcaacacaaacctacaaatcctcatgtgaggtgaggctcatcactccccctgatacccattttcagctctaacagtggtatacccctatgtacagagtaaggcaaggtaacaatagggaaccatactgcttgttccatgttcaacagatggtaaggtactcatgtacttgcccatgagtgaaagtaccaacaagaaaacatgacatgtgctggagatgcatggtcaactgaacacacccccagtcctagcagtgttagaatccttcatgcaactgtccacactctagatcctagagcataactatgttcacctttcttttgttgagtatagaacccttcagtctttagtgtgctaaaacacctcttccttctaatatgcagcacggcatgggcatggacgcttgaataacaatatctctattgagctgagttggattgtgaagctacaatcctctgcatactgtggcagactgtttctgggattacaggaatggagactcacagatttctaactctcaagagaacatgaatttggacaaaagttgcttctcaatatgttggcttatggcagaatttaggtttcagagaatggcaaaaggacagtgtaagttcttactccaatgcaatgttaccatacctccttgctaaccccaactggattacaactctatggcaaatgtgaaatttcccagtagccaagatcatcgctgccccacc

SEQ ID NO: 26 - DNA, 1000 bp, mus musculus
aggttttctatctccagcattgactcactttgggttttctttattgtgtctacttccctttttatgtcttggatggttttattcaatcccattacctgtttggtcatgttttcctgcaattctttaaggaatttttgtgtttcctttttaaggtcttctacctgtttagctgtgttctgtatttctttaagtgagttattaaagttcttcttgatgtcctctatgcttttaaacccgggtcttgctttttgggtgtgttggggtgcccaggaccaggttgggtggtagtgctgcgttctgatgatggtgagtggtcttgatttctgttagtaggatccttatgtttgcctttcaccatctggtaatctctgatgctagttatagttgtctctggttagagcttgttcctcaggtgactctgttagcctctatcagcagaccagagagactagctctctccttagtttcagtggtcagagttttctctgcaggcaagctctcttcttgcagggaaggtgcccagatatctggtgtttgaacccgcctctgggcagaagttgtgttccactcaccagaggtcttaggatcctgtgggggatcctgtgtgggtccttgcgggtgtctggataatctgtgtgcaaggcacactggtgctggattggaccggaagggacttgtgcccctgatcaggctgggttatctgcttccctagtaaatgcatctcaggtcccgcacgattggattggatcatacgctgtgttccactcaccagaggtcttaggatccaatgggggattctgtgtgggtccttgcaggtgtcttgagactcgcgggcaaggcaccccagtgctggagtggaccgaaagggacttgtgctgagtgtctattaacttattgctccaagagcatcatagatcctccaatcagctgcaatatgatttttttaaaaattacttagtaatgttagtactacctgtgagtatatgtgtatggaggaatc

SEQ ID NO: 27 - DNA, 1000 bp, mus musculus
ttctgactggtgtgaggtggaatctcagggttgttttgatttgcatttccctgatgattaaggatgttgaacattttttcaggtgtttctctgccattcggtattcctcaggtgagaattctttgttcagttctgagccccattttttaatggggttatttgattttctgaagtccaccttcttgagttctttatatatgttggatattagtcccctatctgagaccatgttctgtatcaccctttcaatatatgcatcttaaaactgacagtgtgttgaccatttgacaagcaatcctgattgctcactgtagtgttttctgttcccttctctatccttttagcactgagaaataaacccagagcctcacacatgtgcacgtgctaggaaagtgcttcaacataaagctatatctgctgtatccactttggcaacttttatgccagatttctcagtcatatttttccagaatggcaatgaggtgggaggctgtatactatcttctgaataaatacaggtgtactggctggtttcgggtgtcaacttgacacagctggagttatagagaaaggagcttcagttggggaaatgcctccacgagatccagctgtaaggcattttctcaattagtgatcaagggggaaaggccccttgtgggtgggaccatctctgggctggtagtcttgggttctataagaaagcagtctgaaaaagccagtaaagaatatccctccatggcctctgcatcagctcctgctttctgacctgcctgagatccagtcctgacttccttggtgatgaacagcagtatggaagtgtaagctgaataaaccctttcctccccaacttgcttcttggtcatgatgtttgtgcaggaatagaaaccctgactaagataacaggtgacacttaatttcacaatgatacctatgtaactagctcctatactattcaagaaggcaaatcatgtgaccattcagcccatgaatgctttctata

SEQ ID NO: 28 - DNA, 1000 bp, mus musculus
tggcgttcccctgtactggggcatataaagtttgcctgaccaatgggcctctctttccagtgatggccgactaggccatcttttgatacatatgcagctagagtcaagagctctggggtactttaatctgcactttcatccagagcccaaagatgggccctctcatactcttgccttttttacttttacaaagttgaatgctttatattttcttaaactcaattagataaagatattttcatgcaatggtgttgtgtacttagaacatatctcctcatttcccatccttggccagtccagattgtctttgtggccatccacacctttccatcctcggtgccaacccctgggattcaagtttttacaaccagaaacactcagtgcttgggacagctggtctctctagatcagcttatacactgtacctcaccttacttgaggccatagctcgaatctaggcagaaagtacttgggaggtcaccagctctgttgccttaaatagtgaggatgtgagagccaccagagacccctgtctgctggctccgcaattcccttgattttcaagagtggtaaacagggctgtagacatggctgagcagttaagagcactggctgctctttcagagaatctaggttcaactcccagaacccacatggcagcttacaaacgtaattccagtgccaggaaatctggcatccatgagcaggtataaggcatatgctacaactacatacatgcaggcagatactcatatatatgaataaaattttaaattaaagcattaaagataaggcaggcgatggcggtgcatgcctttagtcccagggatcagaaggcaacagcaggcaaatctctgtgagtttgaaacagcttggcctacataatgagttccaaaacagccaaaactacacagagaaatcctgtctcaaagagaaaaccaaacaacaacaacaacaacgtgatatgatacaaagtcaggggtaaatttggatataatca

SEQ ID NO: 29 - DNA, 1000 bp, mus musculus
tccacccacctgcttcctgggttcctggactgttcgttcaaagaaagttaccctgacccaccctgactgttgctggaactcactatgcaaatgtgctattgttagagtctcacagaaaactgtcttgactttgcacttcctcgtgactcttaactggtaattttggtattttccaacaacgccctccctaccccttgagttgtggtttcttcctttaaatacccccttacccagctacttgaggtgccatggtcctctatctgtgcatggtgcatgactgtgggcccgagagcactcttgaaataaaagtcctcttgcagtttgcatcaagactgtttcttgtgaataatttggggtgtcacctctcctgagtcagaatgtgggggagccctcacattgtgggtcattcatttggtgtgttggctgtgaacatgaccacccctcaaaccggagaactgacttggaggtgtggggatgccctctggaatgtgtgcgtgctggccagtgtctctgttctgagtgtctgttttctgttttctgaaacaaacataggcttgtcctttgtttctgaagcacggcacagcctgagtttggatccatctgaatttattctgatcagcctgagtttggtttctctggttttggtcatcctggtggaaggggcgaaggtgtttgtagatgatgtggttttctgaaatgcacacactttgtatttgcagctgtcctctcgggctggaaggactgaaggactgtggtcggcaggtgtgctaggaggaccacaggctgcccctctgggggacaccctgggaagtgagaagagccagggacgcctggtagtctccagagattggtcagagggaccgagttctgatgttgaagcggaagcttccccctctgaagtctaattcttttgtctgcttgtggaggacaagaaagggccgcatgtgtctggatatgttgttttctgttttgtgtgtttttgtgtatgtgtttagagcta

SEQ ID NO: 30 - DNA, 1200 bp, mus musculus
gaagctcaaaagaataagcgtgtgatctaattcacatctacttatttcccatagaggggttgtttttaaacacaataattgggatgcatgcatgcatgaatttatagaagatacaaaagcatgcataaaaacaatttttaacttatctttgggatattgattgtcaattttatttaaaatgatggtatgcaatagatcgattattgatattctgtaataaccaaattaattgctgtttggaacaaggaacagacactttgtcaggttcctaagacacaatttttgttataggttttctaaaatacctggatatatcttataattctttattagcactacagtagttttactaggatgctgaaactgtgctttgaggtgagcaccacctcagccccgcccatgtgccttgttgtggttctgccgtcctgggccccatacccaccaggcacctgggggtgcgtttgccatcgtccttctcagccccggctgagcagaacctctgtcacttgccatcatggtgtgtggagccactctgaaaaggactctggatttcaacctgctgctgagccctgcatctcggtgcgtgcctttaatggcgccacctttgattgcctctgccacttcccctgaagaaaggtgtttgtgtgctgagcagggccagggccctgtctgccatggggcctgccgccactgctattgacagcgtgctgctgcgatgtcaagtggcagctccgtggccctggccctggccctggcaggggaacaccctgagtcttagcgcaaaaaatatggctaccccggcagggacgggaggagtctcatggggcaatggcgagcaaggccctctcctgagttcgctacaaagccgcccgcccactttctggcggcctcccatgtcaccacgttcagggaaagctgcgtgcccaaaggccccgggagccaaagaatacagaaaataaagggggtaggaagtcacaacaggcaaagtacccagaagttacctgacatgaaacaaaggaatgacttcaaaaggattaacaggaaccagataaatgtttacagtaaggataaagcggctctgcttagggtcagcttaatgacagctaaggttttaaaacttcccttgagaggcattagctaataaaatactttccacttagaaaacaatatacactgaaatattcaaactcttagcttctt

SEQ ID NO: 31 - DNA, 1000 bp, mus musculus
tctcttccccctccctgcacccctccatttccaaagggtgtccccaccccacatcccaccagacttccccactccctggggcctcaagtctctggagcattaggtgtggcttctctcactgaggccagaccaggcagtcttctgttgtacatgtgttgggaaggggatgcatcatatcagctggtatatgctgcctggttggtggctccgtgtctgagagatctcgggagttcaggttagttgagactgctggtcttcctatggggtcaccctcctcctcagcttctttaagcttttccctaatttaatcacaggggtccctgatttctgtccattgtttgggtgtaaatatctacatctgactctttctgcttcttgtttagtcttttagagggcagtcatgacaggtccctttttgtgagcactccatagctccagtaatagtgtcaggccttggggcctctttttgagctggatcccaatttgggccggtcactaaacctccttccccccagtatcttttccatttttgtccctgcagttcttttagtcagaaacaattctaggtcagagtttttgactgtgggatggcaacctcatccctccacttaatgttctgtgtttctataacaagccaaagggcccaagtgaggatgcctcaatcccacttgtgtgggagaggggacagggagggaaagggggaacatgatcaggtgttggtgtgtttgagggaataggactgaagccctcagggccagtaaaatgaatgaaaacatgcaacctcgggaggtaggaggtgggggaccctctagaatgtatcagagacctgggaggtgaaagactctcaggtctcaaagggaaccttagatgaaatgccctactgtggggagagggaacttgtaaagttgatcagtatattcttaaggatacaaagaaattagaagaaagaaacatgtttggatgaaagtgtgacaaactggtaagtatggctgctgttgac

SEQ ID NO: 32 - DNA, 1000 bp, mus musculus
acagaatagtaatagagttatagaataaagatacagtatttaataaagcacagagatttataaattaaaataatgcataaagagttaatgaaggacaagtcccttccagtcagcactagcaccaggtcacctagggttcagagtctgcggatacccccaagtttccttgaggactcgccacaagatcttaggatcattggtgagctgagcacaacatcggttccaatccaatcgtgtgggacctgagtcagcagtaaggaagaagaaaaccggcctgaccaggggcacaattcccttctggttggcaccagcactgggtcacctagggtgcggaatgggcggatacccccacagtccccagaggactctccatgtgatcttaggatcactggtgagtggaacacaacatcagttccaattcaattttgacgggcctatgacagcaggaacaaggacaccagagcccttcctgaccagaggcttgggttccttttgatcagttctggtttaccttggttttgaacagactagacagttccatggtcctcaaaggagataccacttccaggcactgtaacaggtccaggatcttaggacaacagaatcccaggataacagtagctgggtcacaccagtatttcagggtctcagaggagcttgattgccaagaactctgacaaacccagaatctcaggttcacaggagcccacaatcaaaggatcacagagaaagctggactcacaagagtcctgaatcaaccgggattataggaaggacaggctccaatgagatatattgagggcagcaagcacttgagataataagatggcaggagacaagcttaagaaaagaaggaacagaaactaaggttacttggcatcatcagaatcaacccctcccaccatagcaagtgctggatacaccatcacaccagaaaagcaagacaaggatctaaagtcacttctcatgatgatgatggaggactttaagaaggaaatac

SEQ ID NO: 33 - DNA, 1000 bp, mus musculus
tcttgtgtttgtcttttgccatatggttatctctggtgttcgatcgtccttctgtctctgcctggagctttttccaactgtgggtttgtaagcctgtgtcagcactgctgggagaacaactctctcctggctagacccatgcacagtgtgctgtggaacagcctcagctccctgttgtagtgagagttgtttccaactgccagtttagtggccatgtagagatattgtttgaattagaccattagaccaggacaccccagtaggtagggacaaggcagcatagacaaacccaaagatgagaatagggttattaactacctctaccagtttcatgaggatactattaataaccagagaggctgacagccaggccagaccaccaggtcatcacatggtgtgataggggctggtgccctgagtgacggagagcagttcatccaggcctgggatttctcagcagtgagaaaggacccatcttagaggagagatgaaatctcacctaagagaaaacgtccaagaatgagggtcagtgaaaacactgaatgcctccatcctcaaaggcagcataggggtaggtttgagctcaagaactttgccctgggaccatttactctaaccagtgtggggagggaacttaccagttctctgaaaattggtctatcgagtcttggctcttcatgtggtagcagggggctgcaaacctgcacaatttataaatctgagtctcagcaccaaatgctgggtttataaactaacaaaggggaaagaaaatatgtttagtggaggtgtagtcaggtatgggggaagggggtgcctctgtgggcccctgctgaagcatcccttccccctgatagagtttattcagggtatggggaggggagttgagagagtaggagagagggagagagagagagagagagagagagagagaagaggtctgctatgagcatgtgggtggggggaggtgaatggagagagaggggtgaaggggtgagaggac

SEQ ID NO: 34 - DNA, 1400 bp, mus musculus
ttcctcttatggtcttctacctgtttagcagggttttcctgtaattccttgagggatttttgtgcttcctctttaaagagcttctacctttttagcagtgttcttcagtatttctttaagcaagttattaatgcccttcttaaaatcctctactagcatcataaaatatgattttaaatttgtatcttgtttttcaggtgtgtttgggtatccatgactcgttgtggtgggcataatgggttctgattatgcccagtagtcttggtttctgttagtaagattcttatgtttgcctttcaccatctggtaatctttggtgttagatgttctagctgtctctggctggagctcatccttcctgtgattctttagcctctgtcagcactccttgaagagtaactctctactgagtctcaggtgttagagcactctctgcatgcaagctctcctcttgcagggaaggttcacagaagtctggagctcagatccacctcctgagtcctagggtcagagctgtctccggaggctgactctcctttgtcagggaaggtgcccagtggtctgtgtctcagctctgcctccttgctgaggatgaaggcccaaaaggaccctgtccaagaagcgctgttgcttctgcatcccacgtgctctcttgcatagactggtctcattgatcccaagattctgggtgtgctaggcactgcctttgtcatttgtccctgttccttctagttcaagaccctctggattttttggaacagatgctgagttccactcactggtgatctgaagatcctgggtgtgctagagtgcctttagcgtggagaatcctcttggagaccttgggactctcagccgagatcttgcccaagatagcgtgggggtggagccaccagaacaaaccccagctgctggtcaggcaggtgtcctttgtccctgttcctgctagcacaagaccctctgggttttttggaacagatattacattccgttcactagtggtctcaagatcctggttgtgctagtgttcctgcagagtggagagtcctctggggaccttgggaccctctaccaggttcatgcccaagatggcgcaggggtgacttgaattttttaatcatacaagtttttttacttggttagagttattctaaaatattttaaatttactttaggtattgtgaaaggtgttatttctctggtttctttcttagtacatttgttgtttgtatattgatgaattacttttttgagttaattttgtatgcagctacttcgctaaaggtgttaatcatctgtgtgttgtctagtagaatttttagtgtctcttgtatatagtatcatatcatctccaaataatgatactttgacttattttccaatttgtatcttttacatat

SEQ ID NO: 35 - DNA, 1000 bp, mus musculus
acaaatcttagggggtatagctttaaactattgtttggaaacacacatgtagttttaccaaattaaatacttaaatagattaaatagatcctggtggtggtatgtgttccttgctaccgactccagtgttctgggttcctgaatgaaacacacacacacacacacacacacacacacacacacacacacacacatacatacacacagagacacacagcctttatattttgatatgcctaaaacagctcaatggctgggcaacttcctcacctccatctagctaatacccctctcatattcttgagttattacttgctaaatctatactccatttacccccaaccccggacccagccatggggccttcttgggctgggatcccccagctcctatccttccttctgtctctaaatcataaaagtctggcctctgtctgccctgccaaactattggctgcgggcaactttatttgccaatcagaaccaacttggggcagggtccctcagtgttttatatgaataagtgcagattctcatgctaacaatttgggggacccaaattaacataatataaacatcattaggccaaacctgctacacacacatatttttattttattaaagtaagacaacaagactcccctgagcccagtagccccaccagtctgtgatgcttgtcttggctctttggtgctgcactggggaggcagaagtaggtagaggtacaatttcatgaccaggctggtctacagtgcatatgcatttgcaaagcatccaaatggtactacattttcttgaatacagtaaatcaacattgcgattatagtattatctaatatatagccatattctaaatttcaaattcaaaaaataggacaatacagaacattttcagtacctcagtactgattctaagtgattcaagatttctttatggttcagagatgtttagttaaatactgaaattgatgaaacaccaacagagattctcattctgtatc

SEQ ID NO: 36 - DNA, 1000 bp, mus musculus
agcacaatggagagagggagaactgcacacttgagggtaataaggaacagcttaatgtaagtagccaatgatgccacgtgggaccacggtggggttctgacctatgctgccactgagaaccatgcctgagtccatgtccctgcagcagcagagatctgttacccaaaaggcagggaacatgtctgtggtctgggctggtgcctgagggctgtgtggaactgaccccatccctcacctaggcatcttgggaaagctggctccaccactcatttcctgtgtggtgtagagaaaggaaatgagtggtggagcaggctcacctctacccctaccactaaggacaataaaaaggaattctcccttctttccagctccagcattagggagagtagaccctacatctccaatggtagcagagtagagctgaccttagtggtaggggtagaggtgagcctgcctgagggcatgagcatgggagagctttgactctgccacttctctgtagtacaatagcatgggcaaaggggagatacatccctccttgcctcttgccacctacagcaggttggagagatggctttgtggtcattagagtaggagaacatgccctgtacttcacctggacatcacagtctgatgatgggggttggcgtgggggagtcatggtgtgacctggccctgagggtgtgagcatgggagaactgatcccacaacttatctccagagtgtcagtgtgggcaaaagagagatgcccacttcctctcactatctttggcagacaggagatctggctcagggtcatgagaatgggacaactggctatgtctctggctggctgcaacactcagaagagcatctcacctgtgtctcacctgtgtagagctggccatggacatgaggattattggtgagctgatcctgagggcatgagagcaaaggagctggtgggcctctcaggctcagatccagggctttggacagagtcatttcaatgatcatttgc

SEQ ID NO: 37 - DNA, 1000 bp, mus musculus
ccagagtcaaaactaaatacagaagaatgccagaaaattaatcacttaaacagaagttcctctagtttaactttatacacgagatgcaaacaaccactctaagatagcatagtgggcatttttcaggctcttagctggaagcatatactaatgtcatacaagcatgggcctgatccccatgaaagcagaggcagctgattgaaaagcagttagaaatgaacatgaacatctgaacaagagctataagcatttatagtaataagattatcacaaacatttaaacacttctttctgactttgagacatgggttattaaagttataagaattaacaaaccattgtccccagtcttgactaagatcagagcccatagacttccaaagacttcagtttaagctgcataagcagattctaaggcagagtgcctgtgatcacactcatcattgaaaaatacactacatggttgcctgcttgtttatatggtcattttctgtttcctgctcctcagtgcaggctttatggcaaaccttaacctgtcttctcagtgctacagagagaccacacatgatacaaatcaacatttcagaaagtgtttgtaaaacactacagtagggactaggatgatggctcggtcagaaaagtgcttgtcagttgagcatgcatttagagttcaaaattccagcatccacataaagaagctgcatatggaagctgttaccagttgtctcaacactgggcaggcagggtctgctgcatccttagatttctctggctaatgaggctagctgaattagggagaaagacactcaacattaaactcatgctgacatatacatgtgcatctatgagggccatttatacttgaacattcattcacacatatacacacaaaacatgcaagcacattcataaacagcaaaataaaattaatcaagttgtacttagtagcttgagctatttgcccttccacctttctggtcttgataagacttaacattta

SEQ ID NO: 38 - DNA, 1200 bp, mus musculus
atgtatatgaaatacttgaaatttgagaagcacagttaaaatttaccttatataatttaattatcttgtgtacattagtttttattgtctaggaagtttgagaactactaattcaaagtaactacagagttggaaaaatagctcattagtaaagtacttgatggaaaagcatgaaaacatgagttctgatctctagagccaacataaaatgtgatgtgtggtagcacatgcctatactttcagtgctgaagggtggagggcagcaagaccctaagcattcactggccatcgagtctactggaatcagtgagctctatactcagtgagtagctttgcctcacaaataaatcagagaagtaatttagaaagacatcacaacattgatttacacacaccaacacaggaatacatacaggaatcgatatggaacacaatgtgtaattgcaatttgtcgagatgtgagtgttcatttgcagtaagcaagaaagttttattttgaaagaattgcaaagaagttttaaagtaattaatagaaattaccatgcgggtcaccttgggtgtgaactcattggacagtcccacactccccagaggactctccacacgatcttaggatcactggtgagtggaacacaacgtctgttccaaaccaattgtgtcaggcctgtgatagcaggagcaaggacacggttgccctgcctgaccagccactaaggttccttctgattggtgctggtataccttgatttcttacacaacagacagccccacggtccccagaggagaaaccacttccaggtgctgtaacacatccaggatcttaggatcccaggatctcaggaaatcaggagtttggtcacatcaggatctcaaggtttcagaggaagcttgactgccaagaactctgacacactcagaatctcaggttcacaggagccctgactcacaggatcacagagaaagctggactctgaggagtcctgaaacaaccaggattataggaagaacaggctccaatcagatatatagagggcagcaagcatttgagataatcagatggcaggagggaggcttaagaagagaagcaacagaaatcaaggttactgggcatcatcagaaccaaactctcccaacatagcaagtccgggatacaccatcataccagaaaaacaagacatggatctaaagtcacttctcatg

SEQ ID NO: 39 - DNA, 1000 bp, mus musculus
tgagagtacccatcacaggtcctgaaagataaagaagaaggcccttctttaaggcccttctctggagtgtgtcctttatgtggctggaaagaaggcattctccatttgctgaccccaggcttgttgtccacaaggcatgtcttcaggaggatgctcccaatgactccagcccttcatcccatggtcagcacagtacttgacgaaaagtagatgggctggtggggtgagatgggggttaggagaggtatagccactggacacatgtaacccagctactgttgagctgagtgccacaggaagccatgtaaaatggatgggtcttgtagctctgattggaggagcatccactggctatagatgctggagtgaatgacggaggcagatgtgggacaccagctccacccacaggcagaaaggcaagacaaggcttcattggctatgtttgtggtatgggatttgtgctaatgagcgcatgaacctgcaggcagaagagtatcctgagtagaaatgcagacaggctcagctagtgctacaaggctagagtgacctgagttccttggttctagtgagagttggaagcaggagccaaggtgagctcagaggctcttggctcttttgagagcgcaggaacaatagggactctcaagacttcagtctgtctgtgtgccatttcagtggcacaatgttccactaactagtggtgtggggcctgctttgagctgaacccagcagcagtggaatgctgcatgagctatgctcttggacacaggtcagccgatccatccaggaaaacaaccctatagactataaaggcagatctcagtgctgtcgagccgcacacatgaccacatggttcccagcaattcactgccataatagcagcctcaaatggatatccttggtctctttgatctcaactgaggccttctgggcaagatgcacagactgtgtgccacatggtatgatgggaagcaacatcaagagaggtgaggctgcaatc

SEQ ID NO: 40 - DNA, 1200 bp, mus musculus
tatacggagaagatgttccaacatgtaataacgatgcatgctcctctatgttcatcacagccttatttataatagccaggagctggaaagaaccaagatgtccctcaatagaggagtggatatagaaatcgtggtacatttatacaatggagtactactcggttattaaaaattgaatttatgaaatttttaggcaaatggatggaactagaaaatatcatcctgagtgaggtaaccaaatcacaaaagaaaacacatggtatacactcactgataagtggatattagcccagaagcttggaatacctaagatacaattcacaaaccacatgaaactcaagaaaaagggagatcaaagtgtggatagttcaatccttcttagaagggggaacaaaatacccatggaaggtgttacagagacaaagtgtggagcagagactgaaggaatgcccatccagagactgccccacctggggatccatcccatatacaatcaccaaaccaagacacttttgtgcatggcaacaagtgcttagtgacagaagcctgttatagctgcctctgaagaggctccaccagtgcctgacaaatacagaggtggatcctcatagcctaccattggactgagcacaatgaaggagctagagaaaggacccaaggagatgatggggttagcagacccatatgaggaacaacaatataaactaatcagtacctctagagctcccagggactaaaccaccaaccaaagagtacacatggtgtggctcatggcttcagctgcatatgtagcagaggatggcctaattggccatcaatgggaggagagcatcttgatcctgtgaaggctctatgtctcagtgtaggggaatgccagggccaggaagcaggtgtgggtgggttggtgaggagggggagaggtaggagatagggggtttttggaggggaaaccaggaaaggggacaacatttgaaatgtaaataaagtaaatatctaatttttaaaatagaaaagaagaactaagggaaatagggaaatgaaaattttaggaactcaaagaggaagcttagagacaagcctcaccaatgggatacaggaggtgaaagagagaatctcaggtgaaaaaagataaaagaaatggatacctcagtggaagaaaacattatatctaaaatactcccagtacaaaatatctgggaa

SEQ ID NO: 41 - DNA, 1000 bp, mus musculus
ctagtgtcatcagagagaaaggtacctcaattgagaaaaatgcttcttagacaagcatgtgaggcattttcttaattagtgattcatggaggagcttccagcccactgtggatggttcaatccctgggctgctgatcatgggttctataagaaagtagactgagcaagcaagaaggagcaagccactaaacagtgctcctccatggtgtctgcatcaactcctgcctccaggttcctgccctgttttagtgactgtcctgacttcaatgatgaccaccactttggaagcataaactacttaatatgtcctttcctctccaagttgctttgatcatggtgtttgatcaccacaatgataaccttaactaggacagaagctaagcagtaatttgttattctgctctaaactccccagcaggtgtgtgtgccttctctacatctgcacaaatgttttggatttcggaagacaaacacatgcagccttactttaaatatgctttaaatagtgcaatgactaggcatttccaaatgtccctatggctagcatattctcccctctgatattcctgaaatttactttctaaaatctatactctatctctgctacccaagactcaatttggggagttgcccctggggccactctaccctgttttggggggttattcttgggggggctggttttttttgggttatttttttgttttgtttacgtattttatgctttctctcctacagctctcaggcttgatctttctgctcgctgtcccctgccccatcctggcaattcggtttcctccctctcctgcatttcttgtcctggaaatctaaaagtcctgcctctgtcttcctgaccagccattggccaccagaaactttattttccaatcagaggcaactgggggcagggaccctcagcagagatgtgcagcttccgatgtgatttggggagacaaattaacacaaataacattagaaccaatccacaacatctcatcct

SEQ ID NO: 42 - DNA, 1400 bp, mus musculus
caaatgccaccatgtctattatgaaatcatctctagtatttcaattatattttggatttattttttaaatttcttattggagtttgtgtgtgtgtacctttgtattgtgtgtttttaatgtatgtatgtccacatgcacgaaggtacccttggaaaccaaaagatgttgtatcctgtggaactagaattataggcagttttgaattacctgatgaaggtcctagaaacccagctattgtcatctgcaagagcaacaagcactcttaattgctgtgttgcctcaatagctccatttcctcttattttgaattaaatgacctgtccttccatgtagcctcaccagcatctattagtcttctatacttttctccttaaacaatgagaaccaaaaccaactttcatttagtcagctctaagtatcctttgcattttgaaaacttctcttactacatagtttctgtcttttttttttttttttttttttgaacagggtttctctgagtagccctggctgccctggaactcactctgcagaacaggctggcctcgaacccagaaatcaacctgactctacctcccaaattctgggattaaaggtgtgtgccaccaccactccgcacagcattgtttcttttctttttctttttcttttttttttttcaagatgtcatcactttgcatttattttgtaccttgccattatggtattaaggtcatttgtgttcattgtctctgaggaggtagacatactaatattttatgcaggtcagtactcttcccagttctcatctgtagtaacttaaagttgatcatggaaagagtccttatttttttcttttttcttttttttaaaattaatttttattagatattttcttcatttacatttcaaattcaaatgctattctgaaagtcccctataccctcccctgtcctgctccccaacccacccactccctcttcctgttcctggcattcccctgtactggggcatataatcttcgcaagaccaagggcctctcctcccattgatggcctactaggccattctccactacatatggaactagagacacgagctctgggggatactggttagttcatattgttgttcctcctatagggttgcagtaccctttacttcctggggtacattctctagctctttcattggacagcattgtttcttaatgatttctgatgagaattacccaaaacagtatttaaaaccagattcctgctatctatttgtgctttaaaagtgaaccagccctttataggctcatgccccaagcttgaattactatttgggaacactatggagccttcaggattgaaacatctcttgagatagcaggtcagtggtaggacatggagtttaaagttttatagtgatgtcc

SEQ ID NO: 43 - DNA, 1800 bp, mus musculus
agcctgcttccctatgtaccgcagtctcgagttccgcgcgattggattggggcaggcactgtgatccactcaccagaggtcttagggtcccgtggggagtcctgtgtggacccttgcgggtgttgggcaagactctgctggcaaggtagcccggggctcgagtcacgagtcgagcggaagggacttgtgccccagatcaggcccgggtagcctgcttccctatgtaccgcagtctcgagttccgcgcgattggattggggcaggcactgtgatccactcaccagaggtcttagggtcccgtggggagtcccgtgtggacccttgcgggtgttgggcaagactctgctggcaaggtcttgttttctctttttactcctcttcatttcaatattttaatcagttttgtggtgagggaaggtatgtgtgtatagatgaggagaaacagaatgctacacaatttcatctgtgcttgaaacttgtgcaagcaacttcctactcacagagaatgttaatgtatatgtgaagctcttggtctcagtctttgatccattgcttattttcactcttgcaatagggaagcatatgaaaaactcacatctttacaattgtcttagttagggttttactgctgtgaacagacaccatgaccaaggcaactctttttttttttttttttttttccgagacagagtttctctgtatagccctggctgtcctggaactcactttgtaaaccaggctggccttaaactcagaaatctgcctgcctctacctcccgaatgttgggattaaaggcatgagccaccacacttggcttccaaggcaactcttataaggacaacagttaattagggtttgcttacaggttcagagtttcagtccattatcatcaatgtagaaacatggcagtgtctgagcaggcatggtgcaggaggagctgagagttctacatcttcatctgaagtctgcaagtggaagactgacttctaggcagctagggtgagggtcttatagcccacacccacagggacctactccaatagggccacaccttctaataatgcccctccctgggccgagcatatacaaaccatcacaatgttttctaggttttgtttttctttcttcattttaaaacttctgcttttcaaaggctgtatctctgataatggactgttcaaacacttaatttctgattattttctatttcttacatttatcaaaaggcataggtctttaatcaaatcatagattttattgaaatatcagaatcttataactgtctaaatttaacaataaggaaaatcattgagttcagaatgaaatctttctaagaacaggatttgcttcttaattattatattttaaaatagacaacgcatgcacatgatataaaatccaaatattacaagagggtatatgctctgtttcaagacagtcacttcctttcacagaagaaaacaagcacaatttgttcttctgcttcattccaagaatatactttatttttaaacaaaattacagtattctatgacatgaagttgtgccttatgttttagtacttagtcttaatggttattctttttcctagtagatatgagttgttggttctttcaaccattgatgacattacattgagtaaacacattacaacttatttttattttttaattatttcttttatttttgcactattcccctcttccctttatgccttccaaaccctcccatattcttttccttgctgcctttcaaatccatggcattatttttcactaattgttttttacagacaagta

SEQ ID NO: 44 - DNA, 1200 bp, mus musculus
tttgcctaaaaacatttttttatgtgtgggggtatacacctgtatccctctccttccctctgtgctccccacccccaacatgtgcatgtgtgtgcattggaggaggccagaggtaaatgtctggtttcttcctttctcactttacaacttaggttttctactttttttataaattaataattttattcatttacatttcaaataatatcccccttcctggttacccctatacaactcttccatctcatcctccctcctccacttcacctttgcctctatgagggtgctccccaacccacctatccttattgctctaacatccccctacactgggacatcaagcctccacagaaccaagggcctcccctcccactgatgccagataaggacatcttctgctacatatgtatctggagccatgggtccctccatgtgcattctttggttagtggtttagttcctgggagctctttgtggtctggttagttgatgttgttcttcctatggggttgcaatccccttcatctccttcagtccttctcctagcttttccattggggttctcaggctcagtctgatggttggctgtatctgcatctgtattggtcaggtgctggtaatatctatcagggaaaagttatcaggcaagcacttcttggcatcagcagtagtgtcatggtttggtgtctgcagatgagatggatccctaggtaggatggtctctggataggcttttcttcagtctcgcttccagttttttggatctgtatctgtttctcctgtctcagccattccagctggaagagttcaggtgtatggcaccatgctgtgaattttacatggatcctgagaatctaaactcaagtccttaagctctcatgagaggcactttaacaactcagccatttgtccaagaccctactttaaaatattttgattttcacttcggttcattattttcattatgaagctccttggtaaggttttgaattttacataattaacttcttattagcagacaaaatgtcactttccttatgacatactttccttatgatgtacgttccttatgacatacttagcttttccttgtgatgtacttagtttttattggtccacttcttccaccaacgctccctattgtttcactgctcctactccccctttctacccttctatcctcaacattcttctttctac

SEQ ID NO: 45 - DNA, 1000 bp, mus musculus
atgaatgaagcagaggcaggctaacctctgaactggaggccagcacagtctacagtgaaagttcctggacagccaggacaacacagagaaaccctggcttgaaaaacaacaacaacaacaacaacaacaacaacaacaacaacaacaacaccacaaaaaacactgataccagaacaatggaggcagaaatggtagacctctgagagtttctagccagcctgatctatgcagtaagaccctcctcaccccctaccccgtcccgcccctcaagtaaacaaaacctgtctagttcaagctgccttactgtcacatgaaataatcctgtttttgttttttataagttaggaattcatgtagacctgactgaccttgaactcctgatcttccagtctccaaacaaccccctggcttatctgttgtttttgaggcagcatctggtctcgtagcccagattggtaacacactcgcagtaatcctgcctccacttcttgagtgcaccacaatgcctgttctttcttttggctgtttttattttgaaatatgggctggctacatagctaaagccggtctagaactcatcaatccttctgtctccctaaagcagtcaagacaggtgcagcaaccatgccctctctatcactactacatgaacagcaacaccagcatcccctgaacccagagtcttgaacctcctgtactcctggctccactgcctagaatgcagccaaccccatagcaggtgctcaggtgcacacaggtgcagcacaaatgaataaaatgaatgaaagaacctgcacgaccaagaaaggcgaagcatttgcttcccaagtatctttgataacattctctccttcccccaaagcaagtcccagagagtagtgcaaataccagcaccctgaccccaaggcgcccactccccactgcgccagccacaggcacagggggccagtgctcctcacctggtctacgcagccctctggtggaatttttagggtcactt

SEQ ID NO: 46 - DNA, 1000 bp, mus musculus
tcttcttatgaaaatcttcattctcatctctacctattatccttagggttggtcttctcattgtgtcctggatttccttgatttttgagttaggatctttttgcattttgcagttttttttttttttaattattgtgtccaggttttctgtggaatcttcagcacttgcaatagtctcttccatctcttttattctgttgctgatgcttgcatttatggttcctgatttttttcctaggatttctatctccagggttgtctccttttgggttttctttattgtttctacttccatttttagatcttggatacttttgttcaatcccatcacctgtttggttgtgttttccagtaattctttaagggatttttgtgcttcctctttaaggacttctacctgtttagcagtcttctcctgtacttttttaagtgagttattaatgcccttcttaaaatcctctattagcatcatgagatacgattttaaatctgaatcttgcttttccaggactcactgtggtaggaggattgggttctgatggtgctgagtggtcttggtttgtgttagtaagattcttatgtatggctttcgccatctggtaatctctggtgttagatattctagctgactctggctggagcttgttgctcctgtgattctgttagtctctgtcagcactcctaggagtccaactctcccctgaatcccagtggtcagcgcactctctgcaggcaagctctctgcgagctctcctctgcagactggtctctgagagacctgagattcaggatggtgctctcatctgagtcctggggtcagagccctccctggaggctgactttcttctggcagggaaggtgtgcagaagactgggtctcagctctacctcctagctgaggatgaaggccgaagtgaccctgtccaagaagctctgttgcttctgcaacctgcatgctctcctgtgtgaactggtctctgagagacccaggatataagatg

SEQ ID NO: 47 - DNA, 1000 bp, mus musculus
attctgtgtattattatttgccccttcaaaccaacattttatccatgatataccaggagaagaaaagtattgccacaatcttaacaaaggcaattgcccaaattctaccagtaagtcatattaaggatccacctttgcagccaaatgggaactctcattttttctaaaatgaaaattctaccttaatgtcttcagaattcatccacaatggctaagagatgtgttggcttgttcatgtcccaccaactgattttgtatgaaatgtgtacagttaatcaatgctaatgttttcagttggccaaaaggcaaaataataatggtgatagttgttaaagcacaaatatgcaaaattatagggctgaagagctgctaagcaggcatggttcttaattataacagagaatatatggtcactgttttcaaaaactctccacacagctagccagacctcctggttcaatccccagtggctgaaggtaaaatcccatagtcctggtctagaatcatgtctgaatagccttgcattgttctctcccatagatgtttttctctcctgctttcctcagttggagaaggtttagttccgagtaatgattttctttcacacttgtttttgtcttttccttcccccactttgccaaatggcctcatctgccagtcacaatttttgtggtccacaattctgatcacttttaaatgaaacccatgctggctttggtaatcataatgtcatttacaatttaccactaaacacgtttattcagttagtagcacacgggagaaagagaactccatatgaactcaccgtgaaagacataatctgattatttcctcatgaaaatccaggcaggggtgcttgtaagaggggcttgagagaagatggaaagaaggcaaggcctggccacagctgactttgataatcaatgtgaacagataactgatacagcctgtcagggcaaccacccagtcaccccagggcattcttctcaaaaaggcaaga

SEQ ID NO: 48 - DNA, 1000 bp, mus musculus
ataaaataaaataaaataaaatggatgtgttgtatttaataaatatgtaggactaaaatgaagaaacttgttattccatgactgtgatcataaaaaggacagagaaatgttgggtgaattcaaatattcttcctcaccaactactttaaccagtctctggaagaaaaaggacaagctccacagtactcatttctcataggctgcatccggactcagaaagacttagaggcttaaccacactggactacttgctgagtgccagtcctaagaggctaagccccagacccttgcggattctccatatctccaaggatccctccactataaaaatgtttatgcctatgagtctccatcccaagagatgtatgaccacagataaggccagccttttcatccagcccatcagaactgcaaaccatagcagaatcatagaagcctgaggcaggataaccaagataacatgcttcctaaaaagtgttggttaagtgcatgaggttttccatttgtgggtacatttggataagttgcaaccccctcctttacccattttctcaatagtaacacaagggtaatatagctattctttagctcaaagaggtaaatgttagaattatatgccaaaaactcaacaaggatgtaactttcatgttgctgtctgtggctgtatccatcagtatggatgcttctttacacccactctcaaacacatcaggtaactaactgtttaaagacaagaaaggcaagggtcagaattcagttccagtaggatagattgcctagagtacgaataacatttgtcccacattgtagaagatggtcactttcttttttggaaagggagatttttgctgtttctaaaatctgaatctacctcacagacacattttaggcagttttgtgactgtatcccaacctagacaatgggtgctctcttaaaatagccaacctgctacacaattgcaagtccacaatttcatgggactttgaaattttcagtgtt

SEQ ID NO: 49 - DNA, 1200 bp, mus musculus
aaattaccatgtctttgggtggcacgatgctgtaagtgtatctcatgtctcattcatgtaaacgcgagcgttattccaggcagagccaactttttctcaaagacagctaaagaaatatatgtcctgtatactgtttcttggaatctggttctgatataagaataatgccatagcttggctattggggctgtttgccttcagcgaacaccactggcagtcactcccaccatttacaatgagcagaatgctttgggttctgtacacagcccagtacccactctctgggctcccaagcatctctctccagagcagggcacctttgcatttgggaaggctttctttccaccaggatgggatgagatgtgcatcatcctctcagagacacagagttagagagggcgttctgctatatcttgagtaatttctttgttttcttccacatttctaatgccatgttcctattattacagactctcctaggcatcagggggagcagggtccccaaaccacagacaggcctgcttacctatcctctgttactgtggtccccaggtctacaggagaaccctaccgtgcctttttctttcccatctcaattcccaactgttttgtgtctcgtcccacaaaaagtatgccaaaaggatactttgctgtgcaagccccaagacttgagttcaatccccagaacccatgttattaaaaatgggtactgtattgtacacttgtaatcccagtgctgggcacagggcggggcgggggggggggtgtggagacaggaggacccctaggcttcctggccagtcaccctagttagcaatctccaaactacagagagatcctgtttcaaaatgaagtagccagctctgaggttgtcccctggctttcacatgcctgagcatgcacaattgtgtgtgtgctcgcacatacatgcgtgtactattgtgttgcactatccatgggaagctgtgaataaatgtctgctggccccagttagggaactcaagacaaatgaaagtacagatagcacacaaagtgtttaattcccagcacccttgtggtggctcctaatgacctgtaactccagttccaaggaatctggtgccctcttctggcctcctcaggaactgtacactcatggcacacagacattcctataagcaaaaacccatacatggggaaaaaaaaccaacaacaacaaca

SEQ ID NO: 50 - DNA, 1200 bp, mus musculus
caagtataaaataaccccataatacacctaatttcatatttaaacatacatgcatagttttagcaaacttttctcatctgggatgagcatcttccctccaagtgccaaagaccacataacaaaagtatcaatacagacacgagaaagatgtcttttcacttgttttgtctaagagactcccaaagcatacagtctattactgttgcctgtagttacctccctaggggaggaagttagttccttttgctgatgacaccatgaactctgtaaatcctgagctggaactgccctgaatgtcccctccctgatgactagatttcttggtatcagaaggtactatgtgagcttctacaagagggaagcaaccaattgtcctatccaactgtgattcctatgaagtgcatctacaaaacaataactgttggtaccggagtagcccacacaccttagtagtaagcaacagctctctaattggactgacattctgttaaacaagaagaaaaatcatttctgctagtggaaacctagctaactatgcactgctaatgaagccatggtcactgtaggagaatctatagttaataatttggtaaaccaacctattctctaacaatataaacttaattatgtacacccacagattagaatagtcttcacctttcatcaaggagacttctctttgcaacagagtttactgcagaaaactacaaccaatcaaaatgaagaactctagagcctggtcccagtggatacatctacaaaacactcttgcgtcctagactcagggcattgcagaaaaggtggtaataagagtgtcagaatcagagaatcaggagttttctgtgaggttgtgtctcctagtaatatcacacgctccacccatagatggtcattaacatgactgcccaaacgtgagctgaacaaggacaacaccaatggacagcacaaaggggatggagaaaagcccaggaagcctcaaccctagacatagaggtgtaggcaactgaagaaatctaggaatggaagaggtggtcttccccacagaagagcacaccagttggttgtttagggccaaatggtcagccctgaaaatgtacatacaagtaatgttatatgtactgtgcaggtaatattgaggaatacacacacacacacacacacacacacacacacacacacacacacacacacatatatata

SEQ ID NO: 51 - DNA, 1000 bp, mus musculus
ttttaatgactaagatttaaaagatctagcacagatgtgtggctttggtcccctgagccccattgtctagctctggttttgcttctcagttcagaggagcatatgggacaccaagaatatcccgccttcccaaggaaacctttggggtcccaaaactaagcagcttggaaccctgctagaccaatccgatcctagttggatctgctcttatttggtctactagcaacagcctgtagaggtgagttgtatgtgatcctctgagccccattttctagctctgggcttgctcttctgtaaggagggcacttgaggggtcccaagagcagcctgcttccctgtggaaaccttggcagattccaagactaaccagctcagaaccttgctccaccaatcctaccatagtcagctgcaccagccattccagttgggtccaactggggaatagtctgaataatagggaccaccaggaacacagcatgcagagtggggtctgcctgaggcacagccagcagagtcttgtaccttgacttccattgcctggcccatggcttctcccaccttcatgagaagtcctgctgccatccagccaacaccaggaaaaaccagatgcttaaagggcaacattagaacacaatcaacaggacccaaaacaatatggcaccactagagcccaggtatcctgaaagaacgaaccttgcatgctaatgaagctgaagaacaagaagcagttcctaaatccaatcttataatgatgatagaggcctttaagaggacattagtaaatcccttaatgaaataaagaaatgcatattcatacaggtagaggcattaacagaggaagcaaataaatatagagaaatacaagaaaatacaatcaaacaggtgaaggacatgaataaaattgtctaagacctgaaaagggaaaaagaagcaatgaggaaaacacaaactgaggcaatcccaaagatggaaaacctaggaaagagaacaggaactacag

SEQ ID NO: 52 - DNA, 1000 bp, mus musculus
gcagatagtgaaaaccaattgaagagccttatgctgagcactcagaaaactcgacctctgccctaaggatacctagcttctcacaggctgcttccagcccatccctaagcaggactggggcaccaagactggtgtgttcctagtagaaagtatccaagttcataggacgcacaacactggatccgtaggtctctagcatccttgacaaacctcctttagtctatacacagtaattgtagactttttttcctacccttccttccactatggacctgagttgtcactaaggaatagcccacacagcacattaaccctaataaaatccttttatctaattttgtatcagctttgtaggaactccaatgaccccattctgatgagttagttattctgggaagccctgcagaaaggaccagacaaggttccctggtgagaaaggaaaatacttcccaagggaggaagagagcagggagaaaattctgccatcctaaagggtcttttgcagaatgtactcagaattgtcgctacagtcacctttgtaatatgcaaagcagtaagaccctcaaggggactcagtctctatgaaactctgtgagcactgttgtagttatcctaaaagctagttagactcatgccagcaaggcctttttaacaaacagagcaacccattagaaagcaaagggaaagatgtctgttagaaagacggagggaaaaataaaaatgtctgtcattcatttgcatatattattagagatgcagtaaagtcataggtaggaggtgagggagaccaggaagaggagggacagcctgaaagagagtggcttccctgccacagaaaggactttactgtacaaaggcagcctgggaacagaggaactgagacatggtacagaagaagctgaggggccaagggcttggacttacagcctagatacctgaacagctgaagatgtgttctacctccaaaacactacctaagagttttaaatagtaaaactca

SEQ ID NO: 53 - DNA, 1000 bp, mus musculus
agtgtaccatcatgctatcctatgtggctttgtccctctgaacctatggtatatcaaagggcagagaggattactattttgctgtgtgataagtagttattaagtaataagtttgtcacaggtgccctgctagaagacagagacacaggaaagtttctagttaaagctgcctaccactcagggaggacacaagaagccatttttgtaaggcagtgaggacaaccaagcataggttacctgaaaacatgtagagaatgtgtctgtctttgacagggatttagggaaagagtactaaaagaagtgatgccccggttgagttttcacaagtagaggggcatccttacactgaagggaggttaagtggtgggatagtaagaagccctggatgatgtcaggtacaaggcagaggctacacacatcacacggatgtgtgctgcattgcggagtgaccagctgatgagcttcacctcttggcttcatctgtgcatcttccttattcagatccttgataggaacaagccctatagtgggtaagtcctcacgcttgcaagtgtttgatttgacaatgtaatctgcagtcttaatatggaagatgagcagagataataactgtctgggatgcaaagatttagctcatgctggagaggcaaagatagactttgagaaagtccctatttggttaggtaggaggagataaagatgatctctcgggattagttaaagagggcagaacagggagaatcgggagtgaatataacatggattctaggaaaacacaaatgaaatttacatatcacaaatctcttgtgttctcaatctgcatctaaattttggatgctttatgttgttgttgttttagttcattaagagaaaagataaaggattatgtgatgaaaggctggaaatgtttggcaggaatgtactgtatcttcagtctacagttggaggtaaaatgctgtgggttttgacaaacaagtattaaaaagcaatttattctttc

SEQ ID NO: 54 - DNA, 1200 bp, mus musculus
cagatgatatgatagtatatataagtgatcctaaaaattccactagagaactcctaaacctgataaacagcttcaatgaagtagctggatataaaattaactcaaacaagtcaatggcctttctctacacataggataaactggctgagaaagaaattagggaaacaacacccctcacaatagccacaaataagataaaataccttggtgtgactctaactatggaagtgaaagatctatattataagaacttcaagtctctgaagaaagaaattaaagaagatctcagaagatggaaagatctcccatgcacatgaattggcagtatctgtatgaccccctttcggggacccccaatctaatctcgggagagagagcacacccaaaaaaacacaagattccttcttgctgcaaacacacaaggcagtttaatggtggagctccgggtcaaaacgcatctcacataggagacagtggatttgaccccaaatctcgaaacctaggggtttttatggggtaaaagtcttaggggtggggaattcagcatagagacacactattggcttattcaaacatcagcagaaagattacatgtcagcaaaagaatacgtgcaggtcagggtgtcagggttctgtgagttgttgactcggttcagatagccctgttatgtcctcacattcctctttatctttatggtcaagctgttcccaggaatgctttaactacggggcatggccgggtttgttttttttttttttttttttttttttttgttctcagccccaggcatcctctaggctcacaaacaaccagcaatttctgagtactttatatgacttacaggtcttaaaatttcatctttctttcagatcatatatagtaaaaatggctatcttgccaaaagcaatctacagattcaatgcaatccccatcaaaattccaactcaattcttcaatgaattagaaagggcaatttgcaaattcatctgcaataacaaaaaacctaggatagcaaaaaaactcttctcaatgataaaagaacctctggtggaatcaacatgcctgacttcaactgtactacagagcaattgtgataaaaactgcatggtactggtatagcaacagacaagtagaccaatggaatagaattgaagacccagaaatgaacccacacacctatggtcacttgatctttgaca

SEQ ID NO: 55 - DNA, 1000 bp, mus musculus
tctttgaactttgccttttaaaaacaagtgtcaagctacccagctatgcaactgcatctgttttctaggctgagagatgaaggctgtgcctctctaatcccaatgatgagattgatcatggtgtgtcccacagaggccccaggatatctggagccacatgtcagcttactaggacagttgcatgggtcaggtgcagtctccaaagaaccacactgcaaggccatcatcgccacctaattttcaatttgcaaaaccctaagaagttggcatgagagtaaattatagttcatgttttcataatatcttgatgaagcaatgtaatcaaaaagttattttcatgcttttgaaaaacaagcagtgtgtctagtgtatacatcaagaggacttcactacactcggaaatcaagaaaatacagagcatcacaagaaggtccacaataccgaggaagaagaaatcaagcatagcttgtagagactctccttaaatcatatagactttttcctccaagctttctttccccaacttactccatcatcccagcctgaaacaccagtaggcagtccctgggaacctaccagccacactaggcaggatgcaaaaggctagctgccattcctgacctcttgtccctctcctccaaatctccccagttttatacccagctctgtagcaaaccacccaactctgtctccccactcctcccacatctccagtaatcttctcctccaaactttctgcctccaactcattgctttatcccacctcccaacttcagtaggcattcactgggaatcagccaggcaagcctgcaagagtaataggtagggcagcaaagcaagtaggcatgcttcaaatcttcacttactctgctaacctccatatacaaactcccagtctcattcccagttctgtagcagactacctgtgccctctagtcattctgtgatgccattccctggggactaagcagatactgatgaaattccctgctttcctctc

SEQ ID NO: 56 - DNA, 1200 bp, mus musculus
tctttctttatttttttctatttctattttgagatcctggatgggtttgttcaatctcttcacctgtttggttgtgtttttctgtacttctttaagggagttttgtgtttcctctttaagggcttccagctatttacctgtgttctcctgtatttctttaagggagttatttatgtccttcttaaagtcctctatcatcatcatgagatgtgatttcaaataagagtcttgattttctggtgttttgtggtttccagggtgtgctatggtgtggcaactgggttctgatgatgtcaagtagccttggtttctgttgcttatgttcttatcctttccttttgccatctgtttatctctggtgttagctggtcttgccttctttgattgtggcttgtccttcctgtaagcctgtgtgtcagtactcctgggagatcagttatctttgggaggaattaggatatggagagctgtagcacaggatcagctcctgggtgcacactgagatgggaaggatcctgtccctgactgtttcttgaaggtgtctgtgtcctgttggctctgggatgatcactcttaggccaaaaatttgagcagaagtggtggtcttacctgtgctcataggtttgtcagtactcctgggaggccagctctcgcccagtggtatttgggtatggagagctgtggcacagggtcagttccatgcacagagggaaactggaaggatcctgtcactggctgttcattgaaggttcctgtgtcctgttggctctgggctggtccctctttggccaggaatttgagcagaagtgctggtcttacctatgctcacaggcttattggcactcctggaagaccagctttctcttggcggtatttgggtatggaatgctgtgactgaactttatttttaatattaaaacagagaagtttttaaaataacaactgaaagcacattccaagttatctacaaggcactgctgtacctacagtgtgaccccttctgctactcatgatgtccagtttaacacacagaggacctcaagattctgtgaagtcttgcagctgtcaaaacagaaagcagaaactatgggtcagaggacatactccaaagtcaatttatgcatttacagtcttcctagcctaaagcattatctcataactttgtcaaaagttcaactttctacatttcattttctttaa

SEQ ID NO: 57 - DNA, 1400 bp, mus musculus
taggatgagcaacaacatcaagtaacctaatctctcagagctcccagggaataaactaccaaccaaagagtttacatggttggactcatggctcctgctactatgttgcagaggattgccttcttttgcaccaatgcgagggtaggtgcttggtcctgtggaggcttattgacccaaggaagggggatgcttgaagagtgaggcaggagtaagtgggtgggagggagagtaccctcttagaggcaaaggggaagggggatggaacgggggaggttgcagaggggagactggaaagggggacaatatttgaaatgtaaacaaataaaataatcaataataaaaaaatattcttaacttctcaaagccgttgccattttaccttcatgtcaatgaaggttagacacgtttaaaaatggtaacaaggcttcatttgatactatcaagtaaatagcctggcacggtgctttacaggctatgttatgaagaactgagtgtcaaatatgtcataattccatactttctcatattcagaaagcctaatttgatgtaatcttggctccacagctgcaatgattttccctgttagccccatgcccctaaacatttgaactcctttattatactggtaggtattatgtaatgaaagtagtttcaaatgaccgtaacataacaagacgtttactgctgctgaattgaaataccaggctcagcagatgaacaggttgcctagcaactgatactgcaagctccagtgactgctcatgcccactgagactgacaagggatccatcaccggttgcctgtaccttgctatttaagcaattctgagagtgagaccaaagatcctagaaggaaatgtgtgtgattaaacataaaatttgtggcatctatctctcctttttcatatctggcattcagattgcctttatagttagaaatacagtcagaaagttttctccctgaatttcttggactaaaaggggatgagaggaccatagagaatagagcaagtagaaaaactaatatttgaagagaataaaatacaaaatgaacttactgtaggtttttgacttcctgttttgtgtcagggtacaatttagtttgtctgagtcatagctcatacacacgtgactaggcatgtccaaaaatgtttaccttagaataaaacgaccatgaaatgcttcctgaatatctacacaggtggagtccccacgctccgctcactgttacatatgaaatcgccgccgtgtgtcacgctccaattcccaagcctcacagcactcagatttggagcaagagctttcttgtcactgagaatgagaccttttaaatggtctaagtaattaactcttacgaaataatcattctccatgttattccttattcgttagagctttcaa

SEQ ID NO: 58 - DNA, 1200 bp, mus musculus
atagtaatttaaaatcttcaaaatgtcttatagtccccaggatatgtctagggattggtttactgtgaattctgtgtctgtagaggaagtcatttgttagtgagttcatatgcttgctcaggtgctccctcagagcttgtaaacattatgcgtgatcacttacaatcgggaataataatgatgcaaataaaagttgtttgctcaggagctgaacaaggatgatagcaacaaaaatgccaaactagatgccagaaagccatgagacttcaaacttacacaaagaagaagaaaaatctacacagagagccataggcagctgagcaaagctgggagcaggacgggtgctcctccccagggaatgacacaccaattgccagtgctagatgaccagccctgaaaacatacatataagttacagtcaaatacatatatgcatgtagtaacaattaaagaataaaggagataatgaattcaaaggagagcagggagggctatacaagaagatttggagaagaaaagtaattaagttataatcttaaaaataaacagaagagcttctgaggcagcccccttttcgggctccagacatccagacaccttcccggccagaggataggtgtctgcccagcccgggagctctttgcctcagcatccgcagcggacatcttggtttgggactccactgaaagtgctctgcacaggtgagagtgtgcactacagaagctatcagcttctgggacaggtcctattttgggccttcatctttggccaggagggaggtccgaatgccagatatctgtgcaccttccctgtaagaggagagcttgcctgcagacagtgctctgaccactaaaactcagaggagagaactagtctcccaggtctgctgatagaggctaacagaatcacgagaggaacaatctctaaccagagacaactaaattaactaactccagagattaccagatggcgaaaggtaaacgaaagactcttaccaacagaaaccaagaccactcaccatcatcagaacccagcactcccaccttgcacagtccagggcaccccaacacaactgaaaagctagacctggatttaaaagcatatctcatgatgatggtagaggacatcaagaaagactttaataactcactcaaagaaaaacaggagaacactgctaaacagatagaagatgttaaagag

SEQ ID NO: 59 - DNA, 1200 bp, mus musculus
tcccatttctccttgttttcttcatcaagaaggttgctaactatttgaaagaagttctgtaaattaaatcagataagaagtttagtatcctctttgagaatgtactttgtgaaaaacccatctggaacaattctgttatatgactgtttgcagcattgctttacatcccgacacagtcttcatctttatgaccaatacagatgtggatgcttgcagccatccatcaaactgagcatggagtccccaatggaggagttaggggaaggactgaaggagctgaaggggttcataacccataggaagaacaatatcaaccaaccagacccccccccccccagaactcccagggactaaaccaccaaccaagagcacacatggagggacccatggctccagctgcatgtgtagcaggagattgtcttatctggcatcaatgggaggggatgccctggatcctgtggaggctcaatgacccagcataggggaatgctatggcgctgaggcagggatgggtcagtgggaaggcactctcatagaagcagagaggggtgggataggagttttgcagagggaaactgggaaggaggataacatttgaaatgtaaataaataaaataaccaatacaaaagaagtctcctcagcatcataattcctcaaacctgcatcccagtagcagccagaacaggtaagacactttttgttcacaatgacttgtcccattatcacctctactaccatctgtaatgtcatctgagagttattctttacaaatgttttattccttctctaaagaggtcacttggcacttgtctattacaagttatcttgtgaactgcaaaccaggactgctatctcactgtttatcttaggagtgtagttagagaaggacaatgggcaagcctgacctaggctcctcaggtgaagacttcctctgtcttttcctatttatggtatttttgcttttcagctaaccattgaaaagtgtaaagaaacatttaaatgttctggcaaaaagaacatgtacttttaaaatcacttgtttggatctctgacatctttttgaaggggtcaacatgtaacatgtatgatcttttaaaaagttccaaatcctttccagcatcctcagtgctaatggcaaaagacctcttgggttttaagtcttcatctagaattatgcaaatgatggtctgttttttatt

SEQ ID NO: 60 - DNA, 1000 bp, mus musculus
ttcaacctgaaaagatgcaaaataaatagacaagccaattccagaatttgatgagtcctgaccagagatctacaaagacttcccaacaccaggaaacaaacctgtacacatggggattgatcaaaaaattgaaaaatatttagatgagtgttgaaataataaatatagtggttggctcaggattaagaaaataaaagatatgcacatgactgggtataaaaaaataaatttccctttgcacacatgtttgtggatatcagtggttcctggtactagaataagaataaaatcatagctttcacatttgttatcacctttacatttatttaaacttaaatgagcattatagaaaccattctgcatgatttcaatcattattgcttaattttagcctggctttctacagaatttattcataaatcttagcatggataaaatagaactcaagttaacaaatagcagagcaggtcctaaatgtacctccaacaaaatatatgcgattaagatgaattctatgactgcttaaaatcaacatattgaaaaaaatcattgaaaactttgggctgagatgtaactcagaaaaatacatgtcccatatgcataaagccctaggtttggtccctaacaactgagctgagtgtgttggcatatttatacaatctgagcatttaggatgggaaaaagtatctgaaagttatggtaactcttggtttaatgaggtctagcctagcctgggatatgaaaatacctctgtacatgtgagcacgcgcatgcgggcacgcacaaacacacacacacacacacacacacacacacacacacacacacactcacaaacacaaacaggggtgaggagaaaagggaggagagggagagagatagagacagaaagacagagggagagacagagaggagacagacacagaaagagatagagagaaaataaatcaagaataaaaataaatgtatgattttagcccatttccccattgctgatggt

SEQ ID NO: 61 - DNA, 1000 bp, mus musculus
ataaaagagacactgcagtcaagactgcaatcccagagacataatcattatcttgcattatctgggaccaaaattgggctttatctgagtaaaatatattgtactgggtacataaattttcttagttctattactttgtctaaagtgtacatttaaatgttcaaaaggtgtgctgcaaatataatctttgtattatatttatgtatgtaacctttctagagctttctcactaagtaatcaataccacccaacaaacatattttaatacaaacctaagggttatgaaatgaagcaaatactgttgcattatgctatgtttaggtattggtccccatgtttaaacaagactatatggggcccagggtatgaaaatgtggtggtttgaatgtgcttggcccagggagtggcactattcggaggtttggccttgttggagtgggtatggccttgttagaagaagtgtgtcacggtggaagtggagtattcgaacctccacttaaccacatgggggtcagtcttctcatatttgcctttgcatcatgagatgtagaactttcagctcctccaatgcctgcctggacactgccatgcttctaaccatgatgatactgaactgaacctcagaacctgtaagccagcaccaattaaatgttttcatttataacagtgaaaaaaagaagcaaatactgttatgtattagtaagaatgctatctataacagtttaaaataataacaaatgaaaatagaccataagcttatttattatgtttctatatatcaatgtgtgtgtgtgtgtgtgtgtgtgcacatgtgtgccatgaaagcatgtgtcacagtacacacatgaaggccagatgacaagctgcaggagtgagttgtctctttctgtcatgtgagtgcttttaggagtcattattaaaccattcttaaccagggttactttaaattatggcatactccatgaagcaaatatcatgttaataattaggaagtataaat

SEQ ID NO: 62 - DNA, 1200 bp, mus musculus
ttatcaatccagtatcatctcttcctctcctcctagtatggccgcaagcaaatcctccctccattccaccttccccttctcttttgagaaccagaagctcccttctgggtttcagcccttccactacctttcccacaacacacatcaagtttcgggaggtcgaggtgcatcctcttccactgaggcttgatgtctggcagtctgtgggaggctgcaataggctcagggaaagccgttgctctagttgttggggggttgggggggaggtctgcatgatgtccaagctcatgtactacaaatgtgcaggagacctaggtacaagtcatgtttgctcattggttgatgatacagtctctgggagcaaccaagggtccaggttagttaactctgttggttttcttgtagagtccctgtcctcttctgtctattcccttaatccttctcctaactctttcttaatactccctgagctccacttaatatttggctgtgagtctctgcatctctttccataggctgctgctgcaagcctgcccctggctcaaatggacctgggtacacctgggaggcagactggagcttaaagagagagaactagatggtagagagaaaaatggagctaagtcaaggttcctgatcaaagctcaaatgtttaatagaaaactgtgcttataaaggggggaggcccatccccgcccctgcttttccattcttggagtctggaaccagctgcaggtgacaggtgcaggatagggtgtagtctcctgaatagctcaagggcctctcagcaggtagcagtgtcttgaaggagaacagcagctgtggctgaacaatagagtcatctaggcaggaaggctccaccctaggtaatctctttagtggcagcaaggtcaaagtctggatcagcctgtttcaggctgggtgagttacaggctgcattgtggagcctcccagaggacaggtatgctagtttcctgtctgtaaacataatagagtatcattaatagcatcacagaatagttcttgatcatgaactagttctcaatatgggagagtcattggttggccattccctcgatctctgttctttctttgtccctgcatctcttgtaggcaagaaacatttgaagttgaaggtttggtggatggtttgctgtccttattcctcaactgggatgctgccacttcaggatccttatg

SEQ ID NO: 63 - DNA, 1000 bp, mus musculus
tctctttgcctctgcaatcaagctctcccaataaatgtgtgcagaaggattgtgttgcagcgtcattcttgctggcaagccagggcacgtgaaagagcacacaagaggtgctaatcactcctcttttgtagcagcagttaattaacagtcaacagacactgctcatgaccagatgttctctagatgtcctttgcagccttggcacctaaaacaaaccaatctttcaaaagtcaacttcccatgaacctctttttcttccttcaatcttttctttatttacatttcaaatgttatcccctttcctagtttccccttcaaaaatccttatctcctcccacctccccctgctccccaactcatccactcctgcttcctggccctggcattctgctattctggggcatagaaccttcacagaaccaaggacctctcctcccattgatgaccaactaggccatcctctgcaacatatgcatctagagccatgagtccaaccatgtgtttttttcttacccaatcacaaggcttagaacccctgcttgtgttttgtttgtttatttgttttgttttccacctttaaaaaaccccttctcttagacttctgggttgctctcctatccatcaagaaagtttgtggcccaagctctcaagcttgaataaagactctcatgtgcttgcattggagttgtggttcctcatgatctctttggggtttttgcaatctgggcctaacatatgcatgtctgtacactatgtatgtgcctgatgctggaggaaggcagaagaaggtgacagatctcctccaactggagttatagatggctgtgaagcaccaattgagtgctaggaattgatcttgtgtcccgtcaaaaagcagtatgttatcttaactgctgagctattgttctactcagacagttgtccatagatccattatgtttttttagtgagtgttgtttctatacacacactggtggtcctcacttccaggtttaaattg

SEQ ID NO: 64 - DNA, 1000 bp, mus musculus
gcttctatctctttagcactgttctcctgtatttctttaagtgagttattaatgcccttcttaaaatcttctatcaccatcatgagatatgattttaaatctgcattttgctttttgggtgtgttggggtatccaggactcgtgttgtgcatactgggttctggtgttgcccagtgttcttggtttctgttcttaagattattatatttgacttttgccatctggaaatctctggtgtttatgttcaagctgtctctggttggagcttgatctgcctgtgattctgttagcctctgtcagcactcctgggagtccaactctcacctcagttccagtggtcagagcactctccacaggcaagctctcctcttgcagggcaggtgtccagtagtctggaactctgatccacctactgagttctggggtcagaaccctccctggaggccagctctcctttggcaaggaatgtgcccaggggtctgggtctcagctccacctcctggctggggatgaaggcccaactgaaccctgaccaagaagctctgttgcttctatctcccacatgctctcaggtgatcaggaggtcctgggtgtgctaggtgtcctatggggtggagagtcctctggtgtcctagatgcccttggcccccaatctgaatatattgcacaatatataagatattgtgggggtggggatggtcatggaatagatacaacatgaaagcaaaaccaggaaagagatgggagacaaatacagaccagaaagtgagagttgggggatgggcattggttatgggagctggagaacagaagagtaaccacagtgtatgcacggagcacatgtaacccattgctatatatgccaattcaaaagcaaaaacaaaggtgattacaaacagataagcaaatctggagttttagcacaggaaaatttcaggtttattcattggtttatatacatttgcatatggttacaattcatgtccttggttataactga

SEQ ID NO: 65 - DNA, 1600 bp, mus musculus
ctgatattaccacaaattaagtaccagacagtctaaaataggctcccaggaggaggaaaaaaaagaagccttccttggaccctggccccaggcagaagtaaggccaagatgaccaacagcatggcaccatgggtcccagtcaaggagctagccggagatgaccaccagtctggtgctgggggacagggggaacagatcatgctgaagatgacccctgcccaccaccataatacacatgaaacttaaaacttccaaaaacattcctgaggtgaccctagacaccctgtgacccttagtgccactaagatgagcaagtaagtagtggagtagtggaagaggaaaaaaaaaaaaacagaaatatgtgggcacaataaagagacacaaaactggagattcaagggtagtaaggaacagcctgatgtgagtagctggtgatgtcactttggaccaattgtagggtcctggcctggagatcatgtctgtgtctgtgcctctgaagcattaggaggtctcttaccatcaaatgccaagtggaaatctctggactgggctgtggtgtggatatactccgatgtgtctgaggtctctgcagaactaactttacctatcacctgggcatcatgggagtgctggccctagggatatgaaagcaggagagctaactttgtccatagtagcttcagtacttgggagagtggtccctgaaacttgcatgcgttgcagagtagatctgaccctgatagtggtggcagggtaagctggctccaagggtgtgcaagtaagagaactggacaaaagcttttctgccattcaagggcaggggatagatattctctcccactcttgctctttgccatctatagtaccctgaagagatggccctgaggtcatgaaagcagattcagccccgcccctcacctattgaagcactaaggagagtggacccagtgtaccttgcttgggtagcacagtagagatgacactatttgcatgggttgctggtgagctggccccaagggaatgagaatgggatatccaaacggctgaccagctcagacacctctcagggccagattaagaactttgaattagcctaccccaacatctaccacattgaagaactgttggagtgcatgaaggcactgctcatacagatccaaattatagtatctccatcaaacaggacaacaataggatgtctgagaggggtctcagtgtcatttcagtatggatagagaagcaggacccagaggtctcattctaatccaaatagccattgcaatgaaatttgcaaacaaagaaatatgtgcaaaagtgtatactgtgagacacactgagataaactacagcttctgcaataatttgttttttttttttaagttgggtgaggtattgtgacggtggagagaaaatatgatggggggagatgagtaggactggggtatatgatgtgaaattcccgaagaaccaataaaaaagctttaagaataaggagaaggaggaggaagaggatgggggaaggaagaggaagagagggaagggggaggaagaggggagaaggggagggggagggggaggaggaggaggaggagaagaccag

SEQ ID NO: 66 - DNA, 1000 bp, mus musculus
attcctctagaacagtgactctcagccttcctaatgctgtgatcctagaatacagtgcctcatgctgtggtgacacctaaccataaaattcttttgcttgctacttcttaactgtaattttgctactgctatgattgtaatccaactatctgggcttaggtgatccttgtaaaaggattcattgacctccaaaagtttttgcaacttgcaggttgagaacaactgaaggctctttctttactttcttttctctttacactgaaagtcggcttgttttgtttggggctcactgtgaggtgatgcttcaagtgttaaataacaggctggcgttagtaatgtggcaatctatgaatcagcacatctgtgttcatgctgatgagttcatgttcatgctcatgagttgaaactcatactttgtctagaatgaagttgatctgttcgtttaagatccctcaaagaagcaagaacaatataagtatagcaacttatttttatctctcttacagtgtacactgactgcatactctatatttcttcacagaaattctcaaaaattcccattcattagtgtggtggcttgaataagaatgactttctaaagcacatgtatttgaatgcatagggaatggcattttgaggtttgggagatgttgaagtagctgtgtccttgttggaaaaagtatgtcattggggggttggctttgtgccaaaggcactcactacctgtttgtagatcataatttacctcccagctatttctccagcaccatgcatgcctgctgccatggtctcagccatgataatcatggaccaagcctctctaactgtaagcttccagttgaatgtctttttttataagcattgcattagtcatggtgtgtcttcacagtaatagaatagtaactaagacaattaacttatcataattgattttcttaatagttaaccccaaatccaaacattactaattattcatttccacctattcccttttgactgc

SEQ ID NO: 67 - DNA, 1400 bp, mus musculus
ctacttgaacttttgtatatttatttattactggtaacaacattctaggaactaataaataccatgctaggtaggaggtagtttaacacactaaaaacttcttgacaacatgctacatactaggcagcagatgttggtaaaggagatggttcaagaataccagagaatttgggactacctatccaaaagtaaccctcctaggagggggcatatatgagcttacacttgtcttctgtcatctcacagagaggtggttttttatttgtttgtttcttttgttttgctttagaagtatactactctgtcataagaaatgttgtatcctaagtattattttgtcatttctcttggttatatcagaaataacaccatttgtggaggagagcctttgaataacaatagaagtcactgtgtttgtaagaagtctatgtctgataaaatgctgtgttactcacctagttttcatagtggaactactgaagggtgtgtgtgtgtgtgtgtgtgtgtgtgtgtgtgtgtgtgtgtgtgtgtgaataggctagtaccacataatatatagcaactctaacttaaactgattcagttaacctgctgaagtggaaatttctcatttcttttaacaacacagttgtgtcacttgatatctttctggaagctgccttgggagaggatgcgatgttttgcagaaaacagacacttggggaggggtgcatgatatttaaaagaatataaatggaacgtcacaaacagtgaaaggatgctcttgcattgcagctccgtgcagagcttcacttctctgctggtgcttgctggtatttgctggtcgctgctggtcctgacttcatagagagaaagacaccaaagacatttttgtggtattcgggctgattctggccacttctttgactattgctgatttggtggagccttgcagtttctattgtattaagctgccatagctgattcatgtttggtgtttgctattgatctggactgctggtatcttgacaatgaagagtggaattagcctaaaaaactactcctaaacaggtccacaatcccctttttttattaaccttctttctcctctacctctggctagaatggaggttgaagtatttaagaaccctaagtaaactaagttttaaaaagtctaagactataatgatagcattgttttgttgagttcagtcttgttagaacaaatggttgaagagccaaaaattgaatccagagttatcctgtatccttaaactggagttcaaaactacctacaaattgaaggaactgggacaatacacagtctgtaaactaatattttacatgtgatggaaaaactgggagcaagaagaacacagccacatcttcaaaataacataaagttataagttgcatgaaag

SEQ ID NO: 68 - DNA, 1000 bp, mus musculus
aaagtaaggtgggaacaagaggagtaggagattaggtggagcaaagatgtataaagatacaactggtactgggtcatctcagggataagctagaaaccaaatgcaatgaatactcccaagaatctataaaggtgatcctacggcaattagtaatggaaatatggagcctgaaatgccatcttctgtgttcatgcaagactccaagtggagggattgaaactctaactcagcccctaaaccttcaacctacaacttgtcctatctacagcatatactgtggtacaggtggtacagaaattgtgggagtggctaactaataactggttcaattagaaacccatgtcacaaaaggggtcccatccttgacattgccatgagggccaagacccagatgatggaaaagccggagacttaggatagaatcaaataagacaaaaggaaagtcactaaaattatttctaatgatatcgtgttatactcatcgttgatgcttagtccagttatcatcagagagggttcatccaacaactgacagaaactgattcagagaactatttccaaacattagggagtcaggaagtcatgaggaggaggtgaggaaggacagtaggggccagggagattaggaacatcataggacaaaacacaaaagcagttatcctagtctcagagaggatcacagagacggaatggacaaacagggatcctgcatcggtctgacctaggacctctgcatgtatattacagatgtgtagcatgggtttcttgtgggactgctcacagtgggagcaggggcaatctctgtttcttttctctgcttactactactgagatgcctcttccagctttaatatgaaggaggtgcctagtcccattacagcttgctacgccctatttggtttatatccataggaagcctgtccatttctgaagataaaaggaggattagatagggaaaggagataaggtaaaggttctaggagaggaagaagaagagaaa

SEQ ID NO: 69 - DNA, 1400 bp, mus musculus
ttttagatagaaaattgacaactaattttttaattaaaaacatcattagtatggaaaagctaagagtacactgatatttttttgcttagttttcttttaaacaagtttattttgtttgcttagttttcttttaaacaagcagcccttcatgaatattcatacatacatacagtttgatatatttgtaaaaccaaaatttgctaattaaatgaatacatttgttgggcatcataaagcatatggaaagagcaagaactcctatttatatattacttaacaaacttattgacataacgatgcgtgttttaatataactcctgggtatataggctagagaagctggccagagacatggaagattatctgtgtttcctatgtctgcttctatgtaacctcccccctcagcctgaaatcgggcagatcaggtttgactgttagcataaggagagcatcggtggtggagcctgccaccctatcattctgccactcccactgcgactaccttgccacctagctgttttggagccagcacgtggtcacctgaaactggactccaaggatgatttggggggaatgggccccttccccttcttcataacccagtgtcttggaaatagtaaaattgatccttgatcagactgatgtcttggttccactctttctctcgctgcctagttccctcttttctttcagattccaagatgcctcccaggctagaacccagacatgtgagccgctggtcagactcaacagattggcgaaccaactcgggactgggaaatggcagaggacatttggaagaagcactgctggtttggagctccatggaagaagaaaataaataaggaaaattcgtactggagaaggttggtacaggttaagatgaaacggagctaaaccttcacgctaatttcacttaggttaagcagtgaaattctcaggatctaggaataacaggcagttagccgcagcttgcagaagccgcttttttaggcgtgagaaaagaaagggtttaataaaagggatttaataatcaggcagatggcagcagtcagaaactgcatcaggcagcaggaaaatgtcccagaagcagagagaaatttcaggggtgccctgctttgtactctctgggccttacagcagaagttctctgccctctttgtgttttggtctgaggtcttgtctaatgtctgttgcaccaatctgttcacatgttcaattcatgtatgttcatgtccagtctgaatgaatgaattttctatgttttatgttggataataaagatggctaaaactttatctggtggttcatcaaagctgagagtggccacatgctttaaccaagaaacagacacacagcagtagggcccctgctggagaaactgttcttaaaagagagag

SEQ ID NO: 70 - DNA, 1000 bp, mus musculus
gggcttcattacattcaggaaagaagtaatcaggcaaaccctcgcgagaaacatcatagctaacatactatgaaaccctcctttttgtccctgactctctaaggcaagggctattgaacagtttcttatttgaaaggaaaactattaggttttattacagaattcaaaaggatatacaccagttttatttgatctttttggctgagaaaatataactgtttctgtaaaatgttcaatcatgttccttgttcacagcaccagacaagagtcagaagagactatcacaggatctgtcccagcaagtaaaggaacagccaagttagtatatacttctctcttggaaatcccaacattcataataaaagagaaagaaaaaaccaatataggtagcttaccagaactatctgaattccatctagcatttaactgagcatacaaaaagtattcatgtgtctactaactgatatctattagaccgggaaaagacctttgaagtattacaaatgataaaatgagatgattatgtaaaggtactaaatatgaatagcaaaaaaaaaaaaaaataaggatgcttccttgttgacagcaggagtaacaggctttctgagggataaatcccctactgggctgtccaatatcaagtgatcagccctgacatcattactgccctataaatgaccccacaagtagctaaaagaatcagatgcagatatttgcacccaaccaatggacagaagcagctgatccctgttgttgaattagggaaaggctgaaagaagctgaggaggagggcggccctttaggaggacaagcagtctcaatcaatctggacccccgaggtctctcaaacattggatcaccaaaaaggcagcatacaccagctgaaataagccccccaacatatatacagtagaggactccctggtctgtgttcattcagagatgatgcacctagccctcaagagactggtggccccagggagtttagaggtaaggtgga

SEQ ID NO: 71 - DNA, 1200 bp, mus musculus
acgactcaatcccacttgggaaagagaagaaaacaatcataagtggggagcggggggaggaattgggagggaaagtggacagggtgggagaaggagtagggggtagaagagggaaacctcatctggtattgagtgagcaaaatggactaaagccctgagggccagaagaaagaatgtaaacaggaaacctcaggaaataggactctgggggtacctcccaagatgcaccagagacctgggaggttagagactcctggaactcaaaggaagttgccttagatgaactgcccatcagtagggagagggaacttatagtgcccacctccagcaggaagacaggacatcaagtgagggatggtggttgacatcccacagtcacatctctgacccataattgttcctgtctgaaagaaattacaggtatagaaatggagaagagcctgtggaaaagaaggtccagtgacaggcccaaagtgggatacatctcaaggggaggtcccaaggcctgacactattactgatggtatggagagctcacaaaaaagggatctatcatgactgccctccaaaagacccaacaagcaggtgaaagagccaaatgcagaaatttccacccagccaagggacagaagcagctggtccctgttgctgaattagggaaggctgaaagaagctgaggagaagatcgatcttgcaggacgacaagcaatctcagttaatctagacccctgagatatctcaaacagtgaaccaccaaacagatagcatacatcagctgatttgagatccgcaacacatgaaaagtagagaacttctgggtctgtgttcattcagagatgatgcacctaaccctcaagagactagaggctccagggagtttagaggtcaggaatggtgggagtgggggcatccatgtggagactgggttgggtagggaggaggtgtaagaaatggaacagacagaggttagatgggtggatgattaatggactatggggtgtattataaaatttaagaaaaggaaaagaatattcacaaatgaaagaaaaagaaacataactttagaaggaaaagaaacttacagaacaccaaatagattgctccagaaaataaagattttgccccataagaaaaatgctaaacatgaagaacaagtgaagaatattaatgctgcatgataaaaaaagccaagtaacttac

SEQ ID NO: 72 - DNA, 1800 bp, mus musculus
gtgctaaaagtgataataaacatagagcaaatacttaaatagagatttgaaaaaatggagacaggtaatatataggaagaaactaaaataagaacagtaaatatgtgtaaccacaccccacagctgctggctgccatgaaattatatctattaaaaaaaaaaagcaaaacgttcacaggaatgaggagtgcatatgaatttacaaaactttacagaacatttaatattgctagaagtctgcaattagcaatgggattaagtatggttataatcataggtagtctttctatgtctcagcattagtggtctattatagattgggggtcataattcaagattatgcttcactatgcacttgtatatgcatacatctgtatatccgaatagtaagttgtataagtcattataatattcattgaatacagcctatatcagtcttcagattctaagttttgctaataatttcaaaaatattttttaattttttaaaattaaaataagatagtatgcattttccctctttctaccctgtctaacccttccaatgtatctgtcctatctctcaaattcattgcttgcattttttgttacattctgttaaagcaaattgttagataagtattgtgactaatgaaagctctcaaccccaattaaaacttaactgccttccccttggaacttggagaactctgtcgaagaagggaggacgacttgtgggattcaggtgttcacagatctcatatgggttcacaaagactgaagtcccagttcctgcataagtctgtgataggtcctctgcatatgtattgtggttgtgtagcatggtattgtctgtgtgactcctaacagtggagtagggatgtctctgacattgtctcctgccctagggacccatctcctcctactgggttgactcacccacccttgatatgagggtttgagcctacctttatcttgtcatgctgtgtttggcttacaacactggcaggcctgctcttttctgaagggaagggaagaggagcagatcttgaagagagcgaacatagaggagactgggagaaaaggaggaaggagaaactgtggttgctatgtaacagatgaaagaggtataaataagtaaaaaaagaaagaactaaagaacaaaagagggagatacagaaagaaaatggtacaaatctaaaagttgagcactgagtcaccagtggaggagctagagaaaggacacaaggagctgaaatggtttgcagcctcataggaggaacaacaatatgaactaaccagtaccaccacagctcccagggactaaaccaccaaccaaagggtacacatggagggacccattttactctcacaaaaacagatatgtagaccaagggaaaatagaagccatagcaacacatatacatccccagaatcatgtcattaataacaaaatgtgggaaatagactctttaaaaactaaactgtgaatcttgaaaaagaagataaaaatgtgccaaattgtaattgctgaaagttgtaatgtaattcaagattgtagaccttgaatttgctgagaaggattcagtagagatggctcagcacttaatgtttactctttgttcagaggacaaagtttgtgttagatgactcacagtttttatttttccaaatccagtatccaatatgttcaggcacctgaagttatgtacacacacacacacacacacacacacacacacactcacaagtatgataataatacatctttgaaaaaggcactactataagaaaagaggtaaaaatcctttaagctatggg

SEQ ID NO: 73 - DNA, 1000 bp, mus musculus
tccacccacgcacccacccacccacccacttctgtctttctgccctggcatttgccttcactggcgcccaaagaccttttgtctcactgatgtacaaggccgtcctatgccacatatgcagccagagccacgtgtcactccatgtgtagtctttggttggtgatccagtccccaggagtttcatcttttgaagcagtatttaaattcagtcagaaagtgattggttactacaattatgctcatgtatattgtaccaattgacatgtctcattaagttagttattgctttagttctcagggttcccagctagggaagattcatgctttttattttttaacaatttttattagatatttttttcttttgcatttcaaatgctaccctgaaagtcccctatagcctcgccaagccacactccccaacccacgctctcttgcttccaggccttggtgatcccctgtactggggcatatcaagtttgcaagaccaaggggcctctcttccagagctctgggggtactggttagttcatattattgttcctcttataggattgcagaccccttcagctccttgggtactttctctagctcctccattgggggccctgtgttccattcaatagatgattgtgagcatccacttctgtatttgccaggcactggcatagcctcacaagagagagctatattagggtcctgtcagcaaaatcttgctggcatatgcaataatgtctgtgtttggtggctgattatgggatggatccctgagtggggcagtctctggatggtccatccttccatccatgtaaaaggtgagttctgattgacatattataagaaatatatgatttgattatccctaagtatagcagtgattaaatatgtcatgttgaaagagaaataatcagaataactcagtactcatggagactatagcattacttttctatgcaaagtagtgttgtgatagcctatttgattttcaatagatttgtta

SEQ ID NO: 74 - DNA, 1200 bp, mus musculus
atatttattaagttcttcattctacctttgagctctgtaataccaaatattttatacttgtatgttcatatactacattagacatgtctttgctaattctcatacattgaaagcctctaagggattatataatgaaaacacctgtctgtaattgtagcttggctcagcccaagcttacacctttatctaatagaattctgattattgtaaacaagattgaagaaagtcaaacataggtcaagaggcagagcaaacaaccatttgacagagagtgaacataagaaaaatacagacgttgaggaactcaaggggatatacagcgagatgcacaggaggtagaatggagagacattaagattgggaggatttataagacagtggattagaagaactgttttgttttgttttgttgttgttgttgttttctttctggtatgtcagttgaggaggaagggtcagttgggtgttttctctgcctctcagccagcaggattctccccccccccacacacacacaccacactcacacatacatacaatacaatacaatacaatacaatacaatacaatacaatgcaacttaggatcaagtagaatgtagtaaatggattaatatccctcagcatatttttattacaaatatgattctagtggtgtctttaactgtggcctagtagatagatattctctgctataatatatattgagatagatatatgggcagatatagatgtgttgggaggtgagctcatgtgtctgtttgtctgtctgtctgtctgtctgtctctctctctctctgtctgtgtgtgtgtgtgtgtgagagagagagagagagagagagagagagagaggattctcagaaatcttgtgtgcttacatatgaaccatataagtaaactacttttcagatagcacatgcataatctggagcaaataacatttataaaatggtacaaacagaaaaatgattttcaagatagggaagtagaatgattaatctcttttgattgggtgtttcttttatttttaggggagagaaaaatcacattactttctgatttcatatttttaataaaacaaaaacaatccatttcacttccaggtgtgtgtgtgtgtgtgtgtgtttagaaataattggttatatcagaggatatgttagagtcttcaacattaatgtcctctgtgccaaagagatttacc

SEQ ID NO: 75 - DNA, 1000 bp, mus musculus
agtagggaaattacatttatcaattattaagaaatgattttatggtgggggtaacaacatcatgaggtgtggtgtaatacaactgcattgaagggtagaagcattaggaagggtgagaacccctgttttctgacaaatcaactgtgagggttgacagcaaaagggatttctgatgacaatacttgtccaatgatacaaatctctctctctctttctctctctctctctctcactctctctctctcacactcaaacacagacacacacacacacacacacacacacacagacacacacatacaccacacaaaataaaatttgaaaattggcaaatatctagctagcaacaggatagatggaaacttgagttttctttcctgtatatgtaggaaaattatgaattgatgacttgcattgaactgtatttttgggcaactggatgtggaatagaggaggatgctcacagacaaccatcgtactgagtatggggatcccaatggaggggttagagaaaggactgaagtagctgaagaggtttttatctacataggaagaacaacaatatcaaccaaccagaacccctagagctcccagggtccaaatcatcaaccaagaagtgcacacagagggacccatggatccagccacaaaagtagcagaggatggccttgtagggcatcaatgggaggaaaggctcttggtcctgtgaaggctcaatgccccagtgtaggggaatgccagggtgaggaggtaggaataggtaggtaggtgggaaagcaccctcatagaagcagggagagggggatgggatagggtatttctggaggggaaaccaggaaaggggataatatttgaaatgtagataaatataatatccaattttttaaaagaaggaagcagaactccaactgagggttttatttctgaaatgactcatgcctgcctctatattcttaacaatactagagataaaataagaagaaactattctcagattttt

SEQ ID NO: 76 - DNA, 1000 bp, mus musculus
aacctaggagttgtgacaatataatacttacttgtttttatggatagctaactttacttagcatgttttcatccatttgcaagcagggaaccttagttaatacacactgtgtgaagtcaacttaagcattaagaacaaaagttaattaactattaagataaaactgatagagttatggatataaaaaaagtttgataacaatcccattattagaatgagtagcttatgtataaatcaagggtggaatattatatgctacaaagtgaaaaaattcagttttgagaaatctacaattatgacatttattttttattggttattttatttacttacatttcaaatgttatcctccttcccagtttcccacacacatatcctacaccattctcctttccctttcttctatgtgggtgctcccccccccacacacacacacacattcctgcctcacaccctgtcctaaaatcccccttgttggggcatcaagtctccacaggaccaaaggcctatcttccattgatgtctgacaaagccatcctctactacacattctgttggagtcatgggtccctccatgtgtactctttgcttgatggttaagtccctgggagctctgggggatcggtttggttgatattgttgttcttccaaacctcttcagcttgttcagtctttcccataactcttcctttggagtcaccatgctcaagctgatgtttgcctgtaagcatccacatctgtattgggtagggtctggcaaagcctcccagcgaacagttgtatcaggctcctgtcagcaagcacttcttgccatcaacaagagtgtctgagtttggtgtctgtatatggttacagttttaagtaacaagtcaaatattccctaacaggagtccttgatattaaagagttatattatactttgcatctaattccccatgaataagaaattaaaagtacagcactaacaaaatgtatgtctattgctatcatgtcttaatat

SEQ ID NO: 77 - DNA, 1200 bp, mus musculus
ttttttttttttttttttttttttttttttttttggtttatgagacagggtttctctgtatagccctggctctcctggaactcactttgtagaccaggctggccttgaactcagaaatctgcctgtctctgcctaaaatgccttttacattaaggcagttgtgtatattttgggggacttctctagaataaaataattaaaacatgaagataaaaatcacagctgatgataatatttgtagattaatgtgaacttgtgaactctctttgcaggtctggagcctgggtatcctggtctatctccccagcagagggcagcacaaagtctaccttcttcatcttccatattaatctgcaaatccctctctacgttgttatcctttctggggtcggactcagggaaaacaccatcatcttcatcttcatcagtgtcctcttcactccactggaccctagctgcggtgtctcgggccctctgcttcagagctgctcttgcagtaagcaaaaacttttcctccttatccctggagatgagagatggctccacagtcatccaccataccttcagagcctcaaagacgcccctgggtcagcacaccatcttccccagtcttcctcctcgtccccatcactgttctgaattggtgctggacacttcttacctcgagcctgagcagctactgtgaataactcttcaagcaatgttttgaccccaggagacttatttggtttagagacttcacgagaccctgccctcttcttggctgctctgtttcaggcactacttcacagccttttgaaattctcatcactagctgcaggcaaaaatctgagcagtttggtctcttcacctttctggttttgggccttttggcctgacccatgtgtctccttcttcctaggatttaacttgtgcccagtgttaactgaaggctcagcttgcctggacctggttgaggcagacccagtacctccagccaaggcctgtgccacgtggtcttgaggaagagctgggattacattctttagtattataatcagcgcccttgagacaaatttaagctggtcttattattttaaggaaaactacataggacatatgttctctgtggaagtgatattatgtcagtcacatatgataagtgccaaacaatcaaagtcacagtttccagtgatagggctcactttaaagctaaaggtt

SEQ ID NO: 78 - DNA, 1000 bp, mus musculus
atgttttaatgagaattaaattaacaaactacataatactggagtaggttataacttaaaatacttaactagtccattagcagagtgtttctataagaatgggttagtctggaaagccctaaagtccttctggaaacagtaagacacaggcttagtaaatctttacagcatcagataccagtcaaaaccaaataagtaactctgaatactatggttatatacctataccaataccaatacattgtctataataagtagaaaacaagactgacctaactgctttttgatgacaacaaccaggatcagattcttctggctaagcaactagtcttcagcttatattttttatttccaactctataaaattctcaactgtacacagttttctccccaaaacagggtagtttctgattgttattgctatttcatataattttgagacaacttgttataaatagacaaaatatccatatagtacacaaagtcagattttgaaaatggcttgttaatattagcaaacatatgcaatgtattatctacaatatgctagtataattaaaatctgttgtactataatgtaggatcaaaactctttatcaggaatgtctctagaaaatcatttgttcagtttaccaaggtgttgatatgaacttctgtgtttgaggagggtgtatctgcccaagtagagggctagatcccatccaggacctggtacagggaggtgagtgggaggagtttgtgggttccacagaaggtagggagagatgggaggggaggatcctgctcatgatctgttgtagtggtagggactatcctcaaaattgggtctaggggaaaagggagatacttcttgataaaatagatgcatataatatgtgtgtgtgtgtgtgtgtgtgtgtgtgtgtgtgtgtgtgtgtgagaaaacaaatagttaaaatccataaaaccattttctaaaataaatttaagaaatatttcatcaagataaagcctttgttat

SEQ ID NO: 79 - DNA, 1200 bp, mus musculus
tatgaaatgaacaatgaggacaataatatgtatcacaatgaagatgaggaaaacttcatgaagcctcaactctacacaaagtactctgggtatataaggacagaagtcatcatcacatatattctagcatgatgaatctgcgccatttaaagagaatgccaagtttatcctatgcattgcattgttttttgcaaatgctgtgattttatttatttatttatttattcataaaaataattactatatttatttataaaccaaatgtcccaatcccacccccaccccctgattcccctcacagagttcttcacccccatcttccttcctctctgagaaattgctctctcctctttcctggtacagtattacctacctaattaggtgtatcttctcccactgaggacaaactaagcagtcctcttccacatatgtggcagtggcctcaggccagcctgtgtatgctcttggttggtgacttagtctctgggagctcccaggggtccagattaattgatactgctggtattcctatattggttgccattcactcacctctttcaatccttcccctaactcttccatagaggtctatgacctcagtctgatgattagctttaagtttctgcagctgtctcagtcggctctgggtagagtctctcagaggacagccatgctaggctcctgtctgcaagctcaacatggcatcagtaatagtgtcaggatttagaatcatcccatgtgatggatcctacattgagccagtcactggatggctcatcctttagtctctgctccatttttggtcctttatttccttttgacaggaacaattcttagccaaaaatttgaaggtgtccctgtccctccactggggaccctgtctaactactggaggtggtctcatcaggttcaatctccctactgtttggcatttcagctaacaggtttcacccccattgagtcctgggagcaatggtttacagctatcactctaacatgccgtagaatctgggctccatattagaaacgtttggagcactgatctatcaagattaaccagtaatattaatgcagaattggtgtgtttgaaggaaatgcaagttttcaaagctcaaaacttttctatgcatccactattagaaatggcaaatggggaggcattagaaggtgatttgcaaattcttactaccacggcttaaa

SEQ ID NO: 80 - DNA, 1400 bp, mus musculus
atggagtgagaaggactatggctggagttggaaagtagataagaatgggagttaggatagaattacactttaattttaaaaactaataaaaatagaaaaaataaaataacctacaaaggagttttatttaaaggtcatggtactttctgtagttttcagataatttcttcggtggttatctatgacttaacttatttctagtgtttaaagaacctgtcaaaaaatttaaatactctgctacataagtgtcagggcctttgggccagactgtttatgctctttattggatagcttagtttctagggtactttcagcaggtctaggttagttgacattgttgttcttcctatggggacgtcattcctattcagttcctttaattcttcccctaactcatctgtaggggttcctgacctcagcccaatgcttggctgtgagtatctgcctgtgtctcagtcagctgttggtagagactctccaaggacagtcatgctaggttactgtcttcaagcacatcattgcatcagtaataatgtcagggattggtgcctgcccatgcctaatcctgaagagacttgatgccctagaatggggagtcacgcagggggcaccatctcagaggctaaggggagggggatgagggaaataactcagtgagtgggaatgggggagaaacatttgggttgtgaataaacgaaaaataataataaaaagtgaacctggcctgagtatcaactgcagacatcttggttccaggactccgccacagtattctgcacaggtgagagtgtggactacagaagctaacagcttctgggacaggcaggatccacagagcttctgaggcagcccccttttcgggccccagacatccggacaccttcctggtcagagaataggtgtctgcctgcccaggagcactttgcctgagtatctgcatcggatatcttggttcctggactctgacacagtattctgcacaagtgagagtgtggactacagaaactaacagcttctgtggcaggctgaagcaacacagtttctgggataggtcctgcttttgggcttattcttcggccaggagggaggtccaaacaccagacatctgtgcacctttcttgtagagttctctgaccactgaaactcagaggagagatctagtctcacaggtctgctgataaaggctaacagaaccatgagaagaacaatatctaaccagagacaactaaatcaactaactccagagattaccagacggccaaaggtaaacataaggatcttactaacagaaaacaagaccactcagcatcatcagaacccagcactcccacctcacccagtacagggcaccccaacacacccgaaaagctaagctgggatttaaaagcatatctcatgat

SEQ ID NO: 81 - DNA, 1000 bp, mus musculus
gtttctctagcctcattggctctttcctccccccaacccccatcctcttctatagagttatctgagccctgcagaagacagagaggtttgttggacatatctcatagaattgtgagttacaagatgtaactgtccctgtcttagtcaggaaaagaaacatcatgactaaaaagcaagttggggaggaaagagtttattcatcttacactttccatattgctgttgatcactaaaggatgtcaggactgtaactcaagcaggtcaggagctaacgcagaggctattccaagcttttttccccaccggcaagaacacgctcaggacaacctgaatcttctgcggcaaagctgttattgcttacttatcaggagggaagaccccgaaccgggaaaatggtgctgcttatatagcccgcagtgtgacgtttcagcacctgatgtggcgtgacagctcctgattctttgctcgcccatcaccccattactacgtcgcgagatgggcagtgactaggcgtgagttcactcttgcacttgcacataaggcttgtttactagttacgcgcagtggaagccatcaccatcttataatggcgattgcttgcagcacgcatgcaattgctcgcagcatggctctccacaagaggccatggagtgattttacttactagcttgctttccctggtttgctcagcttgctttcttatacaacccaagactaccagcccagtgatgcaaccacccacaaggggccctgcgtgccttgttggctaattgagaaaatgccttacagctgcatctcataaaggcatttccttacctgaaactcctttctctgtgattactccagcttttgtcaagtggacataaaaaaccagccagtacatgtccctatattcctctcttattcatttactattctagccatgaactttggcaacattgatatttgaactgaccctataattttatccttatctggggtaacttatacttgtaatacc

SEQ ID NO: 82 - DNA, 1000 bp, mus musculus
aaagagaagtttgaataaaaatattttaaaacaatgatatacatagaattttttcatcttttcaaaaatttttattagatattgtctttatttacatttcaaatgttatcccctttcctagtttacccactgaaaacccaatattcccttacccctatccctgctcaccaacccacccactccctcttcctggccctggcattctcctgtattggggcatagaaccttcacaggaccaagggactcttctcccattgatgaccaactatgccaacctctactacatatacaactagagccatgagtggcatcatgtgttttcttcagttggtggtttggtccaagggagctctggagatactggttagttcatattgttgttcctctatggggctacaaaccccttcagctccttgcgtactttctctagttccttcattagtgaccctgtgctccatccaatggatgactgtgagcatccacttctgtatttgtcaggcactagcagagattcgcaggtgacagctttcttgggttcatgtcagcaagctcttgttggcatctgaaatagtgtttgggtttgatggttgtttatgggttggaaccccatgtgggtcagtctctagatggtcattccttctgtctctgcttcacactttgcccctgtaactcattccatgggttcccccttctaagaaggatcgaagggtcttccttcttcttcagtttcaagtgtcttacaaaatttaccttgagtatccccaacttgttagctaatatacacttattagtgaatgaatatcatgtgtgattttcttttatttcttcttcttcttcttcttcttcttcttcttcttcttcttcttcttcttcttcttcttcttctttctcctcctcctcctcctcttcctcctccttctcctccttcttcttctttttggattgggttatctcactcaagatgatatcctacagacctatccatttgtctaagaatttc

SEQ ID NO: 83 - DNA, 1600 bp, mus musculus
gtaaacaatattaaattgcatgttaaaaattattttatttgtcattattttacttgccccttatcagctctaacctacagaactggtatgttataattaaaaataataggtaatttttttaatttttaatttttattttttgggtttttgagacagggtttctttgtatactctggctgtcctggaactcactatgtagaccaggctggtctcaaattcagaaatccatatgcctctgcctcccgagtgctgggattaaaggcatgcaccaccatgccgagcagattattttattttgacaggacaaactttgaacttctggtgtgttggaagaatagaaaatactgttttaaaaataagtacattgtacatgcaaaatgcagagtaatttgaaaacaatcacttatttttgtatccatttgaacaaagaagtcagaataatattaacaacaaaatcattgaaattacataattttcttgaaagctgttaaaaatgaggggcttctctcttagaattgggaacaaaacacccatggaaggagtttcagagacaaagtttggagctgagacgaaacaatggaacatctagagactaccacacccggggatccatccaataatcagcctccaaactctgacaacattgtatacgccagcaagattttgctgaaaggaccctgatatagctgtctcttgtgaggctatgccagtgcctggcaaacacagaagtggaacagtcagctattggatggaacacagggcccccaatggaggagctagagaaagctccccaaggagctggaggggtctgcaaccctataggtggaacaacaatttgaactaaccagtacccccagagcttgtgtctctagctgcatatgtagcagacgatggcctagttggccatcattgggaagagaggccccttggtcttgcaaactttatatgccccagtgcaggagaacgccagggccaagaagtgggaatgggtaggtaggggaacagggtgtaggggagggtatgggggacttttgggatagcattgtaaatgtaaatgaagaaaatacctaattaaaacatgggggtctaaatgtctaaggggagagagagtgggtacctaggctgaaattactggaaaaccattagagtagaagcaaaataaaataaatcatttaatcactttatgaaaaagagaaaatgtttgttgctaacaaaaggtccacatattttgttaatctttgtcttaaccaccagcaaccatgtcaataaaaatatgtcagtggaataatgattttacttctagttgaattaaaacaaagaaagtcatgtaaaaatccaattcagctttattctgcaaacatattcatccaatcatcaaaatgtccatttgaaaaaaagagtatcttttttttaaaggtactctgtatacatagaaatataaaaaattagtacagggaaaatttaacctattttctttgcgaaaggagaattttaaagtgctgtcttcataagaacacaaaatgaactgataacgacgcattaggaacttgtagtattagtttaatcccgcctcatgttgcctgagaatttgtctatagct

SEQ ID NO: 84 - DNA, 1200 bp, mus musculus
aaccagactcctggcagaagttgtgttccactcactagaggtcttaggatctcgtgtggaatcctgtgtgggcccttgcgggtgtcaggcgactccgctggcaaggtagcccagggctcgagtggagcggaagggacttgtgccccagatcaagcccgggtagcctgcttccctatgtactgcagtctcaggttccgcgcgattggattggggaaggcgctgtgttccactcaccagaggtcttaggatcccgtggggagtcccgtgtgggcccttgcgggtgttgggcaagactctgctggcaaggtagcccggggctcgagtcgagcggaagggagaatagattcttttatgctctgtctacagcgtgagcaaagcccatgtgatgttggtagccaggagtagtgcttcatactgcttgtgacttgtgtgagagagaagcaggtggaaccaaaagtactgatggaggactcaggcaggccctgccgtggttctgcttcagttagagcaagaaagctcatctattcagctgtgtgtggccacatagctcatgctgcctcccacatgacctcagtgtgtatcctatacttctgctagcttgacagccctcatatatactcaatcaatcctgtaccttccagagaattccctattccatccatgtgctggttcctgtattgacattctattctgtctttgtcctgtcacagtgcaagatatgaacagtgccttcatagggtgagtattgactcctctgatcctggtgacattcctaaccgcaatcctccacacagaggcacatgtggtcttccaggcaggtaagctgacacctaggttgtttttggatcacgaattttgccttcacacaatccctcccactctcctcttgctttcctacaagatgtagagaatggagtgagggcagcatctccgggaaccacccagtacaccacactaggccactgtactgatcttctgccctgtactgttgttcagtaaatggtgatctcattctgaggttgacagagggcgtggcattcacagcactaagggtcacagaggcaaggatgtggctatacgagcctcattcattagagacactttagtaaagctcaaagcatacattgcacctcacacaataatagtgggagacttcaacacaccactttcttcaaaggacagatcgtggaaacagaaact

SEQ ID NO: 85 - DNA, 1600 bp, mus musculus
actgctcttgataacttgagattgagtttaccaagggaataagagagggtattggagaggtgatgatattaagacatgtgatccacatatgtgcatgccctggtggaatccatcatgctgctcaatggatatgcattaatttaaaagaggacttttactgctattaattaacatttccattctttttagtttaaactttccatataggttttctgtgaccatcctggcacacattgtggataaaattatcagtcaaacaggacaaatacacagtacacatgcacattctctttatgtgataacacatggagttaggctgtaatatttttatacattaaaatatgtctctgtgcatatatatatatggaaattactatgcaatctcactttttttattaaatgttttccttatttacatttaaaaagttatccgctaccctggtttcccctacaaaaagcccctagcccctagcccatccccctgcttcccaaccaacccactcccacttcctcgtccttgaaattccctacactggggcatcgagccttcacaggactgagggcctctcctcccattgatgaccaacaaggccatcctctgctacatatgcagctggatccatgagtcccttcatgtgtacacatgtttggtggtttagccctggaagctctgggggtactggtttgttcatattgttgttcctcctatggggctgcaaaccccttcatttccttgggtcctttctccagctcctccattggggaccctgtgctgagtccaatggttagctgtaagcatccacctctgtatttctcaggaactggcagagcctctcaggagacagttctatcaagctcctgtcagaaagcaatagttggcatccacagtagaatctgggtttggtgactgtctatgggatggatccccaggtggggaaggctctgtatggcctttccttcagtctatgtgtgggaagccacatgtgccgttgcagggtggcactggctaccgctggccaccacacatacataggcagtaaagatttttgccaagatgaggttttgagaattaaccactcagatgagagacatgttaaccaatcagatgagagacatgttaaccaatcagatgagagacatactaaccaatcagatgagggaagttaaccaatcagatgagagagaagttaaccaatcagatgtgagacgtgcaaatgaggtggtaagcataacccatgcataaccaatctgggtgtgaggcacgcctctcctaggcctatataagcagcaccggttctgggcttgggggtctcttcgcctctgcaatcaagctctcccaataaatgtgtgcagaaggatcctgttgcagcatcattcttgctggtgagtcagggcgtgtgcaagatctatgctctgaactttgtctttgtatctcctaccttgggtattttgttccctcttctaagaagaatcaaagtatccatactttggtgttccttcttcttgaacttcatgtggtgtgtgaattttattttgagtattttgagcttctggactaatatccacttatcagtaagatcataccatctgtgttcttttg

SEQ ID NO: 86 - DNA, 1000 bp, mus musculus
tcagaaaacaactttatgaatcaggaagaagtatggagagagaaacagctagaactggaggcacttgaaggtgagtgaaaacttcctgcaatctctgagggcgaccctagtgaaaactcctagtaatggaggatatacagtctgacctggtcatcttttgtagccaggcaaggcttccagcggtgggacttagttacttttaggttgtattattggctgaagaggtcctgtggggatccctacacaacccagactgctcgccctcgggaacctgactgtgggacgccactgcccaggacaacatccactcagatcactgaacttcattttccttatgtgaattctgacttctagtccccaaacagtaagtgttcattaggagatgagcaatggcagttaccccagagtgtcagagtctgcctgtctaggcaacaaggtaactatactggagagctcaggatgccctggagtccctgacaatgagcacacaaaggggaattgaaatgaagctcctgtgttccttagcatgactcttatccctctctggactaataatatagacatgtcatgaaatggggttcgcttttgtgtagagtctattggctagtgagaatggaagaaatcagatattttataaaatcaacattgatacattaaaaaaaaaaactatttcctgcttccttatttaaggagatttgaggtccatgaatactaagtgacctcaagggaaggttctttcctaactagttcctcctgctttcctttatatgggagaaggaacagcaggtgacaaaggtagacttctcattagggctggaatccacagatagatagagcaggcgaggctcaaatttaagaaaatctttctatataaacttcaagcaacactttctgaaaatccatgtaagccaaaatatgtaaagtttaacgagaaacaaaagaaaatcagataaaaggaaataaaatattcgtagtaatatagattgtaaaccatcttcct

SEQ ID NO: 87 - DNA, 1600 bp, mus musculus
acttattttgtgaaccatatttcctctttgctcctactctctctccccgctttacttctgatagattgccctgaatttcatccagaattttcagccctgccttaaccgcttgataacatgtgaaaaggaacaaaaaggctcctaacactagagaaagttcaaggccaaacataccttgtaaagctatttcccactttacttctgatagactgtcttgaatttcgttagaaagttcaaggccaggcgtaccttgtaaagctattccccactttacttctgatagactgtcttgaatttcgttagaaagttcaagaccagacttaccttgtaaagctatacttatgggtaccctgttccccagctgaagagttctgaattcacgcagttgaatccttctcaacagtctgtgttacgggaacacttcattaccaccgttccccagctgaagagttctgaatccacaccggatccttctcaacagtctgttttaccggaacctttatgaccgtgacccgcagttctggttccggaatgagggatcttccttgcaccggtgatggtaaccgtcccgggttttctcatcccaggatttctcatcccgggttttctcgtctcgggtttcagcaccaactcttacacgcgttctcgcgaccggccaggaagaacgcagcaaaccggaatcttctgcggcaaaactttattgcttacatcttcaggagcaagagtgcaagagagcaagagcgagggcaagagcgcaagagcgcaagagctttattgcttacatcttcaggagcaagaagcaagagccagagagagaatggcgaaaccccgtcccttttaaggagaattattctccgcctaggacgtattactccctgattggctgcagcccatcggccgagttgtcgtcatggggaaggcagagcacatggggtgaactactcttggcacatgcgcagattatttgtttaccacttagaacacaggatgtcagcaccatcttgcaacggcgaatgtgagggcggctccccacagaattgaataaaaccatccaagacataaaaagggaagtaggcacaataaagaaaacccaaagtgaggcaacactggagatagaaaccctaggaaagaaatctggaaacatagatgccagcatcagcaatagaatacaagagaggaaagagagaatcccaggtgcagatgttccatagagaacatctgcacaacaatcaaagaaaatacaaaacgcaaaaagatcctaactaaaaacatccaggaaatccaggaaacaatgagaagaccaaacctacggataataggagttgatgagaatgaagattttcaacttaaagggccagcaaatatcaacaaaattatagaagaaaacttcccaaacctaaagaatgacatgcccatgaacatacaagaagcctacagaactccaaatagactggaccagaaaagaaattcctcccgacacataataatcagaacaacaaatgtactaaataaagatagaatattaaaagcagtaagagagaaaggtcaagtaacatataaaggcaggcctattagaattacaccagacttttcactagag

SEQ ID NO: 88 - DNA, 1000 bp, mus musculus
tcaaatgctatctgaaagttccctataccctcccccgaccctgctccctacccatccattcccacttcttggccctggcgttcccctgtactggggcatatcaagtttgcaataccaaggggcctctcttcccactgatggccgactaggccatcttctgttacatatgcagctagagatatgagctctgggattactggttagttcataatgttgctctacctatagggttgcagaccccttcagctccttggggagctcctccactgggggccctgtgttccatcctgtagatgactgtgagcatccacttctgtattagccaggcactggcacagcctcacttgagacagctatatcagggtcctttcagcaaaatcttgctggcttatgcaatagtgtctgggtttctttatttacatttcaaatgtcatcccccttcctagtttcccttctgaaaattccctctctcctctcccctcccactgctcaccaacccatccactcccattcctggccctggcattcccctatactggggcatagacccttcactggaccaaaggcctctcctcccattgatgaccgactaggccatcctctgctacatatgcagctagagccacaaatcctaccatgtgttttctttgattggtggtttagtcccaaggagctctgagggtactggttagttcatattgatattcgttctatggggcttcagaccctttcagctccttcggtactttctctagctccttcattgggaaccctgtgctccatccaatggatgactgtgagcatccacttctgtatttgacagacactagcagagcctctcaggagacagctatatcaggctcctgtcagcaagctcttgttggaatctgccattgtgtctgggtttggtggttgtttatgggacggatccccaagtgaggcagtctctggatggtcattccttcagtctctgctccaaactaagtaagatccagaagta

SEQ ID NO: 89 - DNA, 1200 bp, mus musculus
tggctcagaaacttagaatgcccaagacacaatttgcaaaatatatgaggctcaagaagaaggaagaccaaagtgtggatacttcgtccctccttagaatggggaacaaaatacccatggaaggagttatagagacaaagtttggagcttagagggaaggaaagaccatccagagactgccccacccggggatccataccataagcagccaccaaaagcagacactattgcatatgccagcaagatttagctgacatgaccctattatagctgtctcttgtgaggttgtaccagtgcctggcaaatacagaggtggatgctcacagtcatctcttggatggagcacagggaccccaatggaggagctggagacagtacccaaggagctgaaggggtctgcaaccctatagaaggaacagcaatatgaactaacctgtactccctgagctcttgtttctagctgcatatgtagcagcagatgggctattcggccatcactgggaagagaggcccttggtcttacaaagattatatgccccactacaggggaatgccagggccaggaagcaggagtgggtggattggggagcagggcagggggagggtataggggacttttgggttagcatttgaaatgtaaatgaagaaaatacctaattaaaaaaaagtcttgggtcagtatttgttcttctgtttgtttgttttgtttttgtttttgttttgagactgggtttctctgtgtaccttggctgtcctggaactcactctgtagaccaggctggccttgatctcagaaattcacctgcctctgcctctgcctccaagcgctgggattaaaggcatgcgccaccacgcccagctagttttgttcttaacattccagctccccttctgattgcaacagtagcattacgatcatccatgactcattttcttcatagagtcattctccaaatagaacttaattcatctcaactacctattatttaagattgattttgacttcaaaacaatatcaggcaacaagctacttgtcagttggaatttaaaacttagagaagttaagtataaaaatcatttacatgtgatactacatgcaatttataattgaacatacataattatgtgatttatatgccaggaatgccatgcactggtgaataagtatatattggacagttgaagtgcggatatttatta

SEQ ID NO: 90 - DNA, 1000 bp, mus musculus
tgaccaaaagcacaaccacactaacaagagtagagaggttagcatgggaaccatacattctgataaggcagaattttattttgttagaaatggtatctgtggtaactagctagaggcctgggatgggagaagatacagacagtctatggggtgaacttagattagattcctgacagatggagatatggagactgagatgggcacctctggtagccagacaggatttctaggggaggaaacaggacatcactctacccacaagatcttcaaccccaaatttgtcttgcctacaagatgtgtagaaataacgttggaccagagaatgaaagaacagaaaaccaatgactgcccgaacttgagactcatcctgtttgagagagccaacccctgacactattaatgatgctctactatacttgagacaggaacctagaataaatgtctcctgagagtcctcttccagcagtggatgcaaacagatgtggagacattcagctaagcatcaagtggagtacaggaagtcttgtggaagaataggtgatagagggaggggtcaaggacaccacaggaagatccacagagtcaattaaattaggaccatgggggctcacagagcctggggcaccaaccagggagcatgcaggatctgaaccaagaccccctacatatttatggcaaatatgctgtatggtattcatctggttcccctagcaatagaaataataggggtgtctcagtctttgttccctatctttggattccctgtgccacttggactgattggttgggcatcagtgggaaatgtgcctaaacctgttgggttgtctgctcaggggtcaggtggtactcaagggtgggtttctcttctctgaatagagaagagtgctgtaattggaatgtaaagtgaataaaaaacaaagagagacatagaaagacagagagagagagagagaagaaaggaaagaaggaagggaggaaatgaatgacagatgagcacatg

SEQ ID NO: 91 - DNA, 1400 bp, mus musculus
ttaaaacgaaagtaatcacaattgattcagtcataacctttatgaatattaaacaagataatgcaggcaaaaggtgattaaaatgagaaagcagtgtagaaacttactttttaaatttatcatagtagaaaaacaatggatgactttctgaggaaaaaattgtgttagatatagtaatatgtcttttttgtttggatatataacctttcctcccttcatattttcccatatatgcctccctcatctacttcaagttcattgattctattttcactaattgttactttattcctaaatagcaccttgccaacccatataatgttcattttagtatgtctttgatgcatatattttgaacatagaatacatgccctggtacagtaaatgcaaatgatacacaaccctgtcgtatatatcataccttttaatcagttcatttcttttgtatgcactataacataaatggttgtcatggttgttaatttatttctgagccaacattatctcttcttcatttagcacagtagtttattcaactttcctagtgctgcaaaccttttatacagttatacatgttgtggtggaccccagcaacaaaattacttccattcccacctcataactgtgatagttgtcatgtaaatatctgtggttttcaatggtcttttgcaacccctgtgaaagagtcacttgaacccaaaggagtggcagcccacaggtggagaacgactgctagtacctttgccaacagcatttgtctgaaatgactgaatgaaattgagcagaaaagcacaccaggcaaatgcagccaggacacatttctaatccatgtgtaccgtttaaatatctgttccaccctgaccctgctacgtctgtaattttgtaatttctgctctgtaatccacttctctcgtccctgtgttcttcattgttttctctcttttacgtatgcaacatagaagcttgctgctaaatctagagcctttgaagtttcttctttaaaaattaacatggctatttccttccatttgagtgtcttctcaaatcttacatgggtagcaaatacttcaatttcaaatctaaagtaacttccttggttgccttctatcaggaaatactgttgtgacaggtccataacatcactgataactctatccaaaagagtgactcattgacctttccctctttcccaatttatttctcttatagatatttatagaatttagatcttatataagaagatagggaggaagatgataggtaggtgatagatcaatatgtagatgggtgaatagatagatagatagatagatagatagatagatagatagatagataaatagatagatagatagatagatagaagatagatggctagatagatagatagatgatagata

SEQ ID NO: 92 - DNA, 1000 bp, mus musculus
tcaagatagcaaatgcactattccctaatctactgaaaataacaataagtcacttttaaagtattgtcctggatgtgtcagagcatgtagcccctttaggtttctttgtttatatctacaccccaactttattgcctgatgtcataattttgttcatagaaggtatacaagaattcttatatgccacatacaaagtgaaaatatcgtaatatgtgaaagtactgtcttcatggtgctgtcttctgcattgtcagacaaacttaggtgttttaaatataatcaaatactcctatgctgctagtctcaccagacaagattgaaagaccactgaacccaagtggcaaattggagcaaacgttatttgtctataaaggctgcctcattctaaggtctacagggttcaagagatcagcactggacatggggaaggtgtgaatttcacaactcaggagtagagaatttggcagacaaataagcagcactacagaagcagaacataaacatatccagaaggtcataaaaaaaaaaatccctgaaacaaagagatggttaccatttcctggaagaaacagtacagaaacatttgtagttcaggttcaaggaagttgtactaaatgtagttcatatttaaatgtttaaatatgcttggcccacagagtggagctgtttggaattgtggcctcatttgagtaggagtggccttgtgtgagggtaggctttgagtccctcctcccagctgcctgggagactgtcagaattttccagattgcctttggatcaagatgtagaactcttggctctgtctctagcactgtatctacctagatgctgtcatgcttcttgccatgatgatagtggactgaacctttgaccctataagccagccccaattaaatgttgcccctataagtgttgctttggtcatagtctcttctcagcaatggaaacctaagacagtagggtataacctagtcatcgatgaacagaaatttaatcataa

SEQ ID NO: 93 - DNA, 1600 bp, mus musculus
gagttatttttgtccattatatagtcctccatcatcatcatgagagatgactttggatctatatattgcttttctggtgtgatggtgtattcaggactcgctatggtgggagagttgggttctgatgatgctaagtatccttggtttctgtgacttctgttcttatgattgcatcctgccatatgattatgtcaagtgctccctgccctcaatatatctgattaaagactgtccttcctgaaaccctggttgactcagaactcctcagagtccagctttctctgtgatcctgtgattccaggatactgtgatcctgagattctgggtgtgttagagtccttgccagtcaaccttcctctgagaccctgagatcctggtatgaccaaaatcctgggctcctgggctcctaagatcctgggcatgttacagcgcctgtaagtggtgcctcctctaaggtccatggtgctgtccactgagttccaaaccaaggtagaccagcactggaaggaactggagccgctgtttggatggggctcctgtgtccctcctcctgctggccccagacactcccagttgtgttggaacagatgttgtgttccactcaccagtgatcctaagatcctggaggcatgctagtgcacctggggtttggagagtcctctgtgatggtggaactgtctgccaagtttgtgcccaaggtggcccatagctggccctgataagaaagaatccaagctgctggttgggcaggtttcctgtatccctgctcctgttggctccaggccctcaggattgtgttggaagagatgctgtgttccactcaccagtgatcctaaaatcctgggcatggtagggcacctggggaggggcggtggagagtcatctcagtactgtgggaacatccttcaagttctcgtacaatgtggtccgccactttgagcttttaaagagatttttgaaattataaagatttttgaaattttaatgtgtttttaatattagaaactttgaaactgtagaaacttttaaaagttgaaagattttatattgtagcagttatatcttgtgtgtagtatgagatcttagggacaaaccagaaagggaagtttgttgtttaacagtgatgatgtatttatgtgtcaagctgacaaggtgtcaattgtgttggttgaacttgacagaagcttaagttactagagaaaaggaaacttcacctgagaaaatgctgccatccaattggcctataaacaaatctgtggggcattttcttgataaatgattgataagaaagatctcaggctatgggaagtggtgccatcctgggaaaggtggtcctatgatacaaaacaaagcaactgaacaagccaggaggagcaagccagtacgcagtgtttctctatgatcagtgctttatttcctgcccccagattccttacttgagttccttccctgtcttcactcagtggtggattgtgattataagctaaaatgaactcttcacccttagccccaagttgcttttggtcacagtattttatcacaacaaaagaaacccgaagacacagggcttcccatgaaaaagaaagtagtagtatatcct

SEQ ID NO: 94 - DNA, 1400 bp, mus musculus
ttataaatacatagcatatatatacacataccatatatatgtatatgtgcatatgtatagtaattgttttcatgctaagatatatagaataattcccctttaaagtatacggacaatgagttttaccattgacatatgacatagcctaaatataaaacgtttcaagtttctataagcttagactttatttccattgctgagtgtaaattgaaagcaaaagtctgagttctttcagtaacacaaggtttttttctaataaaagcatacagctaacaaaatgtacaggagaggcttattatgcatccaaagtgcgttagaaaatgtgagtctgggccacagcatctgggggagccatcttgggtccgggattccgcatagactagtctgtgcaggggagagtgtggactgcagaagctaacagcttctggctcaagtggaagccacagagcttctgggacagaccccatttcaggctccagacatccaggcaccttccctgccagaggagaggtgtctgccccgcccaggagggctttgccacagcatctaggggagtcatcttgggttcccagattccaccaagactggtctgcacaggtgagagtgtggactgcagaggctaacagcttctgggacagacagaagccacagagcttctggggcagaccatgtttcaggctccagacacctgggcaccttccctgccagaggagaagtgtacaccccacccaggagggcttcaccacagcatctgggggtgccatcttggctcccagatcccaccgagactattctgcacaggtgagagtgtggactacagaagctacacagattctgggacaagccatgtttctggccttcatcttctgccaggaggcaggtccgaacaacaaatatctgtccaccttccctgcaagaggagagcttgcctgcagagtgctctcatcactgaaactcaggagagatctagtcttccaggtctgctgatagaggctaacagaatcctgagaggaacaagctctaaccagagacaactataacaactaaatcgagagattaccatatggtgaaaggcaaacataagaattttactaacagaaaccaagaccactcaccatcatcagaacccagcactcccacctcagccagacctgggtactccaacacacccaaaaagctagacccgaatttaaaagcatatctcatgatgattgtatagaacatcaaggaggactttaataacttacttaaagaaatacaggagaacgctgctaaagagttacaagtccttaaagaaaaacaggaaaacacaacaaagagttggaagtccttaaagaaaaacaggaaaacacatccaaacaagtgatggaaatgaacaaaaccatactggacctaaaaag

SEQ ID NO: 95 - DNA, 1000 bp, mus musculus
acttgttaattgaatggccagctgaatcatgcttaatatttaagtcttggggcaactctctgttgatgtgtaaatgagattttagaagtctcagatcagctaagaataggtgtaacttccaagttcagatatgtggagagccgtgccccaagcaatcgcgtgtgtgctgccagtaatctctttggagagccgtgccgcgagcaatcgccattataagatggcgctggcctccactgtgcctaactagtaaacaagccttgtacgcaggtgcgagagtgaacttactcctagtcactcccattggggtgtaatagtggggtgatgggcgaacaacgaatcaggagctgtcacaccatatcaggtgctgaaacgtcatgctgtgggctctaaaagtggcgccattttcccagttcggggtcttcctgaagaagtaagcaataaagcttttgccacggaagattccggtttgttgcgtctttcttgccggtcgagtgggacgcaatacagatacaagctttctgtagctagaagatgcttgctccaattgttagaagtctgtggacggctccctggtttctacaaggtagtccttgggtgccaggggctgaagtcacagtgggagtggatgggaatcactggaggtggggcataggacaccataccatcttcaggtggatgtgagttgggtggaaatcaggctggaatattctaactacaattggaagcacaggatatcatgttctctcttggtgtcctggtgaatgggatggctggtgaatgggtatattggctctaggagttcctacttggggtctggctcacaggactgcacatagtccccaggagcaggacagtgggtagagtggctgatgggtgattaaacatctatgaggggcccttccaaggcctggtccacgggatgcctgtgttcccttggtagtgtggttgttgaggtgactggtgcataggcataaagactgactctttgggggttcctaat

SEQ ID NO: 96 - DNA, 1000 bp, mus musculus
ttgaactcatgagaactttgccaaattgtctgatgctctgcataaagctgactattgtgtgggagtttggtctgcccccatttgtcagctccattcttccaggtcccactgcctctagaacagtattagtaagatagtgataaaatgcttgaagaattgtaatgattcagtttcacagggtccagtgaatggttgcttggcctcatcactggggccagtggtgaagcggaccatcaggatgtcagtgtgaagttctgtctccctcatggtgtctgggtgacaaagagagtaacaggaaaagacagggtcccaatatctcctataccaggcctaaccctacgtcacttcagacactagctgtgaatttaagggtacacagatttcagcagattcttagaaaatcattgctctgcgttaaaggaaaaatggctggatatctaagaaggtctgtctgctacttgctgtcattcagactttctctcctctgtctagtcttagtgaaaatgaatggtcaatcatgtggcccctctggtacagatgtgtagcaagggtaggggtcaactggcagaaggtgccatgtgagggtgctgagaatgtgggcacaaaaacatgagcaactgtatgtaggtacttatgacagcttgagacaggaagttcaatgccaagttaaatactgtcaactcagagactgacagggctccactatgttcaatagatttgcacaaagacctctaatcgttcccaaagcttattttcaagatggctatttgtaccttgcctccttgaaacctggaggcttttcacataggattctttgctccataagtggcacttattgatcacctattgtgtatctggcgtctctgaagcttcttgacaatggcacactgtaacagcactttcaggtcgggtttcctagtccaattttaaaggttccaccttgaggtttagctcacctttcttatatatgatcaaaagcacagagggagccagtggataa

SEQ ID NO: 97 - DNA, 1200 bp, mus musculus
agttttaaacagttgtaatagaactatggtttttgtatctgtgtgttcactactattagggaagagatagatttttgtttgtattgtatcctggactattacggtacttccaacccaccacccacctaggatcccttataatttgctcagattcgtagattaccgtgtcttcaaccaatacttggatctcattttcagggctgctgacctaataccattaggactgttagaaaggtctcactgtagccctggctggtctcgagcttacctgtcggtcaggcaggccctgaactcaggactcagaagcagacccatcagtactggaattaaagttgtgcatcaccacacgcagcagacatcatgactttaaaaatgtgtagtgattctaagcacaactgaagttgagaagtgtggctttcttaatttgtccatcaaggggcaaagatagagatcccaaaccaggcaggccccctttgtgcatgcaaatgcatgtgcgcacgtgcgagcacacatggcacttggtaccatgtcatgctgtcagttgggaaggtgatggtcttagtctttgcagttggtttctactgtgtagcccaatatctggcctcctcccagtccccatgaggcaaccaggctgaggtgaatagagtcagtttaatgagaaaacattgatctgtataaaaaggtgctttgtgtgtcagctaagtgtcctcatttctgaggaattgtcatattgagtaggcttgaatgtctgtgttgcccacggcaccagtgtcaaggtgcacgctggctggcatgacagggcagggcctgccccatggaaagatacatgcccctttggagggaacacttagtcaggttatacttagtcaggttcttcaagtcgtcgtcataacaatggccataggctgccaaaattaatcaaaaaataactgctgcaaaatgggcatcagctggggctgttcaagaggccttcaccttttgcccttcactcagccttcagtgggggccctgcccgcagtacaggtttacaccagtgaaactggaaacagctgggagagaaagcagccacccgggagcctgtgtgaagtcctctttacactaccagctggcatgggaccagagagggatgtatactgttggcattgtcccaaagcaaggtgcaggactcctcagtgtgtagggcctacagagcctagtccc

SEQ ID NO: 98 - DNA, 1000 bp, mus musculus
acccactgagggaagagcgacccgcaagggatgaaatctctgaaggaaacgaatccaccttccctggaagtcatcaatcacattctctgagcccctcccccctccatgcttggtagtgactggcttgatcttgagaagttcctgtatagcagccacagctgcggttcggttcacaagtgccatgtctttcggtcatgaagacaatgccagtacagcctttctgttcttgcatctagcacccatggtgtcgggggaggcagttatcatttctcccccagactgggagttttggaggctgaatctgtgccctactagccttcatagatcttcatagactgcggctcagaatttctcaccagaagagactaagaggattgcgattgatataaaatgcctattaacaatcatattgcctactgttacagatgacagagctagatatgcacggaataagggatagctcaatgaaaggagcaatagggccaagtcatactgggaacactacaagggcaatattttgtttttttgtttttcgagacagggtttctctgtaagccctggctgtcctagagatcactttgtagaccaggctggcctcgaactcagaaatccgcctgcctctggctcccaagtgctgggattaaaggcgtgcgccaccacgcccggcaaatatgaggttgattgaccacttttcccttttttagcttttttttttgtccatgtggttgctgggatttgaactcaggacctttggaagagcaatcggtgctcttaaccactaacctatctctccagccccaatattttttaatgacacgggagttaagatattcaactagagcttcctaaaatatgaaagctctagttagactgctcttttgttgtggacattgtcacactaaacccagtgacgcacacctgagtcagatatttttgtgaaactgaggagagttggacactgctctatacaagctttgtaggtgtactgcgattctctaga

SEQ ID NO: 99 - DNA, 1600 bp, mus musculus
tattatcagtaggtttggtcttctcattgtgtcctggatttcctggatgttttgagttaggatctttttgtgttttgtattttctttgattgttgtgccgatgttctctatggaatcttctgcatctaagattctctcttccatctcttgtattctgttgctgatgcttgcctctatggttccagatttctttcctagggtttctatctccagagttgcctcactttgggttttctttactgtgtctacttccctttttaggtcttggatggttttattcaattccattacctgtttggtcgtgttttcttgcaattctttaaggaatttttgtgtttcctctttgtgttctacctgtttagctgtgttctactgtatttctttgagttattaaagtccttcttgatgtcctctaccatcatcataagatatgcttttaaattgggtcttgtttttcgggtgtgttgtggtgcctaggtggggtgggagtgctgtgttctgatgatggtgagtggtctagatttctgttagtaagattcttatgtttgcctttcaccatctggtaatctctgaagctagttgttatagttgtctctggttagagcttgttcctcaggtgactctgttagcctcttagcagacctgggagactagctctctccttagtttcagtggtcagtgtattctctgcaggcaagctctcctcttgcagggaaggtgcccagatatctggtgtttgaaccttcctcctggcagaagttgtgttccactcaccagaggtcttaagatccctggagggtcctgtgaggaccttgagggtgtccagaaactctgcacacaaggcaccctggtgctggagtggaccggaagggacttgtgcccctgatcaggctgggttatctgcttcactagttaatgcagtctcaggtcccgcatgattggattggagcagatgctgtgttccactcaccagaggtcttaggatcccgtgggggaatcctgtgtgggtccttgagggtgtctggagactctgcaggcaaggcagcctggtgctggagtagaccggaagggatttttgcccctgatcccacattgcatttttaaatgattttcctaggtataatcacttatatttaagagttgaaacatacatatagtatgttacagcaaaaaataaccttaaatttgcatatgcatacaaaaatcaagccattgtaaatatatttggcttgttgatgttctttggtataaaggtagattcaataattttccttttatccctatattcctgttttttatttgtatccttttcccccctttctccctcatactaggtataagagaaagaaggatagaggtaagaaaaaaggagaaacagaaacccatgaatctaacctcctttactttgtttcttccctgatcatgatcattaatgacttgtgtccaacccccttaaatgatgacagagttctatcacccatcaaatgaccaaaactcatccaccccatattttgggaatggggtgtcattctctcaaaattgtttcctgatctcttggagatattctcttttggggaaccttaagaaaactggaatattg

SEQ ID NO: 100 - DNA, 1000 bp, mus musculus
aaatcattgccataaacagaacgcctcatgattgcaggacaacaattgagtagagtgatgtatcatgtgatgttgtgcacacagaggtggatggtaagcatgagtgtcttttggtttgggagaggcatatcatctgaggttgcttaagggatttatattattggtctagtgagatgggtctgttgttaagagcacatttcactcttgtagaggacctaggttcaatttctcacactcacatcaggcggatcacagccctagaggaatgaggatcctctgtcgcagcctcctggggactccactcacgtgcgcatgctttaccctcctctactacacacacacacacacacacacacacacacacatactacatagaacataaataaagtttcctatttttaagagaggctggaaagctgtcttgtatagaatagcatcaaatggcattgccccaggctcctcttcctttaaataaagctgggagtttttctgtggatgaagaaacgccaccagcagatacgcatgggcagacacagtgtgagtatcctgtccccgggtagtgtaaagaacaaaaggaagtggacgatagagcttgtaccccatagtataaatgtatgtggtctggccagcttctaccgctgcagggggagcatgggagcaatatagtaatgaggagaagccatcagatcatcctgattatgcatagaagagctgccaaagtttttcaactttgcatgattaaaaaaaaaaaagtcaacaaactaatgatagactattccctaaccaaccccccaaacaacttgatcaatagagaatggctagcagctgctccactacaagcagaagacaaaggtggccaccctcaacactcagccaacatcgccagtgccctgccagacggaaaagaaagaacacaaatttaaattgaacaatagaattatccttttggaagactaattcccaaatagctagcttatgctctctctctctctctctctct

SEQ ID NO: 101 - DNA, 1000 bp, mus musculus
gatgtatcttggcatttgaattttcataatgctccattgtgattaaataaccttgaagctgctgatagatagattagttgttcccactgtgatagataggttgttctcagtatatcagaaactaacgttcaagggcattttcccatgcatgcactaatgaagggcctgcatcctcaaaagaccctagcttcattacttcacttattttctggttttgtgtttccatgatttgggaagagaagatgatctctttaccccatgaatatgccacccacctcataaatattcatagaaatgtctaaagcgtatatgttagccctacagtgctgctaactcactttttaatgttttttatttttaatcattttattcatttacattttaaatgatatctcctttcccagttaactctccacaactcccccatcccacccccacccccacccccaccacctttgcctctgtgagggagctcctccacccactcacccactcctgcctcactgctctagcatcctcctacactgggacatcaaacatcccaaagaaccaacggcctcccctcccattgattccagataaggccatcctctggtatatatgtgtctggagccatcggtccctccatgtatactctttgggggtttagtctctgggagctcggagtggtctggttagttggtattgttctttctacggggttgcaatccccttcagctccttcagtccctcccctagctcttccattggggtcaccaggcttgtctgatggttgcctgtgagtatctgcatctgtattggtcctgtgctggcagagcctctcagggaacggccataccaggctcctgtcagcaagtgcttcttagcatcagtgatagtgtcatggtttgccgcctcacttttgagtcaccccagtctccccacttctttggagtgcttccttgctttgctgtatcagctttctttaaactgtgtcttgcaactggtatatttgcttcca

SEQ ID NO: 102 - DNA, 1200 bp, mus musculus
cagtaatttatttccaaaaggtatttttaatttaacctaaaattcgagagaataagagtaacaaattatttccttgattatttaaacatctgaatatatatatatatgtatatacatatgttttgtaggagttatgactgaatgcatggcctctaaacaagtcatatttatagtatttaagaaatatttacgcttctgcccagtcttttctgctggggcagactcctagctcatctgctcccgtgaagacaccatattctgacctgtcctagaggacccactgcactcagagcagttggtaagacacccccactccccccacgttcaagagctgccactgggagcctagtggacttggactcaggacccatcacccaccaacaccctcccaccccccagcttcttccaattaccacttcccttccatcccttccgcctggtcctttctgctggggcagactcttggatagtcggctccagtgaaaataccatatcctaacccatcctagcggacccactgcactcagagcagctgaggatcagctgcactcggagcaactggacagcaacttgagtgatccactgaagacccaacagtctgaaggcctcctaggagatctactgcagcaaggacaacagatcagcagcttctttacccctgtgaaggcccccagttggaaggccccacaagtggtctgctacagccagggccacaggcctactgggagaaccgatgcaacccagagacaaaagaggcagactccagacggtcacacagaccaacaaacactaaggatatccagatggtgaaaaacaagtacaagacatacaacaaaagccaatatatgcgggcatcatcacaaccctaccacagcaagccctgaatacactaacataactgaaaatcaggaaatctgtcctaaaatactatctcatgaagataatagtcctttaaggaggatatcaatagctcacttaaagaaatacaggaaaatacagttaaacaggtgaaggaattgaataaagcgatctaagacctaaaagtggaagtagaaacactaaagaaaacacaaatgaaggcaaacctggaagtgaaaaacctaggagagaggtcaggaattactgatgtaaatatcaccaacagaatacaagagatagaagagagaatctcaggtgtagaagataccatagaaaagattg

SEQ ID NO: 103 - DNA, 1000 bp, mus musculus
caaaagtgattgattgtatagacacttttgatggcagtgtagcaagcagaaatggaccaagtatgagtagctgtccagagtagaactgagactgcagaaggcttgctctaagctggatcctggacctgatcactcatgtctgagacctaccatcactatcatctcctttcatgtgggctgctggaacattcttttttttttttttttgttatatggattttcatacttcttctttcttgtattagatattttctttatatacatttcaaatgctatcctgaaagttccctataccctcccctactgctgtaacattcttaaaactactctccttgcagttgatttttacatgtctcctaaggcccgaagtcattctggaaactgctcagatgtgtatattgtatatcagcttccatacccaagtgccccacccctgcgcccaccacagggaactgtgtagacgtggctctgccctaggcgtttgtatttgctgcgtctcgtctcccttctgtaactagagtgctaaactcataactactctcctgacctattatttcttggcacttaatgtgtcaattcttttaggatatgtgcatctcagacataggggtgcatttgtcttgctcacaaatacaatgtttaatgtatctccgtagggtcttggatttacttttacatgggagctctttaacatatagggatggagatacacacacacacacacacacacacacacacacacacacacacacacatattgtcaacttggcatggcatgagagtcatcaagagtcaattgagaaaattcctttggaagaccaagcaagactatagggcttttcctaattagccattaatgggagagggcccagccaattgtggatggtgccacccctgggcttgtgtcctgggttctataagcaggcaagctgagtaagccatgaggagcaagcagctaagcagctcctgtacccaagttcctgctctcttggagtcgctg

SEQ ID NO: 104 - DNA, 1000 bp, mus musculus
tggccttgttggaggaagtgtgtctgggtagggggtagggggagaggaagggggactttgaggtttcaaaaatccattctaatcccagagtcccccctctctctgtgcctactgatctgctgatcggatcaggatgcagttctcagttacttccccagcaccatgtctggctgcattcagccatgctccctgacatgataacagactgaactggaactaggcctctaattaaacgttttcttttgtaagagttgccttggttgttatgcctctccacatcaagaaaacaatgtctgagacagatacatttcaggacatgcaactggtggtcaaaattgcctctggggtttcagccttccagtctatcgattcaagtagacagagatcatctctttctagttgtaggaaaatgcactcatcttattgtccttaatttggtccacatttccattcaggaatgaatcgtcatgaacagatcacagtgctgtcattgttcagtcctggacgtcttttagggtcctagctgtcaggaaggaggaagagggtagctcttctgtgaaggacacccaggctgatgacatgtctggaatgtttctttgctgaggcaggagtggtggcaggaagaaaatgcaataaataacgatgcaaaactaaatgaagaatgaatgttatgtaaaagccccaagacagaaaatatcagtttaaaatgctgaccgacccaaagtgggatccagctcatgcggaggtcccaaggtctgacactagtactgaggctatgaagtgctcacaaaaagggacctagcatgactgtcctctgaaagacccaacaagcagctgaaagagtcagaggcagatacttgcacccaaccaatggacagaagcagctgaactatgttgttaaattaggaaaggctgaaagaagctgaggagaagggctaccctgtaggagaatcggcaggcctcagtctggacccctgagatctcccaaacactggaccac

SEQ ID NO: 105 - DNA, 1000 bp, mus musculus
gtccgagaatgaattggaatttaccagctcagtctctgccaacatggagaccaccaaagtgaacgggagtctggaagccaagtacaaatgatggaccgagtgtggactaacatttacagagaagtggaacacagacaacaccctgagctctgagatcaccgtggaagaccaccttgcttgtggactgaagctgacctttgattcatcttttttgcctaacactggggaaaaagatgctaatatcaagactgatacaagagggagcttatcaacctgggctgtgatgtggactttgacatcgctgaacttttcatccggggtgctctctggtgcttggctatgagggttggctggctggctaccagatgaattttgagacctcgaagttccaagtaacccagagcaactttgcaattggctacaagatggaagaattccagcttcgtactaatgtgaacgagggaacagagtttggtggctccatttaccagaaggtgaacaagaaatttgagactgctgtcaatctcgcctgaactgaaggaaacattaacactccctttggaatagcagccaagtatcaggtcgaccctgatgcctgctttttgaccaaagtgaacagctccagccttgggtacaatcagaccctaaaaccgggtatcaatctgacgctgtcagccctactggatggcaagaacatcaatacaggcagccacaagcttggtttaggactgcaatttcaagcataaatgaatttagtgtaccttttaatgttgtatgttggagatgcgggagttgataaatatcacgttagacctccaggctaagaatgactcggctttaaggtgtttaccatttcagaggtactgcagaaaccccattccagaaagggtcctttttagctgtaggcgtgggttgggaggagcctctatagagatgccaggctgcaagtggaatctgggaacctgtggaccctttgtaaatctgtatccagtccccagat

SEQ ID NO: 106 - DNA, 1200 bp, mus musculus
acaacccaatatcagcccttcctttcctcccagtacctcctcatacaagtccttcccctattccaccttacttttgagtaggggaagcccctctctggtattatacccctccctgccgctacctgctgggactaggcacatcctatcccactgagggcaaacaatgctgtccatttagcagtgtgtatccacaggcagctaagcagcaggctcagggacaatccttgttccagttgttgggggacctgcatgagggaccaagcttgggagaccaagctcctcatctgatatatgtgtgcaggggcctaggtccagcctgtgctcagtcttttggagcccccaagagtctagattagttgactctgttggttttcctgtagagtccttggcctcttcaggttcctcaatcttcctcccaactcttttgtaagaagctccatctaatgtttgggtgtgagtctctgcatctttcctttgactgttgggtggaacctcttagaggacagttatgctaggttcctgtctacaagcataatggaatatcaataatagtgtcagggattgattcttgcccatgggatgggtctcagtttggggcagtcattggttggccattccctcagcctttgttctgtcttcaaccttgcacatcttgtaggtagggcacattttgtgcttaaggctttgtgggtttgttgttgcccttatcctcacactggggttcctgtctggctacaggaagtgaacacttcaggatctatattccccactgctagcaatctcagctagagtgacccccatagaccctcttgggtctctccccatccaagatctctgatttgtgctagagattgcccttccccgagttgatctcagttctctctcccctgctctccctacatatggtccccgtcccgctcccctcccaattcctttttccatccagttccctccttctatcaaccttgatatttctattcactttatgtgaaagatgtatatgctgtgatttgcttggtatgaaagaagacaaaagctgttcagtgtattaaaatgtcctgccttgtaggtataattgatgcatatatgtttcctgtgactgatataagaaaatgccaaaggctgggtaataaaaacaatagcaatttatttccttccaagttgtgggcctcgaatcctagcatagatatccacgtatcc

SEQ ID NO: 107 - DNA, 1200 bp, mus musculus
ataatattttatgtttgttgtataaatgtctcacaacctcattgaaaattgtatacattagtgtgtcagatacaggtttctgaatgcttctttttgaatgaaggagaatctgaatgaaaattgacttattacaatatacaaatcgatgcttttcatacttagaaaatgggatgtatgctatattccatgaaaattttattttagttcctattattattattattattattatttatctttttctaacagtctagtcatgatccccctcctggtctgtcctctgactgttccttatcccatgcctccttccttgtctccaagggaaatctcaccactcccctaaccccatctcatcagaattccccactccctgaggcctcaagtctcttgggggctaggtgtgtcttctccactgagaccagactaggcagtcctctgccatatatgagtcaggggcctcatatcagttagtgtatgctgcctggttggtggcccaatgtccgaagaatcaagggatccaggtcagttgagactgctggtcttcttatgaggctatccacctcctcagcttcctttggtccctcctcagttcaaccacaaagtcctatgaccattggttgggtgcaaatatctgcatctgtcactttcagctgcttgttgggcctttcacagggcagtcttgctaggttcctatctgcaagcacactaccagaactgatcaaaaggaacacgagcctctggtcaggaagggctctgttgtccttgttcctgctgtcacaggcctgtcacaattggattggaaaggatgttgtgttccactcaccagttatcctaagatcctgtggagagtcttcttaggcaccatgggggtgtcagccaactctgtgcccaaggtgaccccgcatttttcttatttgtctttgtaagaagattgcaggatttatttttacttttttttttgttgttgttgctctttttatttattatttacatgctaatctctccattggaagttttgtctggttataggagatggccagttcaggttccatatccctcattgcaaggaggatagggttacctttatagattcctgggtgtatgcattatcctagatatctagcttgtgtcagagattctcccccacccagtttgctttccctctgttctcttaccatatcaaccttgtccccatcccca

SEQ ID NO: 108 - DNA, 1200 bp, mus musculus
tggccttttctttgaagtacaaaatgtatcactttttaagttttagaaagtctataggatatgtttttgaaaaccttaaagtcacaacaataaactgaagcattagtattaggattttacaatacaaaaatataatgctttttcaggagtgtaccatgtacttaaattatagatacatgcttctgtccagtactttctgctagtgcaggctcttagctgttctaatccagtgaagataccataccctgacacatgttagaggacctgctaaactcaaagtatttggtaagaacactgcctctctccagactcccagagctgctgcttgagccccgtggacttgggacttaacacccaccaaaaccctccccaacgccccctcgaataccacttcccttttgtcccttctgccccttttgctccaccctttctgctgaggccgactcttagctggtctgctccagtgaagacatcatatcttgacccatcctagaggacccactgcactcagagcagtagaggatccactacactcagaataattgagaatcagctgtactcagagcagttggacaacagcttgactgctccactgaacacccaacagtctgaaggcctcccagaagatctactgcagccagggcaacagatcagcagcttctctgaccctgtgaagagcccccagttggaaggccccacaggtggtctgctacagccaaggctacagacctaccaggatatctgaagcatgccagggacaaaagaggcagactccatacagtctccctgcccaaaaaacaccagggatatccagatgaagaaaggcaaacacaagaacataagcaagagaagccaatatacgtggacatcatgagaacacagttctcccaccattgcaagtcctgaatataacagcatatctgaacatcaggaagcagacataatcctatctcatgaagataatagagtcctttaaggaagatatcactaactctctgaaagaaatacaggaaaacacaggtaaacaggttaaggaattgagtgaaataatccaagacctaaaagtggaagtaaaaacaataaagaaaacaaaaaatggaggcaaacctggaaatggaaagcctaggaaagaggtcaggaattacagatgtaagtatcaccaactgaatacaagagatagaagaaagaatgtcagatgta

SEQ ID NO: 109 - DNA, 1000 bp, mus musculus
cctcagtcccacttgggagggataagaaagcaatcacaagtgtggagggagtaagggtggtgcctgagagggaaagtgggcagacatggggtgaggtagtgtggggaagaggggaatctgatctggtattgggtgagggaaaaggactgaagccctgagggccagcagaaagaataggagcaggcaacctcaggagataggaagttgatgggaccctccagaacgcaccagagacctgcgaggtgagagactctcaggactcaaaggtggggactttgaatgaaataccagggagagggaacttatatagcctacctccagaaggaagaaagggtatcaaatgagggagagggaagccatcccacagtcacagctctgacccataattgttcctgactgaaagaattacagggatggaaatggagaggagcctgaggaaaagaagttccaggacaggcctaaagctagatcctcctcaaggggaggtcccaaggcctgacactattattaaggctatggagcactcacaaaaaggaacctagcatgactgcactctggaagatccaacaagtagctgaaagcatcagatgcagatatttgcagccaaccaatggacagaaacagctgacccctgttgttgaattaggaagggctaaaagaagctgaggagaagggtgatcctgtaggaggaccaccagtctcaattaatctggacccctgagatctctcaaacacgggacaactaaacaggtaacatgcagcagctgatataaggtccccaattcacatacaatagaggactgcagggtctgtgttcattcagagatgatgcacctaaccttcaagagactggatggaccagggagtttagaggtcaggtggcatggggatggggacatccacatggagacatgggggtggggagtaggtatgggatgtggagcactcagagggtggacaggggtagggaatacaatatggagtataaaaattcattaat

SEQ ID NO: 110 - DNA, 1000 bp, mus musculus
tccttaagttccttaagattattttaagagagcaacagaaaatagagccaagacagcaatagtggttttttaatttaattttagttatttatgagaatgcagtcaagttatgttgcatatagtttaaaaaatatgctagctctttctcaagagctctgccttagctccctcaacctcttgcacctagctcctccaagctgccaatggccaccctggctctgtcctttcttctttccacatggaaaacaccagacagccttaatgttttaaactgtccagatattccaatggcttggcaaagaatgtacttctccatccttcttggcctcttcccatagcagaggctacaaactataggttccctgagatcttcatgcctgctgcttcctgtgctccgccacctactctgcctcttccctcttattcacttctcttcctcatgggatctagaagttccaactgttttcctttgcccagcaattggctttcctcttctttattgacacaatcaagatccaattagggaatcaatacctcctcctacaaattatctattaagaatgctacagaacctaggaatattagaagattttccacatacacactccaaaaatgaagagcaaatcctaactagaaatatatggcagtattgatcactgacaatattggaagcacagattgaggatatcaacaaatagctttattttggtaataatccaggggttgctggagaaagaaaactttttcctataagttgaaaattggttaagcatataaatagtccaaggggaaattacaatgaagtgcagcagagtaaaattagagtctgtgacaatgaaacatggaagaatattaagaagaaatctgtgagaaatcaatgatttgcataccagaatgttgtgctgagtttgagaaaggagagtgcatatcacatgcaacttgaaatgatctcactgtgataggattaagtggtttgaaggaatgataaaattcaatatga

SEQ ID NO: 111 - DNA, 1200 bp, mus musculus
ctctacatccattcctacaactcccagagaaagcctaactcccaggtgctctgaaatgcccaggatgacagaagaggctacaacatctgccccaacacccagagtaactgggtccctgaggatccagggatacaggaacctctatccagccagtgacacgggttccttccggcctgaaactgtgccctgagtagacattgggcgctggctctttaccaactcatataacacccagaggaagcctgactctcagatgccatgaaatgcccggggtcacagaaatacaggatcacagaggaagctcaactcccaggagatcggacactcccaggagcactggagttctgacacactcaagaacacagttgaggccacaacacctttcccaacacccagcataactgggacacccacaggaaccagggaaacacaaacccatgcccagccagaggcacaggtttattccagcttgcaactgtgcccaaagtaaatccagggcactggctccccatgcacccctgcaacacccagagaaagcttgacccccagagttatgacaaaacagtatctcaggagcttgatcacatcaggatttcaggattccagaggaagcttgactcccaagagctctgacacataaagaatcacaggatcccagtgatagctggactctgagcagttctgaaaaaacaaggatcacaggaaggaaaggcttcagtcagagacagcaagggcaggtagcagtagagataaccagatggcaagaggcaaacacaagaacataaacaattgaaaccaaggctacttggcatcaacagaacccagttctccaactacaccaagtcttggatactcgatcacaccagaaaaccaagatttggatttaaagtcacacctcatggtgatgatagaaaactttaagaaggacatacataacttccataaataaatacaaaagaaatacagaggtaaacaggtagaaacacttaaagaggaaaaacaaaaatccattaaagaattacaggaaaacacaaccaaaatggtaaaggaattgaacaaaaccatccaggattgataaaagaaaatagaaccaataaaaaaatcaaaaaaggagacaaccatggagattgaaaacctaggagagagaacaagagacatacatacaagcatcacaaacagaatacaagagatagaagagag

SEQ ID NO: 112 - DNA, 1200 bp, mus musculus
tctatgcctaagattctctcttctatctcttctattctgttagtgatgcctgatctctttcctaagtgcccatctcccaagttgcctccctttgtgttttctttattgtttctatttccatttttagttctattccttcccctgcttgattgcattttcctgtatttctttaagcaatttatttctttcttcgatatggctttctgtttgccagtgttctcctgtatttctttaagggagttctttatattctccttaaaagcctctatcatcttcatgagatgggattttagggcagtatctcacttttcatgggtattagggttgccaagacttgttgtggtaggaaaactgggttctgatggtgtcaaattgcattgggttctgtcacttatgatcttgtgtttgcctctggccacctggttctctctggtgttaactggcctgactgtctctgactggaactggcctccttgaaggcaggtagagccctgtgacctaagttagagctggtctccttggaggcaggcagtgttgccctcttgtgcctcttgttagagcaagcctcctgtgtccctggttactatgaccttcggtgcccctggttactgcaaacttcctgtacccttggttactatggaccacctgggaggcttgcacggtgtagtgattgggcatgtatagggctactactctggcctggggtagggggaatggaatagaaggtaggtggagtctagggtggttgtaaggttagatttcatgtctgttgggttgtgtgggtgtcccagctagtgtgggtacttgggtgaaattctcacctgtgtctttggtcacttcagacctcctgagaagcattcaggctacagcatttgaacaggtattgggcgggctgctgatctggcccaagtaaagaagtgtgctaaaaggaaagtctggtgaattgtttttatagcttattttatttaatttgttttgtgtttttaagttttatatgtatttaataaaataataaaaattgttttattatatccaatatcagataatgtgaaatatgtctgtatatgaatccataatgatctctttatctaaaattcctaattgtagtaaaaattattaaaaatatgcacacatatgttcaagtgactatttttaggtgagggaagaaagaatggtcaaggtttcagaactgcccaacat

SEQ ID NO: 113 - DNA, 1600 bp, mus musculus
agcgcagaggaaatccaggcaagccatttccatctgccctggggcctgtctctacaactctgacacactccctgagggggaaaaaaatcaggtgtccactagtgtagggacttatatcttcatcttctattcaattctattgatcaacatagctgtttttaattcaatatcatgctgttcttattaccatggtgcttgaattcaacttgagatcagaacagtgatactactaaccattcttttattattcaggattgttttagctattctgagttttttgtgttcccatataaagctgaaaattttccattcaagttctttgtagaataatgttggaattttgatgggattgctttgaatctttacattactttgataggaatgtcattttactatgttaatcctaccattccacaagcctggaacatctttcaatcttctgatatcttcttcattgactttcttcaatgttggagccggcctgtggctctcatgtccgggttcgagcctgggaggcaactggagctgaaaaagaagagcgaatctaggtgggttgagaaataatggaaccaagacacgctagtctgttcaaggttccaatgtttaattaaaaagtctgctcttataaagagggaaacccatcccctatcacgccaagtttcttgatgttgtcagcacagccttttagcagcaattcgccagattcacaggttgtagttaactctggaaagtcttggagaaccagttcagcctcacggcagatggcaggcaatatcacatcaaaagaaactatttgagtcagagaagcagcacggcaggtggccctgcctcagtggcatacagtctgaaccagcctgcctaggctgaaggaggttacatttccccccctttaaataatattaaataaaactggactgaggcataaattttatttttgctctatagtcctgcctgggagttatggtggctggcagctgtgcctgtcttaggatctcagattttcccaaaccatccaattccatcttggaggctacatgcagctagtttgtgttatatttcacacaaacatggctctgtggtgtgttatcaacagccacggccttttggcatgtacatctgtcttagattgatatggctcagaaatctggttgcccgtcattgactaaccagcccttatagcacaccttattcccaattcagacaaagaccacaatatgtacttagaatgcttcttggtgaagattaataactgccacctgcgctgttagaggcaaggctttacacctgctgcagttaggctgaacagcgtggctgacctgcttaagaaacaaaggtggggcagtgaaaagcaacagtataaaagcttctttggagaagtccaggtactccattcagttgcaaattaacaatgaccaagctagatctgagctcccagtgtgaaggagctggccttgagaatcacagaaaggctgtgatcttcctgggagaggaagctgtgctccaaattaactttgttaggtaaataagaatatttagctatctttaatatgaatctctaacactggagttattactagaccagtctaagattgagttagaa

SEQ ID NO: 114 - DNA, 1000 bp, mus musculus
ctttgtggctaggggtggaataaattgcactttttctaacatgtggtgcttctcgctttctagtatgtcgaagttcaccttcattatcaggatcaagttcttggtgtccatggccaagctcatgaccactgtgctcaggaagatgcgcatgaggatggccagggctatgtacacggtcaagtttgtgaacccggttatgctcatattgttcactgtgatcatggttggggaggaaacctggtgtattaacctccgagttttctttcttcctcttccctttttctttcctcctgaccttcactgacttcacttcagactgctcttgtgttttattggtctctggtgaagggctgtgaccgggctccccatgctcactgtgagcaacggagtcattatgaacgtgacgagtagtgttgtgatccaggtgatgatgcaaacgatggcgatgatggaagcggtgattgcggtcatgcaggtgtttatcatcagctttgatgggcagttcagctgcctctttctctggatcacatttgtggtttctttttgatgtcacactggttgtagtatgattttctgcatttaaatgattgtgaaaatgctggtgggtatgcgaatggaaatgctttccctcttgcactgccagaatgtctaagtgagaaacatgatcatggccaaggtcctcgtgattaatctcaacgactttgatctctccaaggcccaagtttgttaaaagtttctccagaccaaaaaatgataatcttccattttcaccataacggtcaaaaagtttttcaatatagtactttttttcattttcagcatcctgcactgaaaatttgcttgactctgactctgtcatcccacgatgatgtctgtgaagctcctcagggccatggtcatggtcttcatggcagtggttgcaatgatggaaaataaatgtcagtaaacagatgaggcaaaactttgtgtgtatatgcaccttcatttctacttttcctac

SEQ ID NO: 115 - DNA, 1000 bp, mus musculus
cccaaaagatttggtctctcactctctagggccgaggtctccaaagcctctcactctccacattgcctagttgtggagttctttcttaatagttctttgaccagtttgcagttggaccaaggtgggaaataaactgacatcatagtgaccaggatgtagcagagtgttggggctggcctgcggctctcatgtccgggttcgagcctgggaggcatcttagaactggaagagaagagggaatctaggcaggctgagaaataacggaaccaagacaactagtctgctcaaggttcaaatttttaatggcggacacgctttataaaggagaggggaaaacccattcccgccaaatcatccttggagcccagctgcaggtgaccacatgtagtctcctgaatagctaggccgactcccagcaggtagcagtagcagcaatagctgaacaatagagtgatccagggaggcatgctccaccctaagtaatctccttagtggcaagcaaagtcaagatctggctcagcctgcttcaggctgtgggaggctacagcagagttttccttgattacctcctattttttttccctgtttacatgccggtgtgggattgcctcttttctggacaaggtaaaggtattgtagatgctaccagacactgttgaaactctccttgtatatatttctcatcttgctttctggaagtcatctagccagatgctgttgaaactgtccttgccttcttttttgttgtttttttgtttgttttgttttgttttggttggttggttggttggttggttttttgttttttgttttttgttttttttaattaggtatttatttcatttacatttccaatgctatcccaaaagtcccccacctgctcccccacccactcccccacccacccactcccacttcttggccctggccttcccctgcactgaggcagataaagtttgcatgaccagtgggcctctctttccactgatggctgactagg

SEQ ID NO: 116 - DNA, 1000 bp, mus musculus
ggtttaaaaatagtgaaatataatttattcatgaagattgtttttatttaaaaaaaaacaggatagaatataaagatagatactaatctgaacagcttgcaggagttgcatgctgccactggagcccaactgtctatctttgggcttgctactcagtagggaggagccattcagaactcctgaatgtcctgtttctctgtggaaaccaacagggaccccaaaactatccagcttggaactctgccctaccaaactccttgccagctgatctctccaagacagagcctgaagaagtgagttgcatatggttcctggagctccattgtctagctctgggatcatgtctgagtccagaggagccttgagggacccaaagaacatcctttttccccatggacaacttctggggcaccaaactagtcatcttggaactgtgtcccaacaatcccattccagacatgtctgcccaccatctcagctggtatgcatgggaaacaggttcagaagtgagttgtacatggtccaggtctcctgagctacattgtctatatctaggttctccccttaagtccagaggattcttgaaagaactcaagagccttttcctacactatggaggtctgcagagaccccaagaactaacaacttgggatgtttactcaccaatcccatgccattggggtcttcctaagacatagccagcagagtcttgtactttaacctccattgtctggcccatggcttctctcaccttcctgagaaggcctgctgccatcaggatcatccagttaacaacagggaaaaccagatgcctaaagaacagcacaaaaatacaataaacaagaactaggacaatatggtaccaccagaggtcagctatcccattacaacaaaccctggatatcctaatgaaactcaagcacaagaacataaaatccaatcttataaggatggtagaggcctttaaagaggacatgaataagtctctaaagaaaataca

SEQ ID NO: 117 - DNA, 1000 bp, mus musculus
atttcctggttttccctcaaggaacaccctatctcatccctctcccacttcttctattagggtgtttccccacccacccacccactcccacctccctgacctgccattaccctacactagcgcatcaagccttcatggtagcaagggcttctcctcccactgatgcctgacaaggccatgctctgcacataggcagctggagccatgggtccctctttgtctgctctttggttggcggtttagtccctgggatctctgaggcgtctggttggttaatgctgttgttcttcctatcgggttgcaaacccctttaggtccttcagtcttttctctaactcctccattgagaaacccatgttcagtccagctgttggctgtgagcatctgcctctgtatttgtcagactctggcagatcttctcaggagacagctatattggctcatggcagcaagcaccttttggcatccacaatagtgtctgggtttggtgactatatatggggaagtctctggatggcctttcctgtaggctctgctccatacttcttctctgtatttccttctatgagtattttgttcccccttctaaaaagtactgaagtatccacactttggtcttccttcttcttgagcttcatttggtctatgaattgtatcttgggtattctgaacttttggactcatttccacttattagtgagtccataccatgtttgttcttttgtgattgggttacctcactcaggatgatattttctagttccatccatttcttctaatgcaacaatggctgcgtatgaacaaaaactccaagaatctagtagttgtttagttcacgaatctggatatcttagttggtcttcagtgtacattggaatcttgaagcctctaatgccagtgaagcaaaggactggaccaccaaccaggcagtgtacactagcggatatgaggccctcaacacacatacagcagtagactgcagggtctgtgttctatcaga

SEQ ID NO: 118 - DNA, 1800 bp, mus musculus
aagtatactgttaaattgttttcctccattggcagcttacagagaattttctgaaactatggaagtagaattaaaaaaaaaattgatgcgatctcatccctggacaaagaagtacaggtaattattaacacctagaaaaaataattaccctgtccccaaaatgagcccccttttggttgtccagtgccccattttagttggtcaacctcaaaaccatatacacagaaaacaataaccttggaaggttgtatataatacacacacacacacacagatacttataaacatacacacagacacatataaacacacacacacacacagagagagagagagagagagagagagagagagagagagagagagagagaaaccaaaaaaaaaaggctatgaatttaagagtgggggggtgcctcagggtgccacaggagtgttttaagaaagagagaatatctggaaggtactggaaggagagaagaacgtgttatgtgattctgtgtacatcccactttctatttccttgctgggtgttttgacttgaagaaatcttgaatgttcaaaaatagttcaatgagatcattcacttaataattttttgccctcatttttctgtataaaaattaacgacatttcctctattttattgtggtagggtaacattgaccaagaacaaaagtttatgagtcttagtaaactgagttgagtcctaaatctatgtctacaatgaaatgctgtctcagattttccccagtacaatgattcttatagatgtttaaaagtccacagagcctagctgacacagaaccaacatcctctgctagagttccatcttccctctggtctgttcctccacacaaccatatcagctggccccatctctcccacatcccacagccttccaatctctctgaaggtctgctgtaactagggacacagtgcttccagttccatcttcatctgcaagtgggagagagcctgtccctggaaccaaaatcctgcctggcccacaggagatctgcaaaaagcaggaacacaggaggactgcccttagcagggacacaggatgatgtttctaaccagggacaaaggagatatgctctaatcagggacacaggaggacaggagacctctcaaaccagagacagaattgccaggagccaagctctaacccaagtcacacagctcaaccagccaaggaggcctgttccagtcagagacacacaggttaggtaacaagagagaaaaccagatcttgagaggcaaatactagaagccaataaactcataagtaacagaagcaattcaacacaatcagagcccaattcttcaaaaagagcaagcctgggatactgtaacacacctgaaaagcaagattctgacctacaatctgatttcataaggatgatagaactctttaaggaggatatcaataactcccataaagaaatataggaggactcaagcaccggggtaccatgccagcggagtcgcccggcacccacaagggcccacacaggattccccacgggatcctaagacctctagtgagtggaacacaacttctgcaaggagtcctgttcgaacaccagatatctgggtaccttccctgcaagaagagagcttgcctgcagagaatactctgcccactcaaactaaggagagagctagcctcccaggtctgcttatagaggctaacagagtcacctgaagaacaagctcttacagagacagctataacagctagcttcagagattaccagatggcaaaaggcaaatgtaagaatcctactaacagaaatc

SEQ ID NO: 119 - DNA, 1000 bp, mus musculus
aggttcatagttttgtgagacttatgatcactttttttgtttgtttgtttttgagacagggtttctctgtgtagtcctggctgtcctggaactcactctgtagaccaggctggactcgaactaagaaatccccctgcctctacctcccaagtgctgggattaaaggtgtatgccaccactgcccaactgagcatttatagctttttatagtaatatgaagcaaatgcagtggggtgaaattaacaacttaatgcagcttcagtttttcagtctgtaccataagtatgggatctttttacaattaaggtattacagtaaagttttatgtagctatcaatagcattgactagagcctgtaatggtgggggtgggagctatgagagccattttgctaacaattcaaaattatataagctatttttggcaatgaggttctgtttggtagcatattataaaagtaacttttgttccccagatataattatcatctagaaggcttactcctgaataaaccagaattctagctggtttgctttgcttttctggcataaaccactctccaaattgactgattcaaattatcctctcttggactattattgggtagttctgctcagaaaaaaaactgcctctgaactacacaaactgactcctctgaaatcatctgaactccactgtattgcctgaactccactgaactgcactcactgaactgtcctcctcttcctcactgttctttaagtagtctctctttctcctcagagtttggtgtatcctatctttgactcagtctgccaaaactttttctgactcagctctttgtctgttccacaattagacatcattttgggggaatatagttgtgtgctaaagtcctgtctaatttgaggaccaggcctgtgttagcagtagttatgaagcatctcactgagtcccaaccaacaaccctgcctgtgtcccaagaggccagcactaacccaacacacataacaatcacaac

SEQ ID NO: 120 - DNA, 1200 bp, mus musculus
tccatctctagcttatattcttctatatacaaccctataagtttgggccagtccgggtaatacagggaaactatgatagttaatcttgcttgaaatcttggcaagatttgtattcaccaaagactataaattctccatacattatctagattagattacctgaggtggaaagatctacccaaatgtaagcagttcattttttaatatttccattaagttgtcttgtatgaggcatttggtctcaacaatgagaaaagtaactaacacagaccactctgtggtggtttgaaatagaaagtaccacatagctcctatatttgattgctttgtccctagctgcggatttgttttattgtgggaaggattattagatgtggccttgttggagaacatgtatcactctggtgcgtgttttgaagtttcagaagtgcatttcaggtccaaccttgctctttgtgactacaatttgaagattgggacctaagctttcagctagagctccaataccatggttcttggcagaattgctatatagtaatcatctgaaattgtaaccaagccctcaattagatgctttcttttataagtctcattgttttgtttgtttggttggttggttttgtttgtttgtttggttggtttttggcaatagaaaatgtggtgaagctgggcagtggtggcacatgcctttaatcccagcacttctgagttccaggccagcctggtctacagagtgagttccaggacagccagggctgcacagagaaaccctgattcacaaaagccaaagaaagaaagaaagaaagagagagagagagagagagagagagagagagagagagagagagagagagagagagaatctgtagtgtaaagtggatctaaaatgtcagtgctggtgacaatttctaaaaagggctctgacctggtataaagaagcctagaggcagacatttgctcaacagaaaagcagattttataaggtgaccaatttctgcctcccagtaacctcccttagtcacctcaaaagtcaactacctaaggtcagggaatctagttactgatcaatctgaacagtccatttcatctcaaaacccctgccctgatgacattctcataaaaccataaagtcagcttgtttttttgtttggttttttttttcgtatttttgcttctccatattccatgagagataacgtt

SEQ ID NO: 121 - DNA, 1200 bp, mus musculus
gagaatattattgaatagaagcttgtgataatgatgctatagtgctgagaaaatagttttagtctacaacacagcaagacagaagtaggactggatatagacatggcaggagtgtatggagattgtcaggttatgggtcctgaatctgctccaccacatggcttgtcgcctcctggaggaaggacacaggaattttgactatgcttagcccatggctaggtgtgggcaggaggaaggagatctggctggccttggcttgaaggtggtggtgggcttgagtttggcttggcagccatggctgggagcacacaaagggaaattagacagcagctttataggcataggccttctccatggctcccatagcagattatgatgaaaagaggcagtccatggttttttttttttttttttttttttgttttgtttttattggatattttctttatttacatctcaaacattatcccctttcctggtttcccctccaaaaaatacccttcccctaccccctgtccctgctccccccactcaccaacccacccactcctgcttcctgaccctggcattcccccacactgggagatagagccttcataggacaaagggcctctcccccattgatgtccgactaggcaatcctctgctgcatatgcagctggagccatgagtcctaccatgtgtgctctttggttgatggtttagtccctgggagctctgagggtactggttagctatgttgattgctggctgtgttgagctttgagatttagtcactgaatgtaatggagtcctttatcagccaacatacacagaggatgttgaggagttcccaacaacacaagcaccagggggcacccaaggaccatggacagagaatgtggtcatgtgataggcagctactgtgtttgattctgtgtcatgaggaatgtgctattgttttagaagtgggggaaaaccccagaagcatcatgggatgcagcgatttgtccgtgttctgctggtcgcagagatcagacatgctgaggaacatgatttgctgaccactgagccagtgctctggtgtctacccttctgctttccccaggctgatgatggttgcacacgagcctcccgtgcaggtttctttttttttttttttttttttctttccattttttattaggtatttagctcatttacatttccaatgctatacca

SEQ ID NO: 122 - DNA, 1000 bp, mus musculus
ggataaatgagtgtctttgtggtggatagtcaatgggcaaggcaggcaatagtgatctgccaaaggactcgggaactcctgtcaaaagagacctctgaggtgagattacccgactatagccatgtggtcctctgcttgccagtttttttttttttaacattttttattagatatattcttcattacaattcaaatgctatttccgaaagtcccttataccttccctccgccctgctccccaacttgcccactcccacttcctggtcctggcattccccagtattggggcatatgatctttgcaagaccaagggcctcttcttccaatgatggctgactaggccatcttctgttacatatgcagctggagacacaagctcaggaggtactggttagttcatatttttgttccacctacagggttgcagaccccttcagacccttgggtgctttttgttgctcttctattgggggccctgtgcttcatccaatagatgactatgagcatctacttttatatttgccaggctctggcatagcctcacaagagacagctatattggggttatgtcagcaaaatcttgctggcatatgcaatagtgtctgcatttggtggttggttatggtatggatccccagatgaggtagtctttggatagtccttccttctgtctcagcttcaaactttgtctgtgtaatatcttccatgggaattttgttccccattttaaggaggaatgaagtatctacacttgtcgacctacttcttgattttcatgtgttttgcaaattttatcttgggtattgtgtgcatctgtctgtcatttcatccaacgctttgcccacctgtgactagagacccattccacgcagacaaaggggcccagagggtctgtgttagggtattctaagtttctgggctaatatccacttatcagtgagtgcatatcatgtgagttcttttgtgattgggttacctcactcaggatgatatcctccag

SEQ ID NO: 123 - DNA, 1400 bp, mus musculus
gggcattgtgaagtgtcctaaacgataaccctttgtatctttactccattctcctgagagaaaggataagatttttagatttgttttttcatgtaataactgcaactcttactatggtttgcttgctgttttatatggtgtaatgagcatgctttaaagtaaatgtactttccaagtgttttccatacccaatggctccagatggatcaaatttttgtctgtgttttactttaaactatctttaatgcaatctcaaaagtgttatgtagaaagctttacatttctaggcctgaaaagtaaacacacatacgtcccatggggcaatgttagaaaattacatattctaagtgtcaattctcatgctgtcaagttcagccacttttcaaaatatagcatatgttcttttctagttaaaaaaaaatactgacattaaagtcgtgtcagagttttcaaaaagatatcatgaaaaaaagcctagataattcagttctttggcaaaaaagaatgataaatgactcatgctgaaaagtgggcagttatatcacataagaagataatgactaaaagctttccaaatagctgcctgactacagccaagaaggtggtcggcatgctggtttagcagaatgcagggctgattgccagtctttttttgagcaaagcagctattcatttcacctgcaaaatctgtggttcacactgacattacacaaaatgaaaaacaaggcagtggctatttttagggtcagataatagagaggtaaagtaaaataaaggcacctttcctacatggagacataacctttcttccacattgtctttatgtgtgcatgtgtttgtgtataatttttgttgaaattgcattgtaaaaatggaatgtagttctcagtaatactactattaccactttgtgtaagagtatagatttaacaaacacagttgtattattttgaatgcatgagtacatatatctaaaattattttcactttaaccaatcctacataatactagctgtcaatccaatataaaaccaaaattcattaattgtgaaagaataaaaccagaaatgtttagtcaaaatcaattataatagatctctatgcatacctatgtatacctctgtaacaaattcatacactcaaatacaaacatatgaacagtataaaaattgatacacatacatacgtacccacatatacagacagcatataagttataacataagacaaagataaagaaatatggaaaacacattctatgtatttatgtgaacacaaatactaatcaataatgctgaatataaatgagttataattaaaactaattaaatgtggatattatcaagtagaaattgctcatcctggtaatagaaatattacaaagtgtatataaaagtgaa

SEQ ID NO: 124 - DNA, 1200 bp, mus musculus
aactagaaaaaaaaaagtatcctaaagtatcctaaaaaaagtatatttgcttttgtgtggagattaaatggatatcaaaactattacatgtagacccgcaaagcttaggtgtaggttaagggcctagtgggtatacaaacagagcttattaggaaagaaatagaatagatagttatagatgtgtgtgagaattggaagagaaggatcatcagagatggattagggagaaaatattgggagagacaattaaaattagggccatttaatggtttgattggaaaagaaatagactaattactgtgcatgacaactctagctattgcccacataaagatttcatccctagccaggcaatggtggtgcatgcctttaatccccgcacttgggaggcagagtcaggcagatttctgagttcaaggccagccgggtctgaagagtgagttccaggagagccagagctatacagagaaaagctgtctcaaaaaaaaaaaaaaaaaaaaaaaaaaaaaaaaaaaaaaaaaagaggaacagggacacaggaaacctgccctaccagctgctggggttcattctggttggcgccagccccaggccaccttgggcaggaaatcggcagaaggtccaatggtccctagaggactctccatgctgcaagcgccctatcatatccaggatccaagggtcattgctctgggttaaagacaaagcttcctagaaaagcaagaagaaggaattataagaattgttgcttggcatttgaatgatggcatcttagttagagttgtagtttctttttaaaaatttatttttgactctgtgcaccttccctgccagaggacagttggcctccagggagggcactgacccgtggactcaggtgagagcacaatcttgtatcccaggtctctcagagaccagtccactcaggagagcatgtgggccacaaaagcaacccagcttctaggacagggtcccttcaggccttcatcttcagccaagtagcaaagctgatctccatacctctgtgcaccttccctgcaagaggagagcttgcctggaaagagtgctctgaccattttgacttaggagagagtttgactcccaggagtgctgacagaggctaacagaatcacaggaggaacaagcaacagccagagacagctcaatcatctaacaccagagattaccagatggtgagag

SEQ ID NO: 125 - DNA, 1000 bp, mus musculus
agccccaaagctcaaaatgaccgggatacaatccacaaaccattttcagcttaggaagaaaacaggccatggtatgggtgcttcagtcctgcatagtctggggaacaggatgattctggagatggagggaaacagtgttgggagggacataatagggagagggcaagggggtcaagtcaaggtactagagggttcagaggacattacagagggtcaagaaatcaaataaaaaaatgtagcagtggtgaatgaggaactggggttatgcaaaggagggtgcaagaagccagggaagcaagtggttcccaggacccagtagggatgactttagtggaaatgcacagcaaacatgaggtagaacctgtagagaccatctccagtagataggcacggtccccagtctaaggatgtgggcacccaccgatcctaaagtttttaatccagaagtgtttctgtccaaagggaagacagggagaaaaatggaggagcctgaagaaaagactctctggagactgcccacctggaaatccaccctatctgtaaacaccaaataggacattgttgctgttgtcaagaggagtttgctggcaagaacttggtgtggctgtcccatgggagtttcagccaaccattagactaagtaccaggacccctatgggggagctggcagaagcactggaggggctgaagggaactgcaaccctataggaaaaacaatgttgactgcctagactaccacatgctcccagggtctagaccaccaaccaagaagtatatagggagagatccatggctccaggtagccatgtagcagaggatgaacttgtctgacatcagtgagaggtgaggacctttgtcctgtggaggtttgatgctctagtgcagtgggaatttaatggtggggcaggaatgattgggtaggtggaggagctctctcatagaggcaaaggggaggcaatgggatagggaggttctggaggggtacccaagaagggggata

SEQ ID NO: 126 - DNA, 1200 bp, mus musculus
agttactgtaagattcaaacatccatattctcgtgtcacatacatttttttttgtattgggcacaaataataaacaagtaagtagaaacatgaaatataaagtagtaaatctattattaaatgcgtaaagcaaggtaaaaataatagaaagataagatcagtgtctatattagataatggaaattccctcatttctcctgcaggaatttctattctatgtgacaaacaataataaccttggttaaaaatggtttacattctagctgttctccaggataatgctatttttttaattattaggttagatttctttatttgtatttcgaatgttatcccctttcctggtttcccctccaaaaaacccctatcccatccccgcttccactgctcatcaacccacgcactcccatttccctgccctggcattccactaccccgagcatctagcctttacaggaccaagggcctctcctcccattgatgcccaacaagaccatcctctactacatatgcagctggaaccatgggttcctccttccatgtgttcaatttggttggtattttagtcctacggggctctggggttggttctctggttggttcacattgttgttcatcctataagactacagacctcttcagctccttggatcttttctctagtggggaccctgtgctaagtacaatggttgactgagagcatccacatcagtatttgttaggcactggcacatcctctcaggagatagctttatcaggctcctgtcagcaagcacttgttggcatccacaataatttttgggtttggtgactgtgtatggaatagaaccccaggtgaggcagtctctggatggactttctttcagtctctgctccacactttgtctctgtatctcctcccatgatattttgatgccccttctaaggatcagagtatccacactttggtcttccctcttcttgagtttcagttggtctgtgaattgtatcttgggtattttgagcttctgggctaatatccacatatcagtgagtgcataccatgtgtgttcttttgggattgggttacctcactcaggatgaagtattttagttccatccatttgcctaagaatttcatgaaatcattgtttttaatagctgcatagtactccattgtgtaattgtaccccattttctgtatccattcctttgttgagg

SEQ ID NO: 127 - DNA, 1000 bp, mus musculus
tactttgggattctgaatggcaagacaccagtaagaaaactgccactttaaatgctcagactggtaatctagactggggtagtaacatgcttctgggagaaagtccatatgagggccaggctaatcagattggttttctcgttggaatttacacacagatcgtggcggctgcccatcgtgcttggggacagttaccggttacagcggatgttggtgggagtttagccagcattcggcattgttctgatgagccttaccagaactttgtggataggctattaatagcagctagtagaatccttggaaaatctgacacgggaagttctttcgttatgcaattggcttatgagaatgctaacgcaatgtgtcacgccactatccagccgcacaaagtacaagcagatttagcaggatatgtctgtctttgtgcagaaatcaggccgtcatataatcagggtttggctttcagcgctgcttcgaaagggaccaccatacaagcaatgttctcacagaaacaagggaataatgcatgttttaactgtgaaagtttgggtcattttaaaagtgattgtcctaagaacaaaggtgctgagagtgggcaagcaggccttgccacaggaattttgtccccggtgcagaaagggcaaccactgggctaaggtgtgcaaatccaagccaggcacactgggccttctggtgccaggaaatgagaggaggggtcagccccaggtcctgacttactcacagaaaacagcttatggggctacaaacctgctgcccagccaaagagatcagtttttgaacttgtcagggcaaaaccaagaggtgcaggattggtcctctgttccaccacccatgcagtattaaccccagaaatgggagtccaaactctggcaactggagtctttggaccgttacctgtagaaacttgtggatttcttttaggatgaagcagttctattgtaaaaggcctgaagatttatccaggtgttataaataa

SEQ ID NO: 128 - DNA, 1000 bp, mus musculus
ccacttggcagcaaatactggtgacagaaaagtgtcacagtcaagaaataaccagctaagccaacatattcatttcattagtcatcttactgttcttccatagtaaaatcataggcagaacaatctctagtatttgaccagtatttctgaaacagacatatttattagaatagtaaacaaaattcccttgaaaacaaaactcaaaagttaacattgtttatggatgtatatttaagttttggattctggaacattaaggggcagagaaaacaaagaagaaaactgagataaaatcgagatttacttctttgttgttgttgttgttgttggttttgtttatatttttcaagacagggtttctctgtgtagccctggctgtcctggaactcactttgtagaccaggctggccttgaactcagaaatctgcctgtgtctgcctccccagtgctgggattaaaggtgtgtgccaacatgcccagcaaggaaggattacttcttaaaatgacctgtttctggcaaagacacagggaaaagagaatgctaatgtccatttacatctatttgcttagctatgtgatcaggtatctaaacttaacaactgctgacataccatcagcaaggttctccatatcacttagacttttcctctagaaaactaagcactgacttgaagcaaaagtgcgttattgaagtcacaataaaaggaaaatacttaaaaacaatgaagccaaactatgttccctgtggaccaaagtccattagattttgcttatcatttaccatgatgtagctaggtgaatccaccagattaacctctttatatgcccttctcaatccatgtccagtctaatctgggtactactacttatgcgacccccaaaaattacatgttttcccctagacacacacatcatacacatcccaccaacactatcaaaccacatacaccatattcaaatgtccattacactgttatctttgacattctggctagggtaa

SEQ ID NO: 129 - DNA, 1400 bp, mus musculus
gaaaagtaccatgttatttaaataattttataaataaattagtattagaattgtagttacaggagtttgaggatatcagagggaagagaattggtagtaataggtagtccttatgttatagtttaatacaagaaattctagtaatctactgcagagtaggatgattacaaaattgtatatatgtatttatcataaagaatagttttgaataatattttctgataaattataagtattcagaaaactgtttagttttcctttatttaaaaattacttttaaaatatctatatgaagtagaattaataatatgttccataatgccaggaaatcattggaaggaaacaaaaatttactttcattaattaatttccaaaattagtttatggaatttagatatagtctctgatctacaaagacattatagtttaatgcatgcataaccagaattaggatttatagccagaaattagcttgagggattaactcaccagttttaagaacagtgaaatgcccaatgagttttatttgtaaaaccaccatattggctaggaagtgggggcacagacctttaatcccagcacttggggacagaggcagggggatttctgagttcgaggacagcctggtctacagattgagttccaggacagccagggatacacagagaaaccctgtctcacaaaaaaacaaaacaaagcaaaacaactcaccatattaatactgaaaaagtaatagactaccccgactaaaagtacacaaatatatataaatgggacctttcaaactcagcctttaacttttctcatttaacctgtaaacacacacacacacacacacacacacacacacacacacacacaattaaataggtaaatccatgaacattttaattttgttaaaactaagtttatgatcaatactgcttctctcataaaacttactttaaactagtagaaaagcttaaatactacaaagaagaaaaagtcacttttaattgtagatccttgtcttcaagtcattttaataaaatgattgcttttattattactaagattcaaaacatgtcaggaaatagcatttatcctactttgtatttaataaactcacagaaagggaaaaggtctacactgaatagttaaatcaactgtcatattacacaaccattatttatttatttagtgtaggagatattaatagaactacagacatattagaacaataatattcccagcacattaataatgcaaatgactcatggaggttaattacatctaagatgaacaagtttcgttcaaagtgatctttctctagatgcccactccacctccgtaagaaactgttcttaagatctaccccttgtcttctaaaaaccatcctatatatgggcctataatcttta

SEQ ID NO: 130 - DNA, 1000 bp, mus musculus
ctttcctttttttagttttttaattagatattttcttcatttacatttcaagtgctatacccaaagttccctataccctccctctgccctgctcccaaacccacccactcctgcttcttggccctggcattcccctctactggggcatatgattttcacaagaccaagggcctctcctcccattgatggccaactaggccatcctctggtacatatgcaaatagagacacagctcttggggatactggttagttcatattgttcttcttatagggtttcagacccctttagttccttgggtactttctctagctcctgcattgggggccctgtgttccatccaatagatggctgtgagcatccacttctgtatttgccaggtactggcatagccttacaagagagagctttatcagtgccctgtcagtaaaagctttctggcatatgcaattgtgtctgggtttagtggttgtatattggatggatcccagggtggggtagtctctggatggtccttccttctgtctcagctcagaactttgtctctgtaactccttccagaagtattttgttctccattctaagaaggaatgaagtatctacacattggtcttccttcttcttgagtttcatgtgttttgcaaattgtatcttgggtattctaagattctggactaataaccgcttatcaatgagtccatatcatgtgtgttcttttgtgattgagttacctcattcaggataatatcctccagatccatcaatttgcctaagaatttcaggaacccattgtttttaattgctgagtagataaacaggttatgtgcaaatctttatttgagagtttttaaatggtttcattagcaatactaggtttaaggttttttttttttttctttaacttgttttgtattagaatatttctggctcatcaaaaatatttgggatgtttcttttgcttcaatttttaaaaatagtttaaaaaagaatgactgtcgat

SEQ ID NO: 131 - DNA, 1000 bp, mus musculus
gcattttccctcacacggtggctcatctgggttcaagatagaaaggtacagaggcaaaacatgggtttgccagagggtaccacaaaggctttggggattggaagcatggggctggcatgctagtgaactgccagtgggaacctagcaagctaggtggagatattatggagtgcttagtcagagtctctatgagataaaaacaggtcagacattgccagccagtacatgattggcccggccacttgggcagaggcacaagtgtgggaatgtggcagttctattttttcaatacttccggcaacagataggagcctgttgtcctctgaaaggctctacccagcagctgattcagaaagatacagacatgtacagccaaagagtgaatggagcttggggactcttatggaagaataggatgaagaattgtgggttccaaaggggatagaaattcaacaggaagaaaaaacagaatcaactaatctggacccttgggctcttggagttttatccaccattcatagaaaatacaggggccagacctagacttccctgcacatatatagaggatgtgcagctttgtcttcatgatggtgctcaacaactggaatggggtctatcccaaaatctgctgcctctatgtgggatatgttttcctagctgggctgttttgtttggtctcagtgggagacttgaagtgccagggtggagggataccaatgtctttacctgctcagaggagaaggggatgaggaatgggagacacggggtgggggtgagattgtagatggggatgatcaggaggcggggcagtgggcaggatataaagtgaataattaaaaaataaaattatatttaataataaatatatcctgcattaatatcactaaaattttacttaatcaaaatgaatttccttactgactttattttaattatttgcagattagttttacatttctgcttcatgactgactagaattcaggaagcttggaggtatac

SEQ ID NO: 132 - DNA, 1200 bp, mus musculus
tttttttgtttgtttgtttgttttgttttttgttttttttgagagcacagaggtgttccagagatagccaacgttgcaccttgtgctgtggctggacttggtaatgtgtaagagttacccaggtggtactggttttgaaggcatgaacgggtcacacagagcagctgaggctcggtaccatgagaggccatggaaggccattagtgaagatgcagcctcatttgcaattaatggcccaggactgaaggggccatgcagttttttggagatgccagtaccacgagatgacccccaagagcagcagcactggagttcaggcatctggagcctagagaatgatgtgtgtgctacaaagggcatggctggagaagtgaccgaagcccttggaggagcccagaaaatcgtgacttggatcccagacactggacagttggagcttgattttgcttttcattgtgactgtgccctgatatgtttccctctggaagggagttttttttagtgaagcccacagttaagagacttttaactgtaaagactttggattttaagagagattgaaattttaagaatttgtaaagactgtgggacttttaaaattatttagatcttggggatgaaaaagaaactaagggttgaggcttaccagtcatgtgtttttgtgtcaaggtgacaaggggtcaattgtactggctagttttgtgtcaacttgacacagctagagttatcacagagaaaggagcttcagttgaggaaatgcctccacgagatccaactgtaaggcattttctccattagtgaccaaaggagaaaggccccttgtgggtgggaccatctctgggctggtaatcttggttctataacatagcaggctgagcaagccaggagaagcaagccagtaatgaacatccctccaaggcctctgcatcagttcctgcttcttgatctgcttgacttccagtcttgacttccttggtgataaacagcagtatggaagtataagctgaataaaccctttcctccccaaattgcttcttggtcatgatgtttgtgcagaagtagaaaccccatctaagacatcttattgacagtatcctttgccttacataagtttttcaattttatgaggtctcatctgtctatttttgatcttagagcctgagccattgattttctattcaggaaaatttcctctgttca

SEQ ID NO: 133 - DNA, 1600 bp, mus musculus
acaattggttattttaacttctttgtatatgttgtgtagagccacatttctctatttcagagaatttttcatttgggatgtaatgttttgtagactcatttaatttattatttcattaaaatctaagtttctccattttgggcaggtggtctcacagctgtttattgatcaatgtgtgccattgaaaccatcccctattgctctatgtttaatctgtgataatctgtcactttatatcaaccagtatctgttttataaaactggtttcacttgtgttagaaacacatatatttagtattgttgatttctcaaggtggattttctttgactcagtataaagtgactttgtttttttctcttctgagtggattttattggatatttaccttatcagatattagaaaatgatgccccagctctctagttacattttcttggctttgttgtcatgaattcatttagccttcttttacagtgaagtggcttagttgtccatcaagtgtgttaaatatagtagcttatgttggcagctgtgccttgggatataaaatacatggttccatagtcttatgaatttttgtatttctgtttttaatttaatttttaatttttaaattatttttagaaattaataatttttattaagaacattttattagatattttctttatttacattttaaatgttatccttttcctgatttcccttctgaaaccccctccccctcctcccttccccattccctagatcaccaacccacccactccagctcctggccctgccattcccctatactggggcacagaaccttcacaggaccaggggcctttcctcccattgatgaccaactaggccattctctgctaatcatggagctagagccatgagtcccaccatgtgctttctttggttggtggcttagtcccagggacctctaggggtactggttagtacatattgttgttcctcctatagggctgcaaaccccttcagtttcttgggtcctttctccagctctttcattgaggaacttatgcaccattcaatggatggttgtgacaatccacttctgtatttgtcagacagtggcaaaacttctccgggacagctatatgaggctcctgtcagcaagcatttctgttgagaagttaaatatgttctgataggtggtctttggtatttatctctaaaacatttcagtacattttctgttctgtgttctttagtcttttaactatactatggcatatgtagaattaccattttcctcttatctatttgtaaactacatgtctttcttcgtcatgtggcatcagccttcagtatgttgagaaaataatatttactgtaaaatctcaatgcctgccccatgactaacttcttctaggaagactcaaatcactaatattccatgtccctcccaaataattcttgcagcagataccaattattcaaatacctgagcttctagtgcagtttatatttacatcaaaagagtgaagaaaaaacttacaaatttaattattaataatatatattaaatgcccatcataacaaaatgctgttttgcttgatacgttttccctttgaaaaactaaa

SEQ ID NO: 134 - DNA, 1400 bp, mus musculus
agtacccccagagctcccagggactaaaacaccaaccaaagggtacacatggagggaaccttgtctctagccggatatgtagcagaggatggccttgtgggacatcatgagagggaaggtccttggtcttgtgaaagctccttgccccagtgtaggggaatgccaggacagggaagtgggagtgtgtcagttagtaagcaaagggagggggaattggatagggcaattttcggaagggaagtgtttggaattaagatgtaggggaaggagggggagggaaagaatgcccctgtcctgccagagttcctcctatgctctgggtagacagactctgaaaggcttccagctgctttccactcggccttgggtggccatcaaagccactgaccccacttgatgggggaggggagtatacaaggggcagcccctgataccaggggcccttgccccggggatatgagagagagggcagaaggagagaggctcccaggcaggtgagagaccttagttctggccttgactagagcacaggaaggccttccattgggagattagaaatgtctcattaagagaaagcctttgttcaagcacagtgggccttgataaacagagacagtctatggttttagagctttattgtagaaagtcagggggaaagagagaagagggaaagagggagagaccagccatggccaagaagagagaagggggaaaggaagaaagaaagagaagaaagagagaagaaaggctagagtaagagcgagaggacaagagggagagagagtaatagagtgagaggagagagtgaggagaagttagaaagtgaggtggcttcaagcagcccctcttatggtgggctgttatcttactgttgctaggcaactgggaggagtttagcctgaaagtcagaagcttgggacattgtctatgtgactactagccacacttctcctgtgggggctgtgggagtggtaactttgatagaagccaagattccaggagacatgagggaaagcctatcaccccatgtaggtgaattatcaccattcaggttctactggggttcagaccttaactcgactggagaccagactgtctgtgcatagcccaatgccccacagggaaatgagaaaaggtgataaaatttgcaatgtaaataaagaaaacatctaatatataacaaaactttcccttgacatagttaataagcaatattgagaattatttatacaattctatttcatactgtatttttgctatttattctgtagccatatatatacatatacatatatatatgtatgtatgtatgtatgtatatatatcctttgtttagtttataagcatcagatagacattatagaaacctacaactgttcaaaatttacagaataaatgat

SEQ ID NO: 135 - DNA, 1000 bp, mus musculus
gggcaagatcctacacagctaaattattggttgtgtgtgcagttgaacaaggaatagatttgacttttaatctggaatgaactacaatgtagaaatgaaggatacacttttgatccaaattttgaggctagaaggcacagtcttttgacagggaacttgaaaagtggccaataagaaggtctcacccacacttcaggtcagtgccagctcctggccaccttgggcacaaaatctgcagatggcctctaggtccccagaggactctttccacaatcttaggatcactggtgagtggaacacaacatctgttccaaaccactcatgacaggcctgtgacagcaggagcaaggacacgggaaccctgcctgaccagcatctcgggttccttctgatcagtgctggtataccttggtttcaaatgcaccagagagatacactgtccccagaggagacaccactttaggcactgtaacatgcccaggatcttaagattctgaatcccaggaaagtaggagcttggtcataaaaggatctcagggtttcagaggaagcttaactacaaagaactgtgacacacccagaatctaaggttcacaggagcccagaatcacaggatcacagagaaagctggactctgaggagtcctgaatcaacctgtattatgggaaggacagactccaatcatatatattaagaaaagcaagtacttgaaataatcagatggcagagagaaagcataagaacagaagcaaggttacttggcatcatcagaaccaaactctccctcaatagcaagtcctagatacaccatcataccagaaaagcaaaatatggacctaaagtcacttctcatgatgatgatggaggattttaagacagaaataaataactcacttaaagaaatacaggaaaacacaggtaaatagctagaagcccttaaagaggaaacataaatatcccttaaagagttacaggaaaacagtaccaaacaggtgaaaga

SEQ ID NO: 136 - DNA, 1400 bp, mus musculus
catttccatatataatctacttataaaacatataaataatcaaattcatatgcgtattgaataaaagtcagaggactatgacataattatgataagagctgagttttctactgtgttatattttagtttgattttgctcatttggataatgttgtacatagcaattatatgaactagaatttataggtattaattatgaaatatgattgtttaggttttgtctgatgtctaaaatatggatttgccattaataatactctcttcaacaacaccaacctgtatgtataagaactgtggaacttactatatattctaccaatgggagagttgtgaagaaaaacataaatataataaggtgagtctgctgtgcaggagagagtgcagactgcagaagctacacagcttctgggacagacagaagcaacacagcttttgggacagatccccatttcgggctccagacatccaggcaccttccccgccagagaagaggtgactgcctggtagggctatgactgcctgagcaggtgagagagccatcttgtgtcccaggtccattggagaccagtctgcgcaggtcagctcgctgactgcagaggcaagacatcttctggaacaggacctgtttcaggccttcatcttcagccaggaggcaggtctgaatgtcagacctttgtgcacctttcctataagaggagagcttgcctacagagagtactctgaccaatgagactcaagagagatctagactcccaggacagctgacagaggctaacagaataaaaagaggaaccagctccaaccagagacaactataacaactgacaccagagattaccagatggcaaaaggcaaaaataagaatcttactaacagaaaccaataccactcaccatcatcagaagccaggactcccaactcagccagtctcagataccccaacacaaccaaaaaacaagacttgaatcatatctgatgatgctgatagaggactttaagaagggcattaataactcacttaaataaatacaggagctgagcttggtagcgcaggtcttaaatcccagaactctggaggcagaggcaggcgtatttctgagtttgaggacagcctggtctacaaagtgagttccacgacagccagggctatacagaaaaaccctgtcgcgaaaaacaaacaaacaaacaaacaaacaaacaaacaagaaaagaaggaaggaaggaaggaaggaaggaaggaaggaaggaaggaaagaaagaaagaaagaaagaaagaaagaaagaaagaaagaaagaaagaaagaaaaagaaatacaggagaacactgctaaagaggtagaagtccttaaaaaattacaagaaaacacaaccaaacagatgatggaattgaacaaaaccaa

SEQ ID NO: 137 - DNA, 1000 bp, mus musculus
tccatggagtgcacaaagacaacccatctggaaaaaaataccctttgagatagcccccattccagttgatcagaaccattatgaaaaccaagttgcacatttgctacatatgtgtgaggggcctaggttcagcctatgtatgctctttgattggtggatcagtctctgagagccacaaaagtccaggttagtagacactgcttgtcttcctgtgaagttcctatcaacataggggctacaattcttcctcctcttcttccataagtgtcctaaacctttatctactgtttgcctgtgagtctctgcatccttctgactcagctgatgggtggagcctctcatagtacagctatgctacactcctatctgcaagtataacagagtatcactaatagtgcttgcccatggaatggatctctagttgagtcaattactatttggttattccctcagtctctgctccatcttctgtccctgcatttcttgtagacagggtaaattttgagtcaaaaatgttgtgtgagggtcagtgtccctgttgttccactgtggatcctctatctctgccatgccttcctggttacttggttgcttcatgcttctctgcactgagtcgggtttggctggaccaacaagaggtcaactagcctgcgaggagttcatctcagcttcaggtggcacttcaggaagtcagaattcttcctagttgttacagcttttaagacagaaggcttagatgatggagtagttctcacacacctttaattcttccagaaaggattcttatatacagttttggggtgggaaagggtctgaccaaagatacttctcattggtttggtctgaaatctttgggggaaactttattcgcatgcaggagggcttagtgctgcccctacttgactgatggccacatacttctctgtggagggctctgggatgctgtcgttataacaagagtcagtggctcaggaggcatggttgaataccttccatcccg

SEQ ID NO: 138 - DNA, 1200 bp, mus musculus
gacagctgctatgtctcatctttccctattcccaccagatacacatctagactggtaaaaacctacacattcctaactctggatctgttagtgaaaatcaaaagctcagaaaaccattttgtgcaataggacccttatctgagccagcctttagaaggaatgcaaacctctagccaacctttgttcccaaactattctgaacatgcttgagatgtcttccctactgttccaagcagccttttttatgccaagactttccacactctactgtctaccttatcagtcttggtatctgacccaaattgtaggaagatcatcagtctcaactaactgggaccccagggagctcagcaacatacacggactggtctgaggctcccaacatatagatagcagaggactgcctagcctcagtgagagaagaagcactgaatcctcgagagacttgagaccccagggaaaaggaagggcctgggaggacccatcctccctcatccttccctcccactccttccctctcaccccctccctgttatggggaagaaagaatgggatgaggaactgtggggtgggggactgataggaggtcaatagctggaatgtaaaaatataataaagtaagataaaataaaataaacaattaatttttagcttcagggcgaccagaacaaggatggttttgagaggaaagctgctgaaattcagacacagcaatagggagcttctccagtggctatgctccatacaactgggctcattgaaaagatgttggcttgactgaaaatgtagactagggaagctgacaacataagaggaagagcaagaaccagaagacttactgagggatgatacccattggcaagatctggaaacccaggaagtgaagaagcagaagccttctgcaaaggctaggcttacaacaggggctcagtgtcaggcacatgtgccaaaaatcaaaggatccttctctgttctttactctttcctaatcacttgcatacctcatactaccaaacattaaaaacattaaattaaacattaagatattcgtgtctacatgacataagccacaggactggaaaagatacagtgagtttctatgaaagacaaacctaacatggtaataatacattttttaataacatgcagtactttttaaattgcaaatggaataagatatgtcaactgataagaactttt

SEQ ID NO: 139 - DNA, 1000 bp, mus musculus
acttttcatattactttttaattttgtgtatatgcatcaggtaaggtatatgcaattgtaaatgtaggtacctaaaaagtccagtcgaatgagtcagaatctggagttagaggaggtggggggaggtctgagccacctaacatgagtgctggaaaccaatttggggtcttcttggagagctgtgaatgctattaaccactattggagagccatctcttcacccaatattacttcctgtttgatgagccaaatcaatctctctctctctctctctctctctctctctctctctctctttgtgtgtgtgtgtgtgtgtgtgtgtgtgtgtgtgtgtgtgtgtgtgcatgtgtgtgtgtcacacacacacacgttgagacagaaagcagccagcatttgcctcagtgcaagtcctggcgcagagtttagcagcaacagcacctctagcaccagcacaaccaacactccttccctctggcacagttgtctcctgtccttgaacaaagcagaaaattaatgtccttaaggtgataagacacacacacacacacacacacacacacacacacacacacacaccacccttaaactaagggaaagagaaaaccaagcattcccagcagtcgaaaagagacataacagctgtggccaacttgtaacaacagggaagaatgcactggtcattgataaagggaagagttatttcttcccaggtcaaaggtttctgtccaaatgtatggtccctccttgctgtctgaacaaacgttaactgtttgaaggaaagcattctttaccccttacccaatcacataatgccaagacttgaaagtcccaagttctgcatttcccctatataaacccggagcccctagacctggcaattgcatttctaatctgctgagcaaggaggattgcatccaggcttcgaacttgaataaacagactctcatgtgcttccattggcattgtggtccctggcagtcttctggggttcttgtgcact

SEQ ID NO: 140 - DNA, 1000 bp, mus musculus
ttctttccttcttgtgaattatatcttcttttcatacacaatagttaatgtagcacgtagcttctactaccctgctttaagctcctggcagatcattctgccagcccccctcctgtgattcccttggatctgtgatgaaagacacacacacacacacacacacacacacacacacacacacacacacacactaacttctttttcacatgtgtttagctcaatggctgggcacatctaagcctccctaccactaatgtgcccttaccttcactgccagctcaacacctctaaatctgccctctaacatagttgctcagttacatttagtcctagctcaacaccttgaaatctgccctcaatttagttactcggtaacctttagttctagctcaacaactttaaatctgtccttaacctagctgcccaggtactttttccttgctcagcaccctaaatctgccctcagcttagttgtgtttctaatctcctgtctgctactccaggccaagtcggagaagcggccaatggccacttcccatgagatcttacatggctggctgctctctccccctctgaagcatggaggatcctttgtttccctttttgtctctcctaatcttcgagagtaacctagaaatcccacctcttcttcccagccattggccataagcatctttattgattgatcaagaatgagttggggaacaggaccttcagggttcacatgagcatccctgatcaaagcaacagaagcactccctacaagttaagaaaatagggaatctttagaaagattttcttactccatagcccatcctaccctctaaccaagagcttcctgcctcagcctctgcactgctaggattgtgcgcatgcatcaccacacacaatctttgaatatgatttttaaatttagtttcagtttattaacttgtgtagtgtatgcaacaatctaaataatagccattttttgtccctactttacacctggagcacttga

SEQ ID NO: 141 - DNA, 1000 bp, mus musculus
ggtgtatggctttgttggaggatgtatgtcactgagggcaagctttgatgttttgaaagcccgtgccattccaggcagctctctccctgcctcctgcctgtaggtcagatgtgagttcacagcttctgctcaagtgtcatgcctacctgctgccatgttccccaccatgatgctctgatcctctgaattcgtgagccctaaattaagtactttcttttatataagttaccttggtcgtggcattttgtcacagcaatagaacagtaaccagggcagtctccctctctagcatgtactggtcacagactaatgattctcttgccttaatatccaaagcactcgaatcataagtgttaccacctcctaaagctgtttctttcatttacaacacatgaatgggtcatgcacaatcttcatctaagatatattcataatagagctatttttctcccttcctacccacgtccgagacttagacaatgtcgatcacctaagctgtaattctgatttcctgtttgtctgctgttctctctgagtcccctcattaattcattttctatgctggtaagatctgctagatacttccccactgcccttgaaatccaaacaatgttcctcctcctgatatgtagatatctgatcagagaggatcttggtcgacctcttcatcttccttttgtatccttctcctgttcctatctctccttctacccctccttcccctgactttctctgctctgacagagtaccttgtttctttgccccactttctctatcaggggcactcccttgactctttagctggccagctcttcagagctgttccttatgacacctgaccccacctgactgaaatagatttctaggcccactgttacgtatctgaacatgctgggctacccctctgacatttcaacctggcatattgagtttgggggggttgtttgtttgtttgttttattcatttatttattttgtctgttacctgtctcactgtcgt

SEQ ID NO: 142 - DNA, 1200 bp, mus musculus
atctataataataacttcaggaaatagcaaaatcaagtaatgtacatttctacttaataaagtggaatgagtaatatcattatttaattatgtattccagaaaagtgctctgagctagaaaaagccaatgtgatttcttcaaagatggcactactggagaaatgcaatttttacttaattttcctaccaaagctctttgtgtattttttattgttttaatttcatttgcaaaaaaaaaaatccttgtgatgtctaaatccttgtgactctctgcctcctccctccctcccccctccatccctcctccccctctcctccccctctcctccccccttctgcaatatgtaacctacaaaaatgcatttcacctagcatctggatcctaaaggcagcttcctgtgtctgtccatgtacttctgtgttagagcagacagtgaaaaagacacaggaatcagcagacttattaccacactgctgctgtctcagacgcagaacggagtggccaggttgagagctgcttctatgatcccttcatctgatcaacttcagatctctcatgatcaatcaagtgttcccaaatctcaaatgagctgttaatctcacctctcaccaggactgcaaaactcgatgttgtagtgtttgtatgagagcccgctgacctctctgttcacaatggatgtcgattttcaattagaataagccttaaccatcttttccagccactgaaggcaggcctgtctgtcggtctgcagctttggtcaatcaacccctgggattccatggtattgtctttattctcctcaaaatgtgtttcacaggaataggttggcattcacggtggacgctgtggagagaaatcaaggggttgtgcatagcctggtactgtgatgctgttggtattgacactcgcttgtgccttgtgtctggctctctgggcagaagtggagtcacaggctgtctcctcactcctggtctgaagttctaagattattttttgttacgagtttatgatttttccaattctaaaaaagaaaggaaaaactttttaaattccagatatcttattaaacacctttatgattattcccacttaggagcacatttttatctgacctccgaccatcgttagcatacagtgggtccccatgaatggcaaaacatgtacagctagtaacacaattctgggatctaatctttaat

SEQ ID NO: 143 - DNA, 1000 bp, mus musculus
agcaatggggaagaaaggtgcatttctgtttatttttttagatttatttctgttggagaaccctgctagtatggtcacagtccaccatatctggatagctctccaagcctggagcaaactagactccttttgtcagccgggggcttccctttctctacctggccttggtgcagattgtctctgagcactgatgcctgaccttacttggaagatgactctgtgcagagctccctgcaagtgctgcatgagtcagcacacaaggcctgctttttccttctacccatatgataatcagatactgcattctgatcaatcagccctttccatgagtactcttaagagcccttgtacaccctacccctggaacaataaagcagagctgtttcactggagctgacttctggagtcagaacttctgtcatacttacacccaaggaaccctgctcaccgcttctgctccctccatcattggtggccattggtggccattggtggctattggtggccattggtggccattgatggccaatgacccccaaggaaagggagacccacagttttttttttattttatgtgcatgggagttttgcctgcccatatgtatgcttaccatgtgtgtgcctggtacctgtggaggtcaagagaggaggctggaccttagaactgcagttacagatggttgtgagacaccatgtgggtgctgggaaccaaacctaggtcctctgcaagaacaagtgctcttaaccacctagccttctaaccagccacacactttaatttttcataaagacagagtcctagtatataacatgtgttgcactgggtatctttttgcttcagcttatcaactttaggattaaaggcatgtaccactacaactaccttccttccttcctccctccctcctcctttcttatgtaatggtgttaaagattaaacccagggccacttatagctagacaagtattctatcactgagcaatttgtttgcctgacaaa

SEQ ID NO: 144 - DNA, 1200 bp, mus musculus
aaccacttgacaaaagccacatgacaagaggagagaactgacttctataagttgtcctctcactcagactgaaccttagtgttctgtcgtcagctgagcaacatggtttcacaaaaattacagacaaaaaaaaaatcttaagtttaaaatgaggggaaaaaatagtgtgaaatgggtcattcctctgcaaagtgatggagatagaaacatttttgtccaagagaggcatccccgtaacctggatggaggaggtactgagcttggcaacctcctttggctgagcaggatgtgctagacgagtcctcgaggactcctgaaacttggtgcttctgttggctgaaaaatgatgtaaagtcttgaattacatggtaagtattttcatgttggttgtgatttccacttgatgatagcagattgaagtgggtggggtggattgctgccagtccaagggagaaaagctagactgggcatagcattatgtaggattcaaaaatcgactgcaagccaactttttccagtctccattcttgtaagccagcacgcggtctctcctaaggtgagatttcagagatgcatataatgtttgccatctggagaggggtgtgcttgtcatctagaaactgtgtaagtgtgcacttgaagttctttcctgagatgaacacagagagcattctggggaacagaggtcagcttcactggacaagaatagaaggtcattccagctgggaatgtgctgacggccactctgcccaaagcctgtccccctcaagaggattccagggaaagaaagggttccctgtcagccggaacactgagaactccctcagagtcttttgctttgatggtgtctagaattccagccaccctaaagccacggatctgtcctttcttgctgcaggtcagcctttctccgtagcttgcatggctccagtgtcactagccacagaacttcggagtcaccagacattcttgaagccatttcctaccaaacctgtggctataatttcactgttttccacaccactttcttttacattgaaggtcttggaccagctcactgcttcccactctctggcaggaaaatgaagcacagatcttgttgacacttcaagcaggccagagccaacttttgattcttgtgctactactactttttttaaaaagtctctctctctctctctctctctctctctctctctc

SEQ ID NO: 145 - DNA, 1400 bp, mus musculus
tgggactctttggtcttcactgaaaccaaccagcttagttgctatgaattaatttaccattacttcattcccttggttccaaagtcacaacagatagtgtgctagatcaaaaagagtcccataaagagaaaaatgagaatagtcagaacaacttactctgttgctctaaaaaaggatcgtcagacatcaaataccgataataacatagtatcccacacgtttgtggtgatctcacaacacaagtacttgataagtggtggcattatcattactttaaaaagtgtgtgtgttggggggtgatccaagaaatgttttattctctgacaaaaactttattccaggattcccgagggaccctcttagatttgtgatttcaaatgtcccccacagtccacatgtggcagctctggtccccagatgggtgtgctattggaatgcagtggaaaaactggcaggcactgttctgggaggctgtgggcttggctggtggaggggagctactggtaggtctttgaaggttatagctggccctgtgtcagtcgcaccctctgattctcaagtcaccaagctgtaaatgaggagccacagcacaaagctcctgcctcactgacaagccaccgcccttccctttccccccacaacccccgccataacagagtgcactgcctaaaactgtgagaggaaaaatgaaccctcctccctttaagttgccatgtgaggtattttgtcagagcagtgaggaaaacaactaagacaggggtcatgtacttgacggggatattgggaccccacccctctccctgttctctgctttttggccaccacgaggtgagaggctttctttcaccacacattccatactacaatgtcctccccaacctcaagcccagagacacaaggccaagttaacctggaatgaagtcatagcccagacatttcttcctccttttaaatcttgtctctagtattttgttacagccatggtaagctagacacacttaatgactgaaaattatttcagcaaaacccaagaatcccttgagtgtttgaacaggatatttaaactataatatattcccctttataaaggctgaatgtgaatgtatttggtgacatcaaataaggtcacacaagtgggtcctaatccaatgtctggtatctttagaagaggggaagagagaatgaagggacagatagtggaagaaggcaagccaaagagtgaccctaagaaaagctaaccctggaagcacttttatgttagacttttagcttcaaaaactttgaagaaaaacaaatacccgaagctgtcctgtcgctagtattttgttagggtagctatgaagccagcgcatttactccaagtttgttaataaaaaggaagttattgtgtatttacgagg

SEQ ID NO: 146 - DNA, 1400 bp, mus musculus; identical to SEQ ID NO: 145

SEQ ID NO: 147 - DNA, 1400 bp, mus musculus
gaaatgataaggaaataccctacttgttctttgtataaccaaactccattacctgcaggaagtaaccctaaaggttctcagagaaatgaaatttggcaaatgaatatatttcattttatagattttggtaccggaaatatgtgcaccttatgatagacacatagtcaggatcccaatgggtaactggtttgagctctgaaagggctgattatgttattgtccatttattagaagttatagtaattaggggtatacctagacaaattcagactaacaatgctctggcatatgtctctaataaaataaaaaaatttgcattgtaatataaagcatattataggtatacaacacaatccatcaggacaagcagttactgaaagatccaattgtactttgaaagaaatgcttctgatcccttgaagacaccacaacctgaaggcatcccaggagttcctctgcatgcagggcaactgaccacacagtgtgaaagcctccctggcaacagcttgactgctcctctgaagccccaacaggctgaaggcctcccagaagatcttctgcagccagggcaacaaataagcagcttctttacccctctgaagacttcacagtttgaaggcctcccagaaggcctcccagaaaagccactgcagccagggcaacaggtcaccagtgtacataaccctctgaagaccccacagtctgaaggtcccacaggaggtaagctacagccagggccacaggcataccaggagacctgaaggaacccaggtacacaagaggcaggctccaggcagagacacccagactagtaaatgccagggataaacagatggtgagaggcaagcccaagatgataggcaattgaaaccaatatactttggcatcatcagaacccagttctctcaccacagcaagccttggatacaataacacatctgaaaatcaggaagctgatctaaaatcttatctcaagaggacaatagagtcctttaaggatgatataaataactcactgaaagaaatagaagaaaatgcaggtaaacaggtagaagctctttaagaagaaaaaaagaaatcccttaaagaaatacagaaaaacacaattaaacaggtgaaggaattgaacaaagtgttccaagacctcaaagtagaagtagagacaataaagaaaagacaaatggaggtaaaaattgaaatggaaaacctaggaaagagatcaggaatgacacatgtaagcatcacaaacaaattataagagacagaagaggaaatctcaggtgtataggataccttagaagatattaacacaactgtcaatgaaaattcaaaacataaaaatctcctgacccaaaatattcaagaaatgtaggaaacagtgaaaagaccaaatctaagaa

SEQ ID NO: 148 - DNA, 1000 bp, mus musculus
gaggaggaggaggaggaggagaagaagaagaagaagaagaagaagaggaagaagaagaagaagaagaagaagaagaagaagaagaacaacaacaacaacaacaacaacaagaacaagaaaaagaacaagaacaaggggctggtgagatggctcagtgggtaaaagcacccgactgctcttccgaaggtccgaagttcggatcccagcaaccacatggtggctcacaaccatccgtaatgagatctgatgccctcttctagtgtgtctgaagacagctacagtgtacttacatatgataaataaataaatctttaaaaaaaaaaaaaaaaaagaacaagaacaagaagaacaagaagaagtatttacaaacaagtgttttcgatccagggctagagaaactactcatgcagaggaacagagactagaacccagtatccattaaataaaaatcagaaagaacgcaaggaaaatggcttaaagatgcaactcagaaaatttggggaggggctggtgagatggctcagcggttaagagcaaaaatccctgatgaacataggctcttaagacatttgcaaacagaatagagacacacatcaaacataccatgactaagttggctttattcatgatagttccacaaatttaagtcaataaatataataagcctcataaatggactttaaggcaaaaatcacatgatcatctcaaaagatgcagaaaaagactttgacaaaatccaatgtactttcatgataaaagtcctaaaatggtctagagggagcatacttcaaaaataaaagaatctatatacacgaaaaccagccgggcggtggtggtgcacgcctttgatcccagcacttgggaggcagaggcaggtggatttctgagttcaaggccagcatggtctacagagtgagttccaggacagccagagctacacagagaaaccctgtctcgaaaaacaacaacaacaacaacaacaacaacaacaacaacaaca

SEQ ID NO: 149 - DNA, 1000 bp, mus musculus
caaagccactgaccccactcgatggcgggtggacaaggggcagcccccactaccaggggccctggggcgacacctttggccccagggttacaggagagagggcagaggaagagaggttcccacgcaggcaagagtccttagtccgttccatggctggagcacaggaaggccttccattgggagattacaaacggctcaataggagaaagcctatcccatcttctaagcacagtgggccttgatgaacagaaacaatctatggttttagagcttttttgtaggaaggcaggggggaagagagaaggtaagagagagagggagactggccatggccaagaggagagaagggggaaaaggagagagagagagagagagagagagagagagagagagaaggctagagtaagagggagagagtaagaggttaggttagagagagagagcacgaggagaggatgaggagagagagttaagagtgagagtaaggaaagtaaaagcttaagagagtgaggagagagaatgagagagtgaggtgggaccaagcaccccctcttatagtgggcttgtattatcttgctgttgctaggtaactgggagtagtctagcctgaaggtcagaagcttgggacattgtctacgtgactactagccacagcttttcctgtgggggttatgggggtggtaacttcgacaagagccaggagtccaggagacatgagggaacgcctactgtcccatataggtgggaattaccaccacctggtaccggggttccatacctcagcttgactagagaccagactccattgtcccacatccactatggacaccaacatggaggtttctcacaaaattgggaatcgatctacttcaagatccagctataccactcttgggcatatacccaaaagactctccatcctaccacaaggatatttgctcaactgtgttcaccttggctttattaataatagccagaaactggaaacaagttagatgtc

SEQ ID NO: 150 - DNA, 1400 bp, mus musculus
ttaaggacttttccctgtttagcagtgttctcctgtatttctttaagtgagttattaatgcccttcttaaaatcttttaccaccaccatgagatattattttaaatccgagtcttgcttttcgggtgtgttgtggtatccaggactcactgtggtgggcgtactgggttctgatgatgctcagtggtcttggtttctgttaataagattcttacatttgcctttcgccatctggtaatctctggtgttagatgatcgagctgtctctggctgtagcttgttcttcctgtgattctgttaacctttgtcagcactcctgggagtccaactctcacctgagtcccaatggtcagagcactctctgcaggcaagctctcctcttgcagggcaggtgtccagaagtctggagctctgatctacctcctgagtcctggggtcagagccatccctgtaggctgactttcctctggcaaggaaggtgcccaggggtttgggtctcagctctgcctcctggctgaggatgaaggcctgaggggaccctgtccaagaagctctgttgcttctgttgcccacgtgttctcccgtgttcaagaggtcctgggtgtgctaggagtcctgcgcagtggagagtcgtaaagagtcctctgaggcccttgactccctaggccaagttcatgccgaagatggcagggttggccccgactggaaagaatcccagcctctgattgggcatggttcctttgtccctgtttctgctggcacaggacccccctagattctttggagctgattttgcattccactcaccatgatcccaaggtccctgttgtgctaggggtcctgtggcatgtagagtcctttggggcccttggcaccctctactgggttcatgaggaagatggtggggctggccccaacccgaatggatcccagcctctggtagggcggggttcttttgtctctgttcctgctggcataagaccctcctcaattctttagagctaatgttgcattccactcacccttgctcctgaggtgatcccaaggtcttgcggtgtggagagtactctggagccctcagcggcctcctccaggttcaggcggaagatctatttgggttttagacttacagatcaagctgttttcccccgaagatagtattcgcaggaacagcttaaaaactttaaatgatttaaaaaaatttttaggtgatattaattggcttcacccctatttaaagcttactacaggggaattgaaacctttatttgatattctgaaagagagttctgatcctacctcccctagatctttaaccttagaagggtttctggccttacaagtagaaagagctattgaagaacaatttgttacttatatagattactctttgcctttaca

SEQ ID NO: 151 - DNA, 1000 bp, mus musculus
gaaatgactcaatacagctgcatcaacaacatcccctccgacttctcacacgggtaacaggtcacagaagctaggaatctggagcatcccgcacagccttcagtcagctctgctggtctctgcctctcctaagctgttgatctggtctcagagtcttctttgcatcttggctctattgtctctgagatggatgctcagttattttttattcactctggcagggatgagtctagtgaatctggtcagtttcagggatttcctgaagctgttttgtttaccttcctgctcaaggagcttctgtacaggatagaatgcttcaatctcagaggaaactgttacttaacaacatggaacaaggaaaacccatcccaactgatctgtagacattgtataagaataagtgctgtgtatgatactgttagagtaatttttgaagagactctgtccagcttgagctgtttgccaaacatggttttggaaggcctcacccttctcccccattaccttgccaaaacttaaattacattcctgaagctagccaccaagctctagtccattatttgatcacctcctcctcctgaggctgactactaatgttcagctatcaaagtactgcagtccagaaatcaatagccccttttggctcacctacttaacatccccaaataaaattaaattcctcatcctaacacagggtttacccttttctctttataaaccgccagtttcttttgtaccatgtctgcctcttttctatccagaagcagtcctttgtcccctctgtaacaaatatccctcctcttctctcccatattctcttccccttctctttcattctctatctcctgtctttgtctcttattccctgccttttgtccctctggggcaaataaacttcctttgtgctaagaatttgaatttgggggttctgagcctatattgatcttttataattttgccagtattattgtgaagattaatgccatagtcattaagattg

SEQ ID NO: 152 - DNA, 1000 bp, mus musculus
aacactttatgcttacctgggaccagcattatattgtggaaccagacccaaccttgtagtgggcattttttcctaagcctaagttatcttagaccaaagcaggtgaaaagcctgtgtggttaaggcccacacactctttagcctaagggctggtgatgagtgtgatattcaggtatacactgaggtcagaaggagccatggtttccagggcttagaactggctagggccaggcttcatccaagggcatttatataagaagaatgactcatccttcttccttccagtctatcttgagtgttgggttgatgcacatgtgcaccatgatgtctctctccctagggatgtacctcataaagtacagtccagtcagcatccctcaactaatagtttgctatttattgatcatgaataaatttgggaaaggggatagcgagtctgttgtaagggaatggaaccttttgctacccctagaggttttcatagaagatgcaaaatcattttagctttggcaaagcccagtgttaaggcattttggagttattgattctgtaccataattaaatagtatatatttaaaaattctattaataattaaatagtttcattttcttttttataaaattgacaaaatacagtaatatcttgaataagttatcctactgagaaattttctataataatagaaagtacttatatgatatttattctttatgatttttattctggcatcattttgagcacttaatgtgcattaagtaacttagatatcacagtaagcatatggaagtgttattattatcaagatcagtgtttatagatgagatgttaaatgacttttctgtggtctcacataactaacaaatgcagagccaggtaaagtttatacttttacagagactccccccgccccgccccccgccacctctgcttcctaagtgctggaactagtggtatgtgccattacctctgactgtttcaactctttatgctatatgctcc

SEQ ID NO: 153 - DNA, 1600 bp, mus musculus
tgtctgaaaattacctgttatcctgatttcataaaggatgacttgggtggacatagtggtatatgactacagtatcaacatttgggatgctgaagcaggaggattgagttgagagctcatggcctgcctgagagagagagagagagagagagagagagagagagagagagagagagaaagagagagagagagaaagagagagagagagcgctactataaagcattgttagtagtgagaactttggagccatcgaatttgagcaacacttacccattctgataaacaggcccaatctgataaacaggcccaaacttctccatgtatcctatggtaacaacaggtactgtctaccttgcagcactgctcagggatgctccaggtgcgtggtccccactctttcactgctcttctgaaggcagagcttacacacctccttagaggccttgttattgatcagctctgggacttccgtggctctttctgtctttattcagtacattaccttatggtgcagcagacacatgccagagtctgtcaagagagccagatggttaaagacgacaaagggcatctgtagttctgtggatcttctagaggggatgtagattagggtaaccgagaatacttatgatcaaggtaaaccacgaggaagttaaaacatagagccctgtggcagacggtcctgaggtggtcgacttctgggctgagatgatgaggaaaggggctgctttgctaccatcgaagacatagtttgatagaaggaactggaagtgtaatggcagaggtgggaatacacatgagcagggaatggagagacagagagtcaggggagggaggtgatagatcttttctcagtcctgttgctcttacggcctttcccatggctcgtgtgttctcctggaacatggcctgcatgggatcatgagttgagaagggaataagtctaaggcctctttcccaagcacttgaggtgtttgttggcatattacgttttattatggttggaagctcaggaccagggattttatgtcatgtctttagcctcttagaaatctctactaacagttttgactaaaacgaaagcccaaatacagattgaagcattaagcaaactaagtatcacacttcaaatgatgcatattaatgctttagctcctacagattaataaatgagcaaacatgaggagtgaggcaggaattttaagataaggttgctaaaaaacatcttgagcatttgtttttttttttttttttttttttttttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctataggattgaagttccctttagctccttgggtactttctctagctcctccattgggagccctgtgatccatccattagctgactg

SEQ ID NO: 154 - DNA, 1200 bp, mus musculus
accaaggtcagccagaattcctgtgtcctgctgtgtaggggtctcttggggaagggcataatcatatctcagtctccaagcccacttggttcttggcgtctcttatttggagtcatgcaggcctctgataaattttgaatgtagtgcatttgagaatgaggcagacgtctctccatcctggaagagcaggactgatagccacaatccattcctcagaggatgctgaataattttcagatgacctttcttggcatctccctgcttttggtgtatcagcagctggataactgaaaaggtcatgttgactgaatatggcatggacatgcccttgacagttatgtatactgtgagggttgagagaggaggggagcagtaagactgaagtaagaatcaagcccctggaaggcagttcgtaacaggagcatgcacgtgacaggaaattgaactgagactagaaagccagttggctaggaatgtttcaccataaactgtggggcaatgggctatgcaccgacagtctggtctccagtccagctgaggtcttgaaccctggtgggatccgatgggtggtaatttccacctacatgggacagaaggcgttctctcatgtctcctggaaacctggctcctgtcgaagttaccatccccacagccctcacaagagaggcatgtggttagcagtcacttaggcaatgtcccaagcttctagcattctggctagactcctccccacagttacctagcaacagcaagatagtagcccactataagaggggctgcttgtcccctcctcactctctttaagctttcttactctctaactctccccacccctctctctttaccttctcacccctctctctctaaacttttacctctcttactctctagcctttcttctctctctgtccccccttctctcctcatggccatggtcggcctctccctctctctttctaccttctatcctttctccctaactttctacaataaagctctaaaaccatagactgtctctgttcatcaaggtctgccgtgtttgaatgatggggtaggctttctcttaactagccaaggctaacctccagacaaaaggccttcctacactgcagcaacggaccagactaaggactctcacctgcgtgggaaccacccatcaccgtctcccattgccttctcttcccttatctccagggccta

SEQ ID NO: 155 - DNA, 1400 bp, mus musculus
gaggagaaaccttcagtggatttcattaaatggattttatttaatactgaaatgtggaattcaacacagccatacaacttaatttagaagggcacctagatgcgtaatcattgggcattgcctttgctcctgttgatttggaacgtagtacagaatgaatgtgttgtctagggacaatatagtgttcagctgcttagtaactccacttggagaaccacgagggaaaggttcatggaccctgagccaaactctagcttcttgacactggttgagtatataagacttagttccactacatgcaatgtgggctgcatgttttgaggagtgacccatgtgtgctagacatgtcctgcaacactgtagtaagtgattggagttttaatgggaaagtaattctggaagttttaatttggaatcagtgctctaatatagagttgtgacctcccttgacttgaaatgtgaaggctaccgggtggcagtgattcctcttccttcccttgcctttacagtgttgtgtgaagagttgggcctgtgtgggagaattaaggtttcctcttgatggtttgatcgccaaacattaatgtgtgctagtgtatgcataagaactgaattccaaaagtgatgtggagaaagccagcgttcttaccatgctgttgtggcctgttgctctagtcttgcttggccactctactcttccatgttgtactgtagcatcctggtctctgcccccagcacaggaccatggtgactgcttttctctcctcagttcttagttcttagcatttttcatggctccagtttggtctttgccatcctgaatggaatataaattcttttcttgttaacatcagcaacaacatagtaactgctgaatctagtgaactatatagatccattttaacagcactttcttcaggccatggcatttgtgagggctttaacatttttttttttattcttcttccccctctattcttcctcttcttctttttcctcttcctgaccattgttgtacatctctctttactcagcatctgaattgaatctgtgggcttagtccatatctcaatgttattagtttatgggagctcccagctccaaagcctatttgacagttactagcccttgaagataactttcctctgtagcttcatttagatcatccacagtcatctaaaaatccaagctagcccaaagtaaaaaccttctctttaatgttaatttcactgtattctataattcatgcagtgatgtttatatttacctctcattcaagcttgaaacccataacttgtcttacatcaagaaaatgactggttattttacctctgttttcttcaataaaagtcccatggcatttatctctgtgtatgggtgtgggtggaaagagaggtggaggc

SEQ ID NO: 156 - DNA, 1000 bp, mus musculus
ctaagttcatactctaaacattctagtcttggatgttcctggtgtttcaacagtgcctcatacccacctagatccataacttagaacacctccctccttcccatgctacagaaggcccagtattcagttcccatggatacagatactgctaggttaagtaccaattctaccctgcactggtgccgtgcatgtctactgtgtatcattcctgatctctcaaggttttcatctttcctggttcagtttcctgttgtgatagccactgctgtgtatttcagaattttagttgttatgtatatggtggaatttctctgagtattatgctcatgaagaatgtaacatgcaatggtgtattcttagtgtcacaaatgtccacggattcagtgacacttctaacctaagactctttacaagatcactgagttaaggttaagaatattagtttcctgagagaggtgttttctactagaaatccatttacccatccacatgtcctccagcccatgggtgaagccagtcatataaagtctttcaagtgttgcttttaacacgttctaataaacagcctgtgcttaaatgataaatcagaaaatattgcatatcatcacagtgaattattacctaacatgtcacagagacattattgagtgcacaaaacagcatccatgtagagtttgggcacttaggtgctccccaccatgggaactaattgtgtgtggctatttcaaactttgctcaaccacagtgaaaggagctggagaggctcggttgctagggcaggtgaagcagaatgacagaaggtaggcatcttgggggctattttgagaaggtgacactttctttcagtgacaccaagactgtggtggaatatacagcaactgcctccttggcacaaatatttgaaatgtttaatgcattctgatatttgctcaaagcatattaaggagctatgtgacaaatttccagttatacatgaacttttgtgatggctcggttcact

SEQ ID NO: 157 - DNA, 1800 bp, mus musculus
ttgcttctttatgtggatcatctatactatatacaacctgcatagttagatgagatggcccagatgtgaacctcagagagccctttgatatctccggaaagatagatctgtctatggggaaaacttactagacttaattttacaattgtacgctaataaaaatccgattttagctttctgggtaacttgattttgtcaccattttcctatttagaaatacagaattaactcagcaatagctgctaagcataaatcatgaacttcctaataacaaagtgtgccaactctagatgtagcatgtccattccaaggagaaacaatgacttttatttgcgttcaggccagggaaaataattcagtttaaagacctttgttcagaactcatctaagaagccagtaacatgtgtaatgctactgctaggggttagatattggaggatccttagagcttgctggcaccccggtcttgccatatcagtgagcttcaagttcagtgagagactctgtgtcaaaaaataaagtggaaagaaatagaaaaagatacccagtgtatactggctggttctgtgtttcaacttgacacaagctggagttatcacaaagaaaggagcctctcttgaggaaatgcctccatgagattcagctgtaaggcactttctccattagtgatcaggggtgagagggcccattgtggggttcaacgggttaccggcgcctgccggcgtagggtaggcacaagctgagccagtcagtgtagcgcgcgtgcagccccgggcatgtaagggcatcacagacctgttattgctcaatctcaggtggctgaacgccacttgtccctctaagaatttgagggacaccgaccgctcgggggtcgtgtaactagttagcatgccagagtctcattcgttatcggaattaaccagacaaatcgctccaccaactaagaatggccatgcaccaccacccacggaatcgagaaagagctatcaatctgtcaatcctgtccgtgtccgggccgggtgaggtttctagtcttgggttctataagaaagcaagctgaacaagccaggagaagcaggccagtaagtaacatccctccatggcctctgcatcagctcctgcttcctgacctgtttgagttccagtcctgacttcctttggtgttgaacagcaatgtggaagtgtaaactaaataaaccctttcctccccaagtgcttcttgatcatgatgtttgtgcaggaatagaaaccccgactaagacacccggcaatgacctctgccttccaccatttaagtgtgaatgtatgtgagtatgtgtatgtgcatgtatgtgtgtgtgtgtgtgagtgtgtgtatgtgtgtgagcatgtgtcagtgtgagtatttgtgtatgtatgaatgtgtgtgtgtatgtgtgaatgtgtgagtgtgtgttgtgtatgtgagtgtatgtgagtatatgtgggtgtggggggtgtgtgtagggtatatgtgtgagtgtatgaatgtcagtgtgagtgagtgtgtgtgtatgtgagtatgcatgagtgtgtgagtatgtaggatatgtgtgagtgtatgtgagtgtgtatagggtgtgaggtgtgtgtgagtgtttgagtgtgtgtatgtgagtgcatgtgtgtgtgtgtgaatgtgtgtaagcatgtgtatgtgagtatctgtgagtatgtatgatatttgtgtgtgagtgtatatgtgagtatgtgtgtgtgagtttgtgtgtgtgtctgtgagtgcatgtgtgactatgggtgtgtgtctgtgaatgtgtgtag

SEQ ID NO: 158 - DNA, 1200 bp, mus musculus
attattccataaccgactgcattatacccacttcttctgttgggttcctagaggaaatccttaaaaagttctcccttttgttgatcatcttagctgtctatacgcctttatgtccataaaagacctttggaatatagtgtgatactctcatttcatttatacagtgtccaagcacctataagtataaggtgaatttaagccacaaggatttaacatcaagtcccagcattttagtggggaaatacagcagcctagagcttaagaaggaatgtctgaaacgatcttgtagctcattcagaggccttcggagaaacacaaattaaggagtaaggagtccgtgctctcatctgtgattcccatgctaactgtgtgggcctaaccattctgagccatcacctggtactcagaagtcattttagtggctcctgctaggtttaagacacccactgatttgtacctttcaagcaaggttaacaccaaagtgccagcctgtgagttcctcctgacccatctgtttcccagcactggaggaaggagtcacattgacagtcccaaattctgtcataacctgcctttcacctacctgaactgcctctcctaccccataactccacagatttaactttttataggcatgagatatgccttgttattagattttttgcaaatgttcatatagctgctacaaaagaatgaaaaattagctttgttgactgtctcttggtatttcataattctgaaattatgagtaaataatgtattcatatgctgaggcaaatagggtcgtgggaagctaatgttttgaacacaatgtacaaagctacagatctgtctcccctctgactactcagcctcctctcgggcagttgctgtcactgggctatgtacctagcagagctcattctatgtaagcatagagtatacagtgtataaatggcagcatagtttttatgttattggataaattctatgctgtcataactgcctgactccttagcttcatatttttatcatattttgccatcttcccattgactattactttgatttgcatccatgtctgtatatagtaaatggcacattgttttgctgggagaaaactgttaagccctgaatcagctggaagaatgggctataatgactaatatggtcactaccactgtaatctccatttctgtagcagagcctaattatgtcctt

SEQ ID NO: 159 - DNA, 1000 bp, mus musculus
aacagcacaggtgagccatgtggcttcacatagcacgtaggcagcatctaagaacttgagtgtgcaactgcctctccaaccatcttgtggcggtttcaggtggccttttaggtctttcaaccttgagagttcatgatacagaacaccccctacccctaaccctactcctacccttcctcttccctcttccatctttatcatttgttatgaactgatcaacattcacatcccttaccagtctggaaagcttacttgactttctgtcaatatcattcccttgccatctgtgtattaataaatacattgtagtattgagtcttaacggccttaaatcatatagcccatggagataaatctacctaacctactccatggcaacagagactaagggattcatacatgatcatgagagcctggccaggaacctctgtcagccctgactccttctctagaggtatcccagactcactgcctgccatgtacttgaatgtgggtattttctcctcattgctttctttgtatccctaccttactaaaaacatagaatgaatgctgagaggagtgatatttgtgaagtccttgcagttttcttcctaactggatgccagtactaatgacattaagcacccagatgaaacacccgttcatttagggtggagaagccaacataaatacagtaacatataaatgagcacagccatttcagaccacgacagcagctttgacaacgacacatcaggtgtgttttggtgggacggaggtagagaggtgactattttacatgaggatgtcccaagagctctttgagaggtcatgtgagaactgaaagaaagttgatgggatagaaacaaccaggtaaagatccgagaatcctgcatttaaaaaaggcaaaagtatgtgcttcaaatgcacagagggaatgagtttggaaaaccggtagccatcgtgggcctgagggtgatgggcagagggaatggaaacaaaggccagagggtgcccc

SEQ ID NO: 160 - DNA, 1000 bp, mus musculus; identical to SEQ ID NO: 159

SEQ ID NO: 161 - DNA, 1200 bp, mus musculus
gagccttcactagtgttgggggtcagtctttagtaggcagagactaagcatcacattgatgatgtccatactttatgccagctgccatgaaatgccttggaggaaaccctagaaggggtttcctcccagaaggggaaggaagtaatatcaggaagtagagggagacagggatctgggagggagagaggagggggagaggaaaagggggtccggttcagatatgggagtagatgggggagattttcaaaggaagtgtgtagcggtgggtgagggggaactgggcatagccactagaaagttccagatgccagggacccaagaggttcccaggacccagcagcgaggacattagacaaaatactcaacaaagggaagatagaacctgtagagatcctatccagtggatagacacagcccctggttgatggatgagccaccctcctacctcaaaaatattaattcagaattcctcttatcaaaaggaaatgcagggacaaagaggagcagagactgaggaaaggccatccagagactgccctacctagggatccatcccatctgcatacaccaaacccagacactattgctgattccaagaagagcttgctgacaggagcctggtatagctgtcccttgataggctctgccagagccttaccaatacagatgctgatgctcacaaccaaacattggactgagcatagggatcccaatgggggaggtagggcaaggactgaaggagctgaaggggtttgcaaccccacaggaagaacaacaatatcaaccaaccagacacctcaaagtgcccagggactaaaccaccaaccaaaaagtacacatggagggacccatggctccagctgcatatgtagcaaaggatggccttgttgggcatcgggcatcactaggaggagaaccccttgttcctgtggaggctcgatgacccagggtaggggaaaactagggcgctgaggcaggagtgggtgggcaggtgggggagcaccctcatagaggcaggggaggggatagggggtttgtagaagggaaactggggagggtgataatatttgaaacgtaaataattaaaataaccaataaaaaatgaaaaaaaagagtatgtaacatttctgagatgagctggaaatttttaaaaaattatgaaaaggattttcaatatcttaaaaaatataagactgggga

SEQ ID NO: 162 - DNA, 1000 bp, mus musculus
tcctctcctctccctcccctttttccttttctccttttcttttctttttcttctcttttctttcttttctttctcgtcgtactgagtcctgcctctctggggtacccaggaacctgggaggggtcagggcaaagtccgaatcagggagtccacaatgattcctggtcttctctctggcgtaccatcccagggagtcaggaactggtctgcggtctttgcttctcctcagggcatctttgtgacaagcaggagaggggagatggagccccacatgagcagaattcagtctgattaggagtgaggggctggagaggaggcagccttcttctggagtcttaggcatggctccttagtcaaaggccttcttcttgggtgatccttaatggagcagctttctgagacaatccttgcttgttttttattgctttatttgatggtggatgtaaatgcgtacactttattcgggatgaccaaggggttatataccttttgggggcaggatatccaggaagggaagctcattggctgaaggctcaaggctatctagacacctcattaacatgaagaagaattccaagtgttatgctatgtgactgactgtctggtcttctcagtggggtgtagtggttacatgttgtagagcaggtacagagacaggtagggaatggctccattcctgccaccaaatctctgagattcctggtttgagctcattcagccttaaattcttatgcctgtctggtagtgcattcccacatgtcctacattctaacgtttttcctcctttcttgtggttcttctatttctctccctacctgggacccctggctgggatcagaagtccagccttcctgtctcccctgcccagtcataggctgatcatcattttattaacctatcagagataattggaggatattctttacataacattgacacaggagatagttcaacaatcaatacaaagctagtgttcatactgtaaccagatctctgggca

SEQ ID NO: 163 - DNA, 1000 bp, mus musculus; identical to SEQ ID NO: 162

SEQ ID NO: 164 - DNA, 1000 bp, mus musculus
tcagcaccaggagcagtttgttacctacaatgtttgctttttgttgctgttgtgttcaggaacgtcagactcatacatgttggaattggcagatgaaatttctgaagtttcctcatttgtggttgtggttaacatcttctgcctgtaaaaggaatgatggtcactatatcacgaaacctcgacaggtagaggcgatgggggtatttgctggcaggtaggtaggagaattcggctttcttcctgcttgaggaagcatcctctctcatcactgtaattggcttacatttggtgaaatgtggtgtttgggatatcacatttccaatggaaattgatgcaatgggtaacttatcttctaggttagtggtttgggaaggcccttcagggaatggtgatggtgactggcaactagtctcaacagaagccagaatcagagtgctaaaacccactgaactctgaaaaacaatcctcagtcgtgggacaaagcagctcagaacccactaacaatttacctgtgttttacacaaaacagacacacaggagaaaaggctagatatgaaaagtctacctccacaatgtgtgtccaggtccagaagtttacctcctcccagagatcaggacggtgacctgacctatcagtcacttgaacaaccttctgctctcaaaagcaacccagccaaggacccctgagggaagatcccatacctgaggcagttattttcttctgtcggggtctttatgttgtacttatgcttttcttcagcttcagcaagctttgtctggagcaatttctctagatttgccacaatagttttctagaagataaatttgaatagctgacttccccagagcccctgggacatagctcctgggcagaacagcagttctccaggttcctctccagcccggctctcagtctaaccaggacttgcctgtctctcgagttctttctggcatttgtaaaggtttgtgttcagggtctccagaacagtagcttgtgccc

SEQ ID NO: 165 - DNA, 1400 bp, mus musculus
aggctttcccatatagccgaggtgtgtgctgagccagactatctaggcttctaagtacactgtgatattcccacaatgacaaaatcaaacagaggctcttttctcagaaaatcaactcatgggttcatttctagcgttgcttcctcggttagcccttccgaccaccttcctttctttcttttttctttttttggtttttcgagacagggtttctctgtacagccctggctgtcctggaactcactctgtagaccaggctggcctcgaactcagaaatccgcccgcctctgccttccaagtgctgggattaaaggcgtgtgccaccactgcccggcttcgaccacctttctaacatcacctgcattcctctacctaaagcttttcagcatgtagttatttatttacccagctatgtccacctcttcctgtagattgtgaagttccagaaggctttccgggatttaattcagtatgagaggtgctggagaggtagcccagttggcaaagtgcctgctcagcagaggcggccagcatcgtgacctgaggaactacgtaccgggctctcagcttttccattgtgaagacagtctttgttggactacccagaccatatcgggtaaagcagcctaacaaatcctgttttggcatatggtcattctatggggtctactagagagccctagctgccgtcataggtaccagggaagtacatggcagtaatgttgcacaggagagaaagacggtttctattgcttctggcccctcccttcctgggaaactggaaagaagctgccagacttgaaggcacttgcttctactcatcttggaaacacttaaaactatgtctaatgctgcactcctagaatataaattcaggcaaatagcctaggagagtcaaaatcacgactttaagctcatttgaagaaggtgagggggaaggaataaaagaaaagggaggaaggaagaaagaaagaagaaattgtagttatgacctaaccacagtcaaaaatctctttggcttccattggtctggtatgaatgggaggctttaatcttcagaactttgtgcgtgtgcggccaagcagaggaagggaaaatcaggcacgaagccattgaacacaatcacatacttgctagccttcctcaagttcagacctctgcttgaaggttcaccccactggttctaggaggcccaggctagcatgagaaatcagtgggaaaatgttctttcagatgtcaagtcccagcttctatcagacagatgaatagagccacaggcatggacaggcaggcaggcccttttgttggctatgtgagcggttccaagttttcttcttcaatgttccttagaccaaatgctaatatattctgtcctaaaacatggtgcatagaattaaggg

SEQ ID NO: 166 - DNA, 1200 bp, mus musculus
agacaactcttataaaggaaaacatttaactggggctggcttacagcttcagaggttagtcttactctcttcatggtgggaagcatgacagtatccagacagacagggtgctggagaaggagccaagagttctacatcttgatccacaggcagcaaggaggagattggatatatttcatactgggtgtagcttgagcatttaagacctcaaggccctgccttcccagtgacacacttcctctaataaggccagacctttaataaggccacaacccccaatagtgccactccctatggtcaagcattcaaatacatgaatctgtgggggccaaacctatccaaaccaccacagggtggtagctgtactggtcagcatgccagttctcccttatccataccaccagggtgagctcttcagcactgctctggctctgccacccaatgctgccattgcaggaggcagggtcagctctcctgttcttatacccctggggctggctcacccccacccatgccttcagagccagctccactctgttgccaagtcaaaattcagggctcacttttcccaagtgctgcagctggtgaggggcaggaccagctcaccctctctcctgaccttggagtcacctctcctcttgtcctgggaggttgagggcggagggcatatccctcaaccccaggccatctcatagcgtaggagtggcagggttgggtctccctcgctcttaccctcaggctgactcacctgtgttctctccacacatgaggagcagggagggcatcacccaagtcacctcaaggcagagagtggtggggcagctctcttgccctcagggacagtacacttgcacccccaccatgagggtcagctctgttgtgctgtccaggcccagatgcagggcctgctttcccaagtgctgttgatggtgaggggcagggctaattctaccacgcttattatgctgtggacagctttcccaactgctggattcagctctcctacactcttgccctagggctggcctactcacatctttgccaccagggccagctccactttactgcctggggaaggctcaggacttgctttccctagtgctctataggtgagaggtgttgccagctctccagagccctgcagtcagtgaaggacagctccaattctgcacgggcgtgtctgtcccatccaagaacatc

SEQ ID NO: 167 - DNA, 1000 bp, mus musculus
attagaacttggaacatcgaggcagagttctctctgtgctgacagccatgctctgagagtaagaggagggctaggtggctgctgagtgattggagtcctagctgcttgggagaatggggaggctgctgatgcgggcagttaaaataattgtccactgacgcaaacacaacttaagtctgcgcacgaacaccgagtgtcaaaaatctgccgagctggcatatggctcagtggtaaaagcatttgctgtcaagcttgacaactgagttcaagtcctgggacccacattctggaagaaaccagaatataactacaaaaaaagtaaaactgtctatatagttaagtcttcttccttcctggagaaggtagctgcccacatggaaggctgaggacacaaggttgtggggatggtccagggcagaagtgtttgtatctcatgtaaggcagttagaagaacaaatatgcaaaggagcgaggtgttcaggtaacacaaaagaaaaagtgagtcgccatggtctgtaggcttgggtagaagagaggccagtcagggattggagttatcacaaatggagaagtcaaggaaacacagatctaagtagaccccagctgtaagggaagttctggagaggggtgctcaagatctcagagtgggacagtcgcagctactatggagggattggggtagaaagtccttgctgaggcagctggagtgagtgaggtggaactgagaatattatggaggtctgatgctgagactagtcgaactttatatgcagtggctacatttcttccacttaattagttcctggttattacctcagatagattgcaattaacgatggtgagctctaggagtgtgggtcttctttcaaagataggcatgggacagcctcccttgatagcgcagaggggaaccagggcttcaggagaactagctcacagaggaggctgaagagaggctgccatgtgggaggatctgggacgaagtcaatgcctttgaaga

SEQ ID NO: 168 - DNA, 1200 bp, mus musculus
gttgtgggatgtgggaatgaggggcagggaagactgaataggtaaaacacagcgaacatttaggatagtgaacctatttgacatggcacttttatcatacacattaagatgcatgtgttcggtttatagaccttcctaagagaaacacagagcctcaacgtcttagttagggttttactgctatgaacagacaccatgaccaaggcaacttttataaggacagcatttaattggggcttgttcacaggttcagaggttcagtccgttatcatcaagctaggggtacggcagcatccaggcagacatggtgtaggaagagatgagagtactacatcttgttccagctctggaggcaaacaagacaggcttccagggagctagggtgaggtcttaaagcccaagcccatgatgacacacttcctccaacaaggccacacctcctgatagtgccactccctgggtcaaacctattcaaaccatcacactcagtaaatttaaaagtcactgtttagtcactggggtacccaggaaggaaaaccagaaggggattcgaaccactgcactgaaaacctccggattccatgttgccagcatcgccttgccagcgtctggcttctatagtgccacttagcttccggccagaacgaaccagtgcagaacctggccggatgcaccaggtcctgtctctgaaaccctcactctacacctggtcactgttgccaaaatccggttcctcccagctgcttcttcataaactcaacctaaagccaagagcagctgctgccccagggctcccccaactgctccttgtggtcccctctccaatcagggcctcagccatggacagccgctcagatcaaactcaatgagacgtgagactcagttaattacccccatgctagctccctccttcttccctgctgggagcttgcagagggctgtgttgccagggccatactactcaggatagagttgattaaccaaattagccatgcactttgcctgtgcacatttacttcccactgtttgctctctcgtcgttttagggcttgtaaacatataccaaagacagccgcctttgacatggttctacacctcaaggacacaagtacatcatgtgtttatatatcaggaaaggtctgcaagatatcacattaacccatggatacagctacctccaggagaaaaataaaaaagggg

SEQ ID NO: 169 - DNA, 1200 bp, mus musculus
tcactggtctggactcaggcttctgctacactatcagtactggatcctcactgggacccttctcaggtattccgttgttgccctgtgtcatgatggagatcctgcagctttggttctggaggaccaggtcctttacatgctccagcagttcatagatagggtggatgtcgggatgggccaactcaaagccctggatctaggcctgagtggtaggtgaactggtgtgcccaacacttaggttcatgccattggagccagctctccagcacccacatcacctgggccagctatccagcactgcctaggcaagggatggaaccaactcactcattcttatgccctcagggctagcttttcaactctgcccaggtgagcaggcagagacagctctccctagatctagtatgctactagggcaaggtggaggctgctctccagagtgctatatcagatgagggtggggccagctcttcatagccctcagatattaacatggccccaagcagaagcccagactggggatatctacataccctttggcagtaaaagatatcttactccctcactaccgtagggtcactgacccagatatggcactcaggcgcagcatgggccagggcctcatcatggcctcagatggtgtcacaagctactcacatcaggctgttcctcactaccttcaactctccagttctatctttcttcagtgtccacacaccattctgcctctctttctcttccatctctctaacacttacgtgctcatcttagtggtgccagaagcctatgggtttctggggtcatctcaggagtgccatgtcctgtctgagccacttggcactgagctgaggttccctcccttcttagtattctaataacattgttattttgctcttgactacttcctacggatcccaactttcaccatttgatgttgtctttaatcctgtgtttttcaattaacatactgttcaagacagacatcagtaactaaatttgctgtttttactcaagtgagaacactggatgataatagtaagctgagaagtgcctacctcttaaagcaatgacttggacagttttggggattaacgccaagtttggatgctataatagtaagaatttcaaatttgcaagtcataagataaaaggcttacttctcattttgcattttattaatgcgtaggctacttaatagga

SEQ ID NO: 170 - DNA, 1000 bp, mus musculus
ctcaaacagtcccctctcattaagctcattaacagatatggcatatcaagtagcagatttgcaaagcatgtaagggagagatttgtgcaggaattccaagtctgactacttgaagaaagtgctccgctcagatgtacgtctagcttctggatcttggcagacagaaccagctagcacctctgctccttccaccatccctcccacacgcgtctgccctgatgggtacttagttccctgttaaaggtctcgggacttgttttgccattgaccaagatgtgttttaaaaaaattaatcgcttatggagttttggcaaacagcagcctgagctgtgctttttctaacaaataacttgcagattgtcatgtttctcttgggaaagggaaaaaacatccaatcagaacagaattgaaatgatataaattaggctcattgtttagcaaatcgctggctttaggtaagaattgtggataagaatagcctgggccctctcaaggatcagagcaggcatgtgtgcctgcatgaagaaaccaggcctttctttgttaggatcctttctgcaatggctattaaagtaattacagtaatttatagatttttttccccttccatttcaaaacgggttccatttttcctcttttgtcttgagatcctcagttggaaaaacgtctgtgtgtgagcatgtgctgtagcactgtatcgcctgtggatcatctgcctccacgctgatgaggtgtgatgctcacagaagtctagagatggtttggcagctctgcagacaggaaacactggtccttggaagtgctaagtatactgtataatcatataccataatggttaattatgattttccgtgaaggcattaaaattttctgtgttcaatttaaagatacactatttctgatgtcttaaaacttaccccttcaaaacaatggattttatggttatactttgttgtagttttatgtcagggatgcctgggtataagaactataatacttt

SEQ ID NO: 171 - DNA, 1000 bp, mus musculus
acagaaaaatctatctagtaaatatctcaaggaccacataatagataaaacaattacatgtatttctacaatattttaagtttttgcagaaggcaacaggattatatatgacattgaaagtattagcttgttcccatatttgtgcttgtataatgaagacatgtaaagaaaatacattttgaaattatttcagagaaattgaattataagtaactttttgttaataaaaattttcaaaagtatcatatatgtatgtagtacatcccggttacaaccctacactctttcccccttgatcccttgctattctgccccctcccttcctttaaaagtatcattcccagattcaatttgtgactttttgtttgattatatgttccacataagtgtaaccagagcagacattgggaccatggatttggaaccattcatgagagcctgacacgttcaccagcagatacacaactaggaacaatgactccctctcccgaaaatggccagttgccagtagttcagctgtagatagcacttatgaacctcttcctcatcttcagccattgctcaaatgttgtgtgggcctgtcttgctgatgcctatatgttgaagtgaaacatacttcctatttttcctctagcagttttaagaacattttggcatatttattactttatatgctttagaaaatcttaaaactacaaccagttctgtgccctttgaaattcaagacctctacaacctccttcctctgattttctattaggcatttgatacccagtgagatgtttcaccttcaataacaagaggtatttaattagcatccagtagtgtatgattggactccccgatgtgacatagtttcatatgaattattataatgcagtatacatactggtgatgatgaagttattcagtaaagttctataattattagaactgtatcagaatcttcactttcctctctaattttagatggtagattgtttaagttttacttttacaa

SEQ ID NO: 172 - DNA, 1400 bp, mus musculus
taatgtcttctccatgctatggggtccccacatatgtgtggtgtgtgtgtgtgtgtggtgtggtatgtatgtggtatgtgtatgtgtgtggtcatcacaatatggtgaccagccagccagctgatccatacacaccacaagtgacctgcttacggcttccagagaaataagtcctttaagtacggttcaacccagactgtttccggctaccttggagacttcctgcaacctgcctctcttcttatagaagcgtgtgcactttctagacatattccctcatggtccactaagactcagcctaacagcaccctatattcctgggtgctacttccgtgcccagcaaacggggtattttaacacatgcatttccactgtgcagcgaggccagggctgtgacttgcattcctgaccgggtctggctttgctctgagagccaccacagtgtttcaggatgtatatcgggacacagcatccaagtggcactttgagaggaggaaacagttccagctgactggccaccaagggccacattcagaatctccaccctggcgtggctacagccccttcctgcttggaccttagtgtggaactgttatttccacagcccggtgcttaccagacagtagtgacagtttgcccctggagctctctgtaacttaaaacgccaagagaacaggatccaaactctgactgccacatctgccacctgctcccaaagtgcctctgtcctggaattcctcgtagcacatttttcagacaggtcctgtgtcttccaggccttgtgacagaggctaggggaatagtaaaatgatggggatcctatccccagaaactcagatgaactttgacctgatgactgactccctggcgcctggcaagcttctcccagcaggcttccatttttcggacagatggggaggcttttatttctctcttacaattggctccttcgggaggcagaggtagtgagctccttcccagagggagctgtcatctcagccaagtggagggatgctggcagcacaccaggggcttaggatggctatcagttaccttatgcccctagttggtcccaagaggtgaagagatgagctccgtgcccatttagaaggtgaggcaaaccaaggcaggacagcatgatagaccccggccagcatgagacaacttagcaagtcttagctctatcaggtttcactttcaccatcagagtttgagttgctgttactgctgccagtgaggagagagtggtctatgggcccttgttaccgacttagtactccggcgtcattacggaacgcttgcaaggggctcttgaagttgaagctaaagaatgaggattctatagtcataaaaagaagctgacggtcatgctgaaaagagccagtcccaagccttcaact

SEQ ID NO: 173 - DNA, 1400 bp, mus musculus; identical to SEQ ID NO: 172

SEQ ID NO: 174 - DNA, 1000 bp, mus musculus
agggccctgacccaccaccccagacagcagagagggctgcaggttgctctttaataatcacgtacactggggagagggagaggaagcgagttatacgagctgccgctgctgctgcttggtggcggccttgttggccaggtccttggccttctctgtagctgccagtgcggtctcctttgctttctctttggcctctttggctgtctcaacaagggttttggaaggggcctcaccttgtagcttggccaggatgtattcaaagcccttcattgtcttggtcacattgcttttgaaccgagcaagaccaaattcctggctggacagctctggagacgccaaataagctagaggcttcccgacggatttcggtccagccgctattgtcagagttcacacagtaaatgcatcgttcctccaccaccatcagctgggcatggttgatgttccaggtgaaggtggtcatggtctgattctgggggtccacaatagagtcctccaggatgtacacagagtgagcaacattggcaggaaacagtcactctgcccaacgtggcatcctgttggtcttggtcaggagtctccgggacagtagcttctggtcaggggtcacctcccggtgcactatgtcttctgttaagacatgtttgctatagggattcgggtaccgttgccagaaggcagcgaacaattggtcccaggaacttcggagcacgctctggcccaggaaatactttaccatcgtcccaacccgggcgggctcagcacccgtgcagcatccgagggtggggggaacatggctaggcggacgccagccaggctcgcagctcaatcaccgaggcgctgcacccagatccctaccgccgccatcaggggttataagaggtcctgattctctgccattcggtattcctcaggtgagaattctttgttcagttctgagtcccgttttttaatggggttatttgattttctgaagtccaccttcttgagttctttatat

SEQ ID NO: 175 - DNA, 1400 bp, mus musculus
attaaactgtgtatagtggagtatcagcaacaaaccctgaactgttactgaccttgcagcacagatgaacatcacagccacaatactgaacaaaagaagcttctgtgtggttataaagaagacaaactatgtttatgatgtcagaagttaggataggagcaaagggaaacctagagactataatatcttccatttcttcatatagataaaataagactactgtctggtttcactctctaaaagttgctctagctatacactatgttatatgcactttttctataagagttacacttccttaaaacacagttaaaagtaggtaaaaatatcctcggtattgcacatagttcaaggtgtctctcacactctctacaggggagcaggggcctccatgtcctttggagactagcattaataagccttacctttctaggaagaatcctcattgtctcagacagttgtggtgaaagaacagataaaagaacagatgccttctgcgatctacctgtgagcatcctcagagtaaagtgggtactacaaaagtgatttcacagagttaagaaggctgggatccattcaggttagagccagccctgccatcttctgcatgaacccggccgagggcatctagggcaccagaggactttccacgccgcaggacccctagcacacccaggacctcctgatcacctgagagcatgtggatgatagaagcaacagagcttcttggtcagtgtcctatcgggccttcatcctcagccaggaggcagagctgagacccagacccctgggcacattccttgccagagaagagttggcctacaaggagatttctgaccccagaactcaggaggtggatcagagctccagactgctggacacctgccctgaaagaggagagcttgcctgcagagtgttatgaccagtggaacacaggagagagatggactcccaggagtgctgacagaggctaaaagaatcacaggaggatcaagctccaaccagagacagcttgaacattgacatcagagatttccagatggcgaaaggcaaacataagaatcttactaatagaaaccaagaacactaggcatcatcagaacccagtacgcccaccacaacgagtcctggatatcccaagacacccaaaaagcaagacgcggatttacaatcatatctcatgatggtggtagaagattttaagaagggcattaataactcacttaaagaaataccggaaaacactgctaaacaggtagaagcgcttaaagaggaagcacaaaaattcctcaaggaactacaggagaatactgctaaacaagtagaagcccttaaagaggaaaaacaaaaatccctcaaggaattacaggagaacactgctaaacaggtagaagtcctta

SEQ ID NO: 176 - DNA, 1000 bp, mus musculus
taggctctttgtcaaaattggactccaatcacttcctagattagaagacaactttgccatattatttttcaaggttgtcagctaactgcttcctctccaatagccttcttattgaagtgtctttagcttgacctgacctttcattgtgaaataagcttacccccccacccccatggtatactctccctccatcaggtataccctccccaccaagtataccctccccaccacaccaggtataccctccctccacctgaacctttttctttttttttttttttctggtaatgctagggaccgagcccaggaccttgtgcacactgaataaaagctctatcactgaggtacatacatatatctccagccacctaagacttattcaaaattaacacaattgaaaagttcatgaacaccctaacttctccattctcaactcaaccttttatagggagagtttacaggtgggtggatttgcacacaatgaaagaataacagaagtcagggtttgccaacaatacagactaaatactttattaggttccaaaatgagaaaatggtagcgttaacctattttagtataaatctaccaccctccgcaaagagcccgccttagcatctacagagccccagtcctggaagcgccggtactcttgaggcctcagcagatactggcggcctcggtagttaggcatctcatagagaacccagcagccttccagcacttgcagcgagcgcacctcactgaggtggaagcgatcctggatgcaggagcaatcctcgctcagctccatcatgacacctttgtgatcttctttctcatacagccgcattctgtgggaacctgcctgcttgggtcacacagagaaagataggaaaaagcaattgagtctcttccagaactcacccaagcaaaacaatgggtgagtgtggtcgactgaggtaggaggctgttggtgtaagatctgagcctgtgatattttggagagctatgcatcagtgg

SEQ ID NO: 177 - DNA, 1000 bp, mus musculus; identical to SEQ ID NO: 176

SEQ ID NO: 178 - DNA, 1600 bp, mus musculus
tgtgcagaagacaactttgggtatagatatttgcctttcccattgcttgaagagtctcttgtttattgcagctcacaaaaggctatttggcttatgaacttctttggattctgcttctgtgtcccatctgactgtgggcacaccggtggtacaaatgtgtgctgctgcttctggctttatgcttgttctgggaatcaaagctctgctcctcaggtttgtgcagcaagtgctttattcagtgaacgtctttccagcccctatggcatcttttctagactactgtcttgtgaaatagcagctaccccctctagcagccctttgtctttagtggtgtagccataggcaggcgttacattttctaccttctctgggttctaaatggctgtttatgtttgtctttcctcccgtctgcagacccagaggtcaccaaggtatgcaccgtcccataagtactgcttcctgactggaaggaagtgagtcaatatttgaaacctctttcagggttaagttccccaggataccacttaatagggtttagatattgaagataagcaagagccacttagtgccaggaacacaggttgattatttattgcatatatgggctgtaacaagcaaaaggaggcttagtacaaatccatgacccgtctcagagagccgaccttggcatccatggcgccccagtcgtggtagcgcctgtagtctccaggcctgagcaggtattggcggcctcggtagttgggcatctcatagaggacccagcagccctccagcacgtgcatggagtagatctcatggaggcggaagcgatcgtggatgcaggaacagtcgtccatgagctcagacacaaggccccggtagtcatctctctcataaagccttatcctgtgagagctggtctgttgttaggaagacagaagaggaaaaacaatgatttacacacggtgtcgcagcctgcttgccccgtcccaaaacacagctttcgggcgaatctgtcaagtgttcgtcttccctaagcctactccgtgtgctgttgttgtaacaaattaggagatgcactaacataaagttgacctgaccagtgaactcttgtgaaggaaacgaacacggaaaggcagggagtgaaagcacttactgcccgtgtaaccaaatcctaccaagcttattttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttg

SEQ ID NO: 179 - DNA, 1000 bp, mus musculus
ggccaccagtacacacgcagagccaacgctgagccctgcggtcactctatccaccatgattatcaccagtatttctcttataaccagatggtggcatctttcaggtaagaaggcaaaaggatcgtgtgtattatcacattccttatagatagaacacttccactcttgggttgaatttgggcatatatgtcctcccctatctctaaacctacaaatgcagagggctatactttaagagcttttagtgttagttaccctttatgccaagaactaggtagtattattgttctgttataagcaaggataataatcttgtatatttcatccatggagcagtcaagtgattgatttttctgcttcctgactcactcttgaccattgttttggcatctgcaagtctgagatttttgttgagaaattaccatgaagatcctaagatacttctaacaaagctaaaattccaagttcaaggaataaatactcactgttgcagtatcaaatgtgagaacgccttaagtgctgtcctcagaaactactaatactactacttcattgctctaggcatgccattcttttgttttagcaggatgttaccacagtaactctggacagacccccttagccttattcctgtagccagctcttagctctgttcagcagtcaaaaatgtgagcctgttccaggaaaatcagctgttccttatgctgctgtagaaattccaaaggtatctggtttgcaagtagaggccagaatccagtttctggcttacaaacccttacatactcttacatactctggttgctcagggcctgtgttctcacctcctactgctcacagtcactctgctgaggtctctctggctctggcctgccttctgctgtgccaggtaggtgcctacctgggagccttgtacttatccttccttctctcagctgcttgtccctcagatacctacctgtttccttacttaccagcactctctctttagatcttcatgctt

SEQ ID NO: 180 - DNA, 1000 bp, mus musculus
agtttcttttttttttccatcttaggtgttgggaacttagtgctggagacaggtggatttaccaggctccgatcttagctgctattggggtaagttgtaaagtttgtgtagcttcaatgaatagtaaatgaacaaatgaagttgctactaaaacttgggcaagtttgcttgttgctttactgtacagtaggttgaggatgttttacatgtgctgcgatagctaggagaagcagggctggggttcagacccttatttgtggctgacactgagactggtgcagaaagtgcttgctgttctatgaatcggggtaaccgggtaaccccaggagacagttctgaggctcaattatggatgttatgactttaaaaaaattatttaaacttttttttttcttacagtccagactttatccccctcctggtctaccctctgactgttccacattccatacctcctcaactcccccatctatatgaggatgttcccacccccaaccccaccccagtaaacctccccactttctggggcctccagtcttttgagggttagtggcatcttctctgactgagtccagaccctctgctgtatttgtgttgggggcctcatatcagctactgtatgtggcctggttggtggctcagtgtctgagagatctcaggggccaggttagttgagactgctggtcttataggtttgccctcctcctcagcttcttccagctcttccctaatgcaaccataggggtcagcagcttctgtccattggtttggtgtaaatatctgcatctgactcttttcaggtgcttgttgggtctttaggagggcagtcatgataggcccccttttgtgtgcaagccatgacattagtaatagtgtcagaccttgggaccttcccttgagctggatcccaatttgggcctgccgctggacccccttttcctcaggctcatctccattgttatccctgcagttctttcagacaggaacaattcagagagtt

SEQ ID NO: 181 - DNA, 1600 bp, mus musculus
ccatgcctgacctaaagctttactacagagcaattgttataaaaactgcatggtactggtatagtgacagacaagtagaccaatggaatagaattgaagacccagaaatgaacccacacacctatggtcacttgatcttcgacaagggagctaaagccatccaatggaagaaagacagcattttcaacaaatggtgctggcacaactggttgttatcatgtagaagaatgcgaatcaacccattcctctcaccttgtactaaggtcaaatctaagtggatcaaggaacttcacataaaaccagagacactgaaacttatagaggagaaagtcggaaaagtctcgaagatatgggcacagggaaaaaattcctgaacagaacagcaatggcttgtgctgtaagatcgaggattgacaaatgggacctcatgaaactacaaagcttctgcaaggcaaaagacactgtcaataagacaaagagaccaccaacagattgggaaaggatctttacctatcttaaatcagataggggactaatatccaatatatataaagaactcaagagggtggactccagaaaatcaaataacccccttaaaagatggggctcagagctgaacaaagaattctcacctgaggaatacagaaaggctgagaaacacctgaaaaaatgttcaacatccttaatcatcagagaaatgcaaatcaaaacaaccctgagattccatctcacaccagtcagaatggctaagataaaaaattcatttgacaggagatgctcgcgtggatgtggagaaagaggaacactcctccactgttggtgggattgcaagcttgtacaaccactctggaaatcagtctggcggttcctcagaaaattggacatcactagaaagagaggcccattggtcaggcaaactttatatgctccagtacaggggaatgccagggccaaaaaatgggaatgggtgggtaggggagtgggggggggggagggggtgggggacttttgggatagcattggaaatgtaattgaagaaaatacgtaataaaaaaaagtctacttctttgggagttagatttattatttatactgtacaactttttcaatttcatttagtttagttaacttctcatcttaaaatttgctcatagcattacttatttaaattataaacaagtgaaggatctgtaatgatttctgaaataagtaaaaaaaaatgcatttatttacattgtgaagaaagccagaatgattttcaaaatattgacacatcatggatctttggggaaaaataactttagtcaggaatgtcaaagagtgtcaaatgtttgaatataaacccacttaaaagtcaaacatgatatttttagacatacttttagacatatttttagacagttttagataaaaatctcatgctgggattatgcttatatcttgtttgtgcatgctagccaacatctattactgagttacatctttgtcccaacatgtgctttttttttgacaaaaatttaaattatgtaataggactgtttgatttgtcgtaattcgaaagtttaaaatactgcatatagtaattttcactggctctgaa

SEQ ID NO: 182 - DNA, 1000 bp, mus musculus
catgaaacttgagtctgtcttttggtcttcacacttcctttgttctccttgataatatgcatcaaggactccagatcagaaggtctcaaatctcagcttaaggccagctgtcatcactggacacttgataaaaacaagattcaaggcctcatcccatctcctgagtccagatctctggggataaggcctgggaactgatgttttatccaggcactgaagaaggcattctgatattaaactgaaatatgaaagtcactgccttggacattattttagaacagtagttaagaatcaatgcaacaagtgaatacctgggctagctaaatgtttaagagcacacgctgctcttgcagaagatctgggttcaattcccaggactcacaactgtcagctcacacccatctgctactttatttccagaatgctttcttctggactctgcaggctctgctttgtatacttaggcatgcacatatacacagaaaatatatttttaaaatatatgtattttataaagaagtggacatcttttacattgatcacacagagacaaatagcttcttttgtattacagaaattctcttttttattaacctttcaaagcaatattgaaagattatttctaagtgtttccattttactaggtcaaccttgttaatttcacaactagcacaaaatttatgacatattggctcattaagtcccccttactcatccatagtcaaactgtgcaatgctaatgactacatttgttttcctgtccctctaacatgttaattcttctacctctcctaatttatgtaggaaggtttgctattgtttgcttgcttcttttaatgttagccaattatgcccaattgcaacatggaagagaaatctctttctgtgtttaaaaggaagacgttcctctaggtctctttagagattcagcctctgtagtgtggctttacctgcagaaatagtctctcaagttcacttcttttttcatttctgacttatc

SEQ ID NO: 183 - DNA, 1000 bp, mus musculus
tcttatctcagtttaaaagtatctttggacacctacttccctggtttgctcatgtcacatgttgctgcccttagggaagatggtggtgaagccatggctttacatatggctgctagggtatgtggtataactgtccagcagtcatgaatgaactgggttacctgaaagggaggctggaaatgaaaaaggacgggggagtgggggggggcaatacaaagtttctgatcaaggctcaaagtttaatattcagtactgtatttatttatagagatcccacagaccctatcctttgtttcagctggattatgttgcaaagcaagctcaggggggcagtctactgtaggagattgcaggtgcagcaaggcagaagactccatctaggtcattaaggtccaactgtggcaaacatttaaggtctatttagcctactcaaggctgagggaagggcacaatgaggctgccctgaaccaaaatcgtggtgaagctacgactccaccttcctcagcccatagtaactagtcatgtgtttatatcccagtatgaaatcatgtcacatgatttaagattatctatgactttgaactagatccaataatctataaactgataatcctgttttagatcctggactttaaaaacatgcctgggtcagagaagagtgagcaatagctcatttttattgctagcgatagactaaaacagtataaaaatagcagtagaacagtatgcaacaacttcaaaattatccatacttaaataacatttgaactccaattatattagatccaatgggcagaaaaccaattagtgaattgaagttaggtggctgattacaagagaaaagaacaacatttgttcacacattcaagacaagtcagaaaggagcatacaatgactatgtactagcagagacatagggagttagacagacattttaaattgtcatttgtaaatttgaatagactttataacattgaaattttgtcatcatataaagaat

SEQ ID NO: 184 - DNA, 1600 bp, mus musculus
aatctggtattaccaggagcacagggaatcaagagagaaaggaaatgctaatttccatttctttattgacctctagcctataagaccttaaagtatcatttaataactcggatttctgcctgtagcttggtacagctttcttcacatctctggtaaaaggtcatccaaaggcctaaaaaaataaagcctgaatggatgtgtacaaagagttttcagaactggaaaagcttttaaagagtgtatgataattttaaaacatgtataaatcagccttccaaagaaccctcaccagagtgacctttcccagggtgctactgcatcgagctgcagtgctcctgaggtacccagaggcagtcaacaaaggagactggtgaggacagaatctaacctgtctaactaagtcaccactcaagatcctaatcggcaaaaagtggctctgagggacagcagtgacatctgcataaagattagactttggttttctcttacggtggacatgatatgttgtgaactacctcacacaatatctctattagaaaagcattgttatgattctgtttctaaagaggagagagttttaaatattaacagtttccccaagattacatagctattaattattgaagctgcaatttggatccaaactaaaaatcatttttttcccttagcaaatacataattatagaatgttctttgaattcaggatgactcttcaaagatgtcaccaggggatgcaaagtgactttcaagccccttacttctttgggctctgactagccactggagaaagaatgccttcaggcaaacagtatggagttggatggttaatagagacagctttacccccaggagtggcattccgttgaggcaggttagcaaccaccattgctatcagctcatcgaagaaatgtttcactcctgaaatgtggctctctgagccccaagtgcatctgctaccagaacttgcagatgagaaaagcttgaccagttggacaatggaaagaaggagaaactccagcataccatgttaaggtgcatggtaatgtccttagaagccactagccttttcataccttacccgcattacagtattctttctacatttgtcaacctgacagtgtgactagtgggaaatcatccctcatgattgcagagtaatttctttccactatttcatgtagtctgtatgcaaaacgtatgcgataggaaaaaaaaaaaagacaaccacaaagagactaatttgtgcaactgtcttgtatcacccaaagcaactagaattctggctctgtgatgcacatgctggctgaatgcagccagaaggagcatggaaactccagctatgcaaagacaacaaccctcccactgtgggctcagcatcattcctcagtaacgcttgttcatctatggaaagaattcaagttccttttgggggacccctgttttccactcacaaaacacaaaaggaacaaaagatagccaagttcataattcacctcaggagggcttcctagtgaacctcaagaggagagccaagctgaatgtgaagttctatacattctactttgcttgtgcttattacatatactacgatatgatggaa

SEQ ID NO: 185 - DNA, 1200 bp, mus musculus
tgacaagctaaacaggaaaagtgggctgataatccaaagcagttcataactgacacttcattctgcactttgcctgaggtgacctcaactgtcagggcttagtcatcctccagtccccccctgagactccaatgctgtctcttctcctcttttatgagacaagatctcactaagcagacagcctgaacctgttctgtagcccaggctggcctagagtttaaaatccctctgcttcagcctccagagtacaggggtgtgcctccatgcccagatcacccacattgcctgatacaatctggacctactggattccacaaagtgactcactcgcagaacatgtccgtcccaccccatactcctgcccaacaatgaatgtcaacatatcccctacttcaacaaatgctttaataaactatgctgccatccgcttcccagtcaacgtggtgctgttctttctggcccacgtttactgttccagtctgcttccttccttttctactattgccactaactcccctcccggctctcctcagggcttgtacaaggatctaagacagctctcacaacaactgcatccataatccatcagctgcccagaggggctgctctatacggcagtgtgatccttccaaggtcacaccccaacatctttcaacagctagcttcaagatacactctgaaccctttgagcaggcataaaaactcctcacaaacagatggcagctcacccctcctgcctcttctctcatcctattttgcctctgtttcctgcccttgggtcagctctactgaagccctcgtctcacacatcccagtgccttccagacccatgtgtatttgaaaatcacgtttccgcccctatggaggccccttctaactctaacaatgcaaatcctacgcaccttggactaagctcaggtatcacatcatctagaattcttgccagtcttccacactgagctaagcactcctaatgtaccgtcaattccaggctcagacaagctgctttgtttattcaacatcgaaaccagggcctgcacagaccaggtacagatggtaccactgagtctgcgtatcacagcacttaggtagctgcttcctaaagttgatttgaatgatatcagtgattcaagacaatctataaaaggaaattttctaggatacaagatatactatctctaattcttaagagattcataa

SEQ ID NO: 186 - DNA, 1200 bp, mus musculus
tttctgtacaatacttaggggtaaggattggggtaggggtaagcttattgtacatagtcaaggtttgctgttttattagacttttactacatacatgttggggatggatttcatccatggtagtacaaatatttcaatgaaaaattaagttcaagtcccaagtagttattgtctaattggctcagagaagaggtcactttgtgtgcttttgatgcacagttttcctgtggtcaggaggtggcttctcttttctattcccatgtatgttatccatactttgtttattttcttgaagcacagattctttagcttactactgacggtgctttgaccatttgcgcatctttgcatacctaacttttggaaaagctaggagagagagtagtgagtgagactccaggaggcagaatttctggaagcaggggctcttagttcggatcatggtttgcttcccctaaggctgagccctatggacctccttgccttatcactgttctgctgtgggtcagaagctatggattctggttaagacaagttctgagggtcaaacctggtcttgactcatgtttccttggcttcttctcgaggcttcctttgcccatcattgagcatggtttttagtggttaagaggcgaaatgaggttcagctgctgaggaaatggggctcattcctctgcctgtatgtctctattagagcatcctggcatttctgacttgttaggattgagagctgcagtatggctgtcagtactccttttggaatgagatgaagacggagctctctgtcaatgttcagatggaggacagacagaccttgatgtcactagtatttcccagcatctttacaatgactgggctacttgccagccaaacaaacaggctcaaacttgctgtgacattgcattcatgagtaaagacaaagttaaaacctgaatgtgcttttgaggtcatttcctttcgttattcttttctaaacaccatttgagaagctttcaaatttctcaaggaagttggtgggtggtgaaattgtcattagttaatcaataggtttagtggcaaatttgaccatttcacctatgtcagaccatactaatttataaatataagtaaaagttagctaatactctcaaattcagaaccatttgtcctataccatatgcatagtcagagcttgttaaaaaatacacttatgaagatctg

SEQ ID NO: 187 - DNA, 1400 bp, mus musculus
tgtgaggactgccattcacctcccagagcagggaagacaaagcttactttgaataatgaaatggaagcagaagccatacgtaagaggatgagaactgaacattccagcctcctcttgtcatactgccagtaggaacactacatgtagaagtgaggatgctgtaaattcagagcttatggtcataacaaggggtgactccttttgaatagttttaagactttcagagtatggtccataaaaaataaatatatatttttctgagagaaaatactaggataagattattatacaatcacaacttcgatgaactataacagctgctttacattttgtaaagatgtttaaaagctcttatactttggttatgagcttagcctttaatggctgagccatctctccagcctaaccctaaccctgaaaacgggacggggtgggggtggggggataggatcaggtatgggaggggatggggaagatgtacgaaaggtttcagaaaattgaacagagttgtatagcactgggggatggggaactaaaggtagccaccagaaagtcccagaagacaagaaagcaagaggctcccagaactcaacagggatgacattaactgaaatgctcaacaaagaggagcgagaacctctatagaccatatacagaggttaggcacagcccccggttaagggatggggccacccacccatctcaaatatattaacccagaattgctcccgtctaaaggaaatacaaggacaaagagtggagcagagactgaaggaaaggccatccagagactaccccacctggggaaccatcccatatgtatccaccaaacccagacactattgctgatgccacgaagtgcttgctgacaggagcctgatatagctgtctcctgagaggctctgccagatcctgacaaatacagaggcagatgcacacagccaaccatgggactgagcatacggaacccagtggaggagttaagggaaggactgaaggagctgaagggttttgtaaccccataggaagaacaacaatagcaaccaaccagactccccagagccccttaggactacaagaccaactatagagtacacatgactccagctgcatatatagcagaggatgcccttatctggcaacaatgggaggggaggcccttagttctgtgaatgcttgatgccccagtgtaggggaatgccagcgtggtgaagtaggagtgggagggtgggtgggggaacaccgtcatagaagcaggggaaaaggggacaggatagggggtttgcagagaacaaaccaggaaaggggataacatttgaaatgtaaataaataaaataaccaataaaaattaaaaaaaaatgtttaaaagctcagtccacccatttagctccttttcttc

SEQ ID NO: 188 - DNA, 1600 bp, mus musculus
agataatataagtgcagtagtgatttatggagtcctgaaaccagaacaaaacaatacactcaaacccctaaatccaagaagctgtagattctttaaaaaagaaattcatgtattagaaagtgataaattcataaaattaatagagaatcagaatatgaaggacttaacatattattcattttttagatgatgtacctttgaataaatgtatagatcaaacagatgttataagtgaaaaataaagttaaatgtatactatagtttgtattgaatatgttctaaaacttatgatattaatgacatggtccctaactcacggtatcatttgaaaacagtagacactaaaaaagtgagggctgcggggacagtttctagtactaggagggtactcctcttgaggatgatttgatcctgacctcttttttttattagatattttcttcatttacatttcaaatgctatcccaaaagtcccctataccctccctctgccctgctcccctacccacatactaccacttcttggccctggcattcccctgtactggggcatataacatttgctagaccacagggcctctcttcccaatgatggccatctaggccatcttctgctacatatgcagctagagacacaagctctgggggtactgattagttcatatttttgttccacctatagggttgcagacccctccagctccttgggtacttgctctagctcctccattgggggccttgtgttccatccaatagctgactgtgagcatccacttctgtgtttgccaggcactggcatagtctcacatgagacaactatatcagggtcctttcagcaaaatcttgctggcatatggaatcgtgtatgcatttggtggctgatcatgggatggacccccgcatggggaagtctctgtatggtccatccttttgtcttagctccaaactttgcatctgcaactccttccatggatattttattccctattctagggaggaatgaaagatccacaaattggtctttcttcttgatttttttgtgtttttggaaattgtatcttgggtattctaggtttctgggctaatacccacttatgacctctttctgtatttaacttctcttcaatgtctcatcagattttctcacccatattctccatgctgtggatgctagctggcaacatgcccatggttaacagaaccaatcactccatggccaaaacgttcaaagctgcatgccagaatcaacttttaaccttacatatttatcattttacagatatgttttacggtaacagaaagctaatgaacacatagataacataataagcggttgtgagtaaaaatgggaaaggcatttagtcatgcattttttatctatagaaattattttctgaattttatgatgaataccaatggatggctgacaattttatgtgattctgtttatatttcttcaatttgaatactaaaatatacataatttaataaatttaagaatattttacctttgagggttattctttctgtatacccaccattgctggcttatgctatcaaaattggcttatgctataataatttattttattatttcttt

SEQ ID NO: 189 - DNA, 1200 bp, mus musculus
cttcctaatttggtgaaaaataggatgaaatattgaaaaatgcatattgtatgggggtactcttattacagaagatgataaattaaatgtttagttctctttaataaagctggatagagtagtgtaaatataaataatgttttaacttctgtagtggtatttatttgtgatttcaataggctcctatacaaccttttgctttgtgttttttttttttaagcacatatatttaatacaggggacatataaatttagcttacctggaatactatatttttatactcatgttataacctttaaacttaaagtgtaaagttttcgtttattaagtaacctcagacatgaacagcatactaagacaatggctcagacacacaggacgagtactggcatttggatccccagatcctgggtccgttcaggatgaatgtaatggctagcctgttattttatcctcgtgtgaatgtggaggatccctgggacaaacaggatgggagcaagctttgactgagactttagcttagagctggtgagaagaatctgctgttatatattaaggtacacactccacaggaaaagaatttggtttgctactatcttaaataaagtaaggtagaggaacaatggggaacaactctatactttgttcatcaacctcaggccacgggcctctgacaccacagacacaggcactgatcccacatacacctgcccacacatgtgtatgcacatacatgccacatacatattgcaacatacatatgcaggaatggaaaacaccctgaacaattataaaacaaaaaagccagtatggtaagttttatggaaaaataaaagatgaatttattctggttaagttgtctgaaaacagtaaaactgaaggctcagaagaatatctatggctatatatatgtgtgtatgtatatatgtgtgtgtgtgtgtgtgtgtgtgtatgtgtgtatgtgtgtgtgtgtgtgtatatatatatatatttacatacaatataatcctcagtcttatagaacactgttattgatggaatttggataaggatttcttttaagaattaataatttcatttattcattaaaatatgaacataagactatctttgctaatggatacttttttttcaaatttttacatgtactcgctaactttcttttattagaagacatacataagttcatattatatgaa

SEQ ID NO: 190 - DNA, 1000 bp, mus musculus
acatcgcttgtctaatgaaatattctatttcttcgtttggtcatagacattttttattttaattctaattttttcattgtatttttatatgtgtggtgttttgccttcacaaagtctatggatttatggactttaagtaggtgttgggaattgaaccttggatctctggaatagcaaccaaagctcttaagcacggagccttctctccagctctaattttgctttgtaatcatccatcataaacctaaacaacttttcattacttccattcacttatctttaatatcttcaatcaggtgtctctgttaagaataaattttttcagctgtggtgttttgaatagctttggcccccatagattcatgtgttgaagagttggccatagggagtggaattattaagttgtgtggccttattggagtaggtgtggcctttttggaggaaatgtgtcactgtgtaggtgggctttgagggcttttgtggtcaagctctgcccactgtggaattagcatcatcgggtatccttggatcaaggtgtagaattcttggatactctaatgccatgtctgcatgcttcttgccaggatgataatggatttaacctctcatacaataatccagcccagatgaaatgatttagtttatgagttgcctttgtcatgatgtatcttcacaacaatgaaagccctaagacactaaccatgaagtgttctttaagaggtagctcctcggttagtatgtttatcttgccagcacacacggtaatgcccagggtagcattaaagcctcactgtcttctcctaggtcatcatgagacttcagtgttaaggtgcttatttgtcatattactaattactcaaagataatgaaaagtatcctttcccctccctaaccgattgttcttccactgaagacagaggttgagtatcatgcaccttttaatcctcataaaccatagccagagctgaaatcttcactctaacttggactctagtggttt

SEQ ID NO: 191 - DNA, 1000 bp, mus musculus
aatgtattgataccaacacataaatgaactttttaattaataattttattcctttacatttcaaatgatatcccccttcctggttactcctccacaatcctccccctccaagttattccctctttcctctcccctttgcctctatgtgggtgctcctccacccactctcccactcctgcctcacttctagcatccccctatgctggggcattaagcctccacaggaccaagagcatcccctcccattgatgtcagataaggccatcctctgctacatgtgtctggagccttagatccctccatgtagattctttagttggtggtttagtctctggaagctctaggtggtttggctagttgatatcgttcttcttgtggggttgtaatcccctctagctccttcagttctctccctagttcttccattggtgtccctggactcagtctaatagttggctgtaactgcatctgtatcggtaaggctctggtataaccttttagggaacagccatgtcaggttcctgtcagctagcaagtcttggcatcagcaatagtgtctgggcttggtgtctgcagatgggacagacccctaggtgggccagtctctaatggcctttccttcagcatctgttccatttttttaaatgcctctctcctctttctcatgccagaaatcagatcactgagaccctccaatgtgggacagtgaaaggcagcctggtgacccagcagattaattcgcaagagatagaaggcctgtttgccatgctcccagacaccagcttcctgacacagggccccagctccataattctgtgcccatcagtcacacaggccaacacctcaagcttctggtattttgtctggactccacccccacaggtacctggcaacagccaggtatgctcctccccacaattacctggtaacagccaagtaggctggcccactctaaaaggtgctgtttaccccctccccacctctcttactctcctgctcc

SEQ ID NO: 192 - DNA, 1000 bp, mus musculus
tggctgcaagttcaaggttcaaccagtgtgagggtggggcttagaactgcagtagacttagtgggagacactactagagtcattgaaggccactgaaagggttgcaggtttcaacttgtagctacggagtgacccctaaaaagcatggacgaggaagtgaaatgccaggtttacctttgctgaagttctctccttgtgctgtagaggagagcgtggcccaggagtgaagaggcaaagcagaagtacagaaaacaaccgccagggtcctactggttgatgctgaaagggcctgcacctggctcaccggaacaaggcacccagagcggatctcgcttatttgtaaggaggaatcaacagctctggtgggatggaaagggaaaagggtaggaggaaataggaagggggaaagctaagcttccttagatgccaatagagcatcagtcaggactattggaaaatgattcttaaacagatgactacaaccacaggaccaccaatggtttggaattgggacaaaggagcctgggaggaaatgaggctgctgatgctaagtgggtgttttccataatcgcagatgtttctctagtactccactgcagctttgtaaagtgttcaagcaccacaggggttggcaggctaacttctggcatctgatggggatctgggcagagctgagatactgtagcatcacagtgactggagcctacacaccccctctccttgctcctcccatctcccaggattctatggttcacaaagggaaactttacagttcccccacagacatagaatgccctggctattctgtccacattagcctcccctacctgatttgtgaagcatttgtactggcaagtgtgtggttgagctgcaagaccttcagggaaaattaaagtttaaacgacaaggtcctcggaaaggccctgagaatttttctcattttcatttatttttacataaataaatcagcagaagtggacatctgaatgcaatacattaa

SEQ ID NO: 193 - DNA, 1200 bp, mus musculus
atgggaaggaaggggtccaagctgacataacaaatgcgtttacactaaagtgaaacaaaattagctccatgagatgaaaatgtaccactaaagaaacttctcatgaatattgtttttctagaaatgtacaggaaggttcaaagtagcacaaccacttctacctgtaagacagggttgcatgtgctgataaagttaggatttgttgtataaagaagtaggaggtgaagtagatagtagtggttattaccataggtgggaaaagaggagtttgttttggtcaactttgacagattgtcatagtagctggggcgagccaaagtcgcttttatctggtggtcacaaccttctgtcagggaaaagcaacagaatagtatcccctctcctctgtgcagagggcagagacactggggtgtcattatcagggctggatgggtggactcaggaactccacggttatgcaaagtatgtgtgcaactgatactgttggtgtgattatcagtgtgatccagttctatcaaccacccccagaaaggaaaggagggggcgagggtggggaaagttcacacttgggagatgacctagaaaataggccaggtgctggcctaagatcagtttcaaacagtgctgttcataggaaacctgcaggacaattaatactacctttaaaacacactgtcaccataaatacgagttgtactagttggcatcctataatctagtgtgattatcttattgaccactggatctgagctttaaagaatgaagtcttttgggctgaaaccggctccgttggcaaagtactcagaagcaataggatctgagctcagatccctggtatccctgtaataagccaggaatggcagtgcatgtctgtaagcacaatgctgcggactggtgtgatggaagaaacaagtgaatgccctggacacgctgcctagccagttgatcctaagcagtgacctcaggtcccagtgcatacgtatatttacacacacacacacacacacacacacacacacacacacactcacacacacacacctacagaagagagaaaaacagaatgagttgtatttgacatagtcaatacactgtttcatatgagggttataattagagcaattgacattatatctttagcaatatagacaaaggttgacctttccatgcaagccagattaatacgtcagaaattttgag

SEQ ID NO: 194 - DNA, 1000 bp, mus musculus
gggagcaagagggctagagagaaagcaagacaagcaagagagagaggattggccaagcagcctcttttatagtgggctgggctaccttgctgttgcagggtaactgtggggaggagcatacctggctatgggcaggtaactgtgggggtggagtctggacagactacatgactgatggccacagaatggagctgggtccttgtgtcatatgtttgggagcatggcagatgggctttccatctcttgcagattaatctgatgggtctccagggtttgaacctagctcaaccagaaaacaggctacctttcatggtcccacgcctgttagccattattattaattttttttttgagcaattgtcaacattttttttaatttaaaattttacttcaccttgccacttcttttagtgtcagagcaactactggcaatgagaatctgtcttcaattttgcacaaggattgtgaaagggactattcagaagtatggggatccttcttcctcaatgcatttctatattaatatcctttacattctatgtaacatttctagctaagaaagagaaataggaaataagtatactactgagtttttgtaggcctcctttcccaacaatcagtaaatgaactagtgatttctgaataatgacttgaagacagtggtgggtttatagttgtagctttcttgtcactgtgacagaatgcttgctgcaaataacctaggtgggaactgtcaaatatggaagggaaggcatggtggaacagctcacataatggtgggaaagaagcagagtttatccctactttcaaggggccaggccagataaagccctctaggacatgcttctggtgacctctggctttaattcaggtccctacttccaaagtaccatcccctcttgacaatctactcatccatcttgtatagttttattctgttagtgaatagactatttattaggacagaggccttatcattttgctgtccctggaaacaccc

SEQ ID NO: 195 - DNA, 1200 bp, mus musculus
gaatgaaagaatatgaatcagaaaggtaactaatctcctctatattctaaagccattttcttagctctctcctcttaaattaacatttaaaatactctccattaattagatgaattcataatgcaacgatagaaaataatattatcttcacttcctgaggctgaaaatattgactcagtctcagtcttctttgtctacatggcagacttggcagtggcattagtaggaccctattttcatagtcactagcattttttaattagaaagaataaaatataaagtaatatcatatgaaaagcaataatatcgacccaaccatgtaggtttaaaatataaaatgataagtttacaagcataatcatatttccatactcattcaatgaattattcaaagaaaaagaaaatatgttttgcctagattttagaatgtgaatcattttttcataaaaatgatcatgtttaatgacgtgagtcacatcttttaagagctgtgataaatatcctacatggaaactgacaataacaagtcagaatctcctaaattaaaaacaaaagaaaacccctccctgggagcattagtaatctttagagatgcattacctcttggtttatgacctaaagaatgctgttcaaagcttaccttgtgtgctaaggtgtcctttggcttcatgtagagatatggatagctcattataaccttttaataacttgaacacaaatggcattggagtgaataattttcatcctgagtcattttggccctactagttcaacgccaagcaaattaatcacccgagtgctcatgttgcacacagagatacttatacactgactcataagctccccagcctgctgggttgcactgattttatcaccacatgaatctggtaccaaggcactgggtgatcacccgcctgtctttatactatgatattgatttgtacttattttttccaagtatcatttagctgctctgagacatgaagtcttgtagcgtaattagcactccacttctctatcattgcatttcttgtcttcttggagacagatgctctaggtcatgtctattgagcagaatctgctgacaaagggtttacattagggttattgctatgaaagcaaagtagaaaatggaaactactcgatttctctcccaagccaaaacaaacaaacaaaaatcacttggaatgaaacagtagt

SEQ ID NO: 196 - DNA, 1200 bp, mus musculus; identical to SEQ ID NO: 195

SEQ ID NO: 197 - DNA, 1000 bp, mus musculus
aaagttcctttgcttttagaatttaatgcttgaccctaatttcttgttttttatgcaagttactataacatctacattctattactgactcatctagttcaaagaaaactagggatgtaatttcaaatatccatgagctatataccagtaactacttgcaatcaccctttaaggctcaataaaactacttcttacaatgtacaaagagccagaccattgaaactcaaaggcaaattacaacctgaaggccccaaaataaaataactccataaattaactttattgaaacatatattgccaaagtccactattcaaactttacaataaagtataggcagttggatgaacttagttgatttgaagtctcagtgtcttccaaattgaatccatacaaatgatttaaaagcatgggcttaactgcatctttattatcttttatatgtcaaattatcttttaaatatttattttcagcccacccctcttgcattcccatggaaggagctgagtgtgtttaatattaggagaacatccagaagtctgtgaggagggggatggctcttcatattcatgaagcttgcatacttctattggtcatccctggattggtcacctctgctgccatcagtcacgaagactatcctgctgatgaaggtgaccaggcttccagtaatgacaatctgatctttgatgactatcgagggaaagggtgtgtggatgacagcggctttgtatacaagttgggagaacggtttttcccggggcattccaactgtccgtgtgtctgtgccctagatggacctgtctgtgaccagccagaatgccctaaaattcatccgaaatgtacaaaggtggaacacaatggatgctgtcccgaatgtaaagaagtgaaaaacttttgtgaatatcatgggaaaaattacaaaatcttggaggaatttaaggtatgagttaccctccatatttattgaattctaattttcactataacatgcttagcaa

SEQ ID NO: 198 - DNA, 1000 bp, mus musculus
ttactctttcctcctaccctctctcatctccttcttgcccctccacccctcctccccaacttgtccctctcccagatgctcaagttttggtttagtttaatcagaggtgtccctgtgaccacaggattggcacttgctgttgttatcaaaagggacacaacagaaggtaatgactccctcattttctttgtctgttcaaaggaaataattgaacagtaagggctcctcctgaatctgtgcccagctatggatggctccattcttgtgcagatccagtacagccagccagagctgttgagagttcatgtttacatgactgtggattgtcgaaaagatggcattttgcagttggctacctgttatttgcaaatgtcaaggagtgtgaagacaatttctagctacctggtgcttttagtctagtaaataacttccgctcagctttcatggtgacaaatatcagacactggatcgtttactttatctagttctccagaaaatgcaagcgtgctctgcatcattgggcggccaggaaatcggtctattaacctgtcaaactcagtggaggtcacaagggacaccgagcagagggactggattgaggtggtttactgcagagacaggtaagtaggaatccccccagcatcctttgtgaagagggaggaatgagagggtcctgggagggcttaaagatggaaatacccatacacggtcagtggctcacaagcctgtttcctgccatggactttaaagtatttgacctcaggcttcgtgtaggtggctggcctctggcaaagattgccttacctgagctctgatgtaaaggttgggccaggtggctagctagctgccacaataaaggagataaagaaattttccaacttgaagtgtgagctcttgtggccagggaagcgcttcgttggtgaatgtagataatgaatgagacacggtctgacaaagcagtagaaatactttgtttctggactttctttgatggtttggt

SEQ ID NO: 199 - DNA, 1600 bp, mus musculus
ttccctgtttgcagaattttaaatgaagtgttaccataaagaaggcacaaattacttaatccacacccaagagccagtctcattaatttacaaccacacctcttaggtcacatcatggtcattaattatacctagaggatgtcgcaacaacagacactcctagtatgccctgaaatgttttcctgtccttttcagtgtattctgtcctgggtcttagaatacactgaccttcgtcagccctgtctactttgttcccctttgttggaaggcatgaaaaggcatcctgaggtgggtaccattaaatcagaatcactcaagctcactcttcctgactgtggacagcagcttaggaaatgcagcccttccatctctacctactcatgatatctccgctcttctttgggagtgcctctgacctggcatcctcattacagtcagcctcacacctcaggtaaagaaggaaagaaactccagaaactgggattccctagccacacagaagacagccaatggtagaggcatttggggaccgaaggcagctctggttcttgtaactactgtccctggaaaggtgattttacagcagccactgctgtcaagtggagataaatttcctataataagaattgcagcagcagaccaatatgatacttgggttcgtctggaagagccatccagggatattccagccttacagttgtatcagttcaagcagaagttgacgtctccacctcccagaggacagctttcatcttttaatcacttttacaagccacagaggtcatgaagaccataagatagctgaggccattgccaggtaccctgtgagcgactgaccactaagggactggggcacttctctgggtctgtttttctctctggcttttttccccagcctttctgtcgatgagatgcagtaggactgaaaccctaactggcacattgcctaggtgctgatgttggaatcttgaggggcattgagtaatccactctccccctaacttcagcatccatcaaaaaaggaggcgacttcgcttcccccatgcagtgctcatgcagagtgactcacctaccagaagagagatgctgcccagcacacagcatgaatgcctctcttcatacagccaaaatggtgacatttctgagtcctcatgcagtctgaaacggaacaagaaaaacttgaattgattgttgcctgctttttccgtatggaccagagacataaatcattccatgtgtcaaactctgcccttctccctgatttagtaatcactgccgtattgacttgggagatcgcgactagacatcagtatctcccatgggaaccagatggatcacttatttaattcacctaagactttggagtgctacgttccattaattcaacaacaatcatttttaaatgaatggttctaagctgacgtcttgagataatgagcttgatagagatacaatggaacaagagacgattctcagttttgatttaactttattgttttgctaaccactcccataagaaaaaaaatttcaaattctcaatgctctcaagcttcagacatatttttgtcaccatgtttactcggaaaagagagcaagtctc

SEQ ID NO: 200 - DNA, 1200 bp, mus musculus
aataaactaagtacccagagtgcttggtgtggtaccttgcacactgcaagcacacaagaagaagtaagcgctgttatcaaatacagaatatttacacactccttgcttacttagaagataggaaaatgccgggcagtggtggcgcacacctttaatcccagcacttgggaggcagaggcaggcggatttctgagtttgaggccagcctgatctacagaatgagttccaggacagccaggctacacagagaaaccctgtctcgaaaaacaaaaccaaaaaccaaaccaaaccaaaccaaaacaaacaacccccccccccccaaaaaaaggaaaaggataggaagatgtgactattagggcttaaaaggaaaggcaaaagatccacccttaaatccatcattttaactactgggcatccacaaagggccaggtcctaaaagtcaggtatgagtagctattcctttctttttattaataataataattattattgattatgagtttcatatcatgtacccctatcccactcatctctcatcccctcatatctgcccttttcccttacaatgttccctcaaattaacatacatacatacacacacacacacaccagcaacaaactcaaataataggaaacatctcatggtggaagccatagtacatcacagtgcgtcccacagtagatccctctgtccgcacatcttcacttgtaagtgttcattgcaatgagtcactgatctggcttctgtgacaccataaatattggatgctcattgagacttccagttatcctgctattgccctgtgccctggagatcctgcagcttaggaccagcaggcttggctctttcatgtgtcccaaccctttgcagatgatatagatttgggggcgggccaactcaaagccccgcttctgggcctgggggcatagctgaattggtcagcctgctggctatcccttatctgcaccaccagggcttgttctccagcatttctctggctaggccacccagtgccactgtcatcaagaggaaggatcagccctcctgctgtcatgcccttgggactgactcaccccacaccacacctccagggccagctccactgtgctgcccaggcaaggcatgggcccatgaatgactattctttagactcatgaaaaatttgatataatctaatcacgttttaccttattgtgaca

SEQ ID NO: 201 - DNA, 1000 bp, mus musculus
atactcacatgtccaagggcagatggttgtgctgggaaaggcaactggaaaaccaaattgaactactaaaggaaagatggctcaaggctcagcttttcctgtgaagtgtcaagtgaattcagcattcatgaaagtttccagagctggttggactccagagagccccagggtgtgcccctgtcacctctgtactctggccagagcatggattgccctctgactctggtctggccatagtacaataccacagagaggcccatatccctgtcttaatctgctcagctcagagatgccccttccacactgcccctaagggcatcagccaatacactgccaggaaatgtaggcaccaggcaacatagttcaaagagatagggagggcagatgccaggggtggaggtgggggtggggttaaaaaggtcctgcccttgagggtggagcactagagaagcatgggagcaggacagagactagctggggccccttcagaaaggtcactctcttcttccttcctcccaagttaccacctgcattcaaacagaaaccagcttacctatgttccccagactgtgcccaggcacaccgcagcaggctcgtcagagatcctttcactcagcttcatcttttattaaagacaacaatgaatcaggagaagtggggttcacacgggcactctggattagccagagcttgggaatcagccttgtgggctctagtcttccccccaaacccccaacaaataccgttgccgcactactttgactaggctgaactcgttggctgtggacattccaactcccacctaaacccacggccacacccttcctacttgcccttaattttgcttgaggccagcacctatactggttcacattactcctctgtttaagaagtccttttactgagcatttctgtgaaaccacaggcagtaggcaggttcttcctgccaaagggaacttcccagtgatgggacgtccatcctcacatccagtgtgtctga

SEQ ID NO: 202 - DNA, 1200 bp, mus musculus
ctatcttcaccccctttcctctctgagtcattaaaggctgactttcttccagcctggtactcatccggctctttgcagtttgccaaaaaccttcattcccacgtcatttcccactggatcccagggccctcttgttgtcagtgtgcagatagcagaggtctgggaataggaagctccagtgagtggcagcttccaggacctcaggcctggccataccccactgctcatccccctccagatctgcttgtcctctggtctcaggtcaagggccctttgtggccacaggagcactatggtcgttttgcaagcacaccttaggtgagttagccaggagccacatctttctgtgtcagagccttccactgggctgtgcagtgccctctgttgttcctctgagatgcccctgcctcagtttcccctctcatttggcttcggctgccctctccaggcacagcctttggaactcactctagcaataccaccggactagttagccttcccggccccaagacactcgcagtttcatgcctttgtgcctttcgctcatgcggtttcttcagctggaatgccttcccgctcctgccgcctcctctgcctggcaaacacctgttagcctctcccaggcccctcccccaggaaggcacccttcacccctctcttccaggctacctctgcacctgtaaatgcttctctcgtggcacctatcacaccgtactttacttgtttacatgtttgtctccccttctagactgtgaatccttaagggcatggactgtatcttatgcatctctgtatttctgcgcctagcacggtgcctggcacacagtaggcgctcaataaatgttgaatgaatgatttaaccaaggtctgagctctcaatggcttatctatgctgcccatgggtaacaacagcagagaatctgctcactgtttcctgactccattccgggtcccacaactcagggtacttcgtgggaaaagctctggacaggaaaggctccaagggcaccagaacaacccagaaaaaatgcctccacatgctccttccacagcccctgtgctttgggttcagagtttgcgatgtgtgtacctgggtccttatcccagcttgagacacacaggataccactagccacagaccagccaggaagagcactcagtggacacaaccttggctccagcttgtctcttctgttctgt

SEQ ID NO: 203 - DNA, 1200 bp, mus musculus; identical to SEQ ID NO: 202

SEQ ID NO: 204 - DNA, 1000 bp, mus musculus
gcaggggctctcggcgaccttggcaccccgatttggagtgcagagttagggctttttcccggcgagtgataaaaggacagtgtgggcagcggaaggctcttccttctccctggatcacgaccatttgtacccggccctccaacaccaacgcttctgcttgttctttgtcctgtctcctcatggccttaagtagcgactctgactcaggaaatggaggcaacggtacagtctcagcagtcagagctgccttgaatgtattaggtgcttcttcagaaattaggggatttctgggaggctcagaggctagcttctccacaacgggctcttcttcagcaaccaaggcaggcgtctcaatactgtcaaagctggacagtgctggctcttctagtccacctggtctttctgttcccaatggtcctgagggatccagaggcctgaactccacagtggctgtttcggtgagctcctcaaggggtagtggctcagtctcaggttctagctctactctcagggcctccaagtgtagtgtgcagccaccctcttccacctcccccaggctggggctgtcaacctgatcatcctcttggggagcctcaatgccatcttgtcttttggggctggcctcctcatttgtctctggcagggcctggtccatattggagttagccacaatttcatgttcacggtcttctctctcaggctgggcagacagctggcttgaaggtcctgagtctgaaggaggtgccaggcactgcctagccccctccaactcttggctagcattgcagaactgccaaacctggtcccctggcatgtagccatggaccttacgcttgtggaagaagagtgtggtattgctaaaggtacggtagtcacagagggcgcagtgaaactcacggagatgggtgtgcttgcagttctcatggctcaggagggcctgcttgtggcggctctgatagctacaatagcggcaggggtagagtggggcaggtgtgccagg

SEQ ID NO: 205 - DNA, 1200 bp, mus musculus
ttgatctggcttacacctccaatctggtccatcattgaaggagactgagacaggaatcccaacatgaacctggaggcaggagctgatgcagaggccatggaggagtagttgactggcttgctccccatggcttgctcaccctgctttcttacagaaccctgcacgaccagcccagggggtggccccacccacagtgggctggcctctccctcatgagtcactaagaaaagcgctctacaggcttgcccgcaacctggttttatggagacttttgtccatctgaggctccctcctctctggtgactctagattctggtaagttgacgtgggctcaggcagcacaccaggtgactccaggtttcgtcaagttgacactgaaaaccaaccagcactctggacaagctgaagcatccccaggataccttatattatcttgtttaaacctaaaatgcatgtagccattatacctcctgtaagtcccatggggacaagttctgctgctcaccactctattattggcaccccaaatgttgcctgctatattagtcagtcagcacttgttaaggaagtgttacatgtacgcctattttataattgtggaaatgaggctttgtgcagctctgtgtcttgcccaaggttacctcgctagtaaatggagggagcaggatccaaacccaggcaagtctgagcagaaacgggtgctctggcttcttctgatcactgctcctcttgtccatggtggagccagactctgcctcttctggcctgccaggtgcccaatgcctagacagtgactcaggcgccttgagggcagggagggggtgacgcctgacaaattctctgtcctgactctgggatagaggacatcaaggcagcagatgagacagggcctcagccaggatagagactcccttggggacaatctttgggctgccactgaccctgggaagaatctcacaatatcttacaggaggtgtggcaagaacctgggacaggccatcaggaggactaagaagaaagtaagtgacctgccaattgggctgtgtttccagatagataggcacggtgctcttctctgtctggtgtacagagacaaccagcccaccctggttgtctctgtggctatgtcctcctccagttatgtggcatagctagtacacacatccccaagctcccactggcgtgcactgacaggcctgg

SEQ ID NO: 206 - DNA, 1000 bp, mus musculus
gcccgcacatcctgcagccgccgcaagaacagcagctctgtctctggaagggaagatgagagatcatggagcccagaggttgaaggctagctcacttctaggccatggttgtgaggggttagctacagggaacagagcattttatgctcagtcacactgaacctcgaacgtggagcctggcacttgtgtcagcagctccggctcgcgcggtcacggtccctgcgtctttgagttggcagcctcggatgatcaaggtgcggcttgaaccattctggaccatttccaactgtggccctgcagtgataaccgctccgttgcgtagccaggtgacttcggcatctggtggtgaaacctcacactggaatgtggcatcgtccccctcatggactgtcagaggcgtcagttcagagaccagcttcactggcgggagctctggaaggaggggtgaggcagtgacctggatacctctttctccctctgtctctctccactaccaacccccaccctgatccccctacaggatgcaagctctcattctcccaccaattacaacagcttgagtgaggccctattgtgtgttggttgtgggggttctcccaaagaccaggatgccaaatcctggccacacttagtaagctccttgaaatcccagcctggcacctcttcccaagtctctagtaccaatacattatttactatgggcccagttacaacatttaatggtcatagcaacctatctgccatcccatttcagtgctggggctcaggggaataaaatggcctcgcaaatgtcacccaagtcccagagagccaagtctgagttacaccctggacaagttgactctagagtcctccttttaatccactgggctatacatcctgctatgctagggtgctggaaaaaaggaagatgccctcttacagtgacagtcatgaacgcattggtgggaaccatagagagcagttgggtgaggtataggagatgaaaagggtccagagg

SEQ ID NO: 207 - DNA, 1400 bp, mus musculus
aggcctcctcttcaaggagtctagctaagatgtcctcacagcacgaagttccaggatggtgataatggaaattaccacttctcttgatgcttcatatctaagtccccagacataacttatgcacagtttctatgggtggaacataagctctgactcctaatggaagtcaaagatccatggcaggggctgaagaggtgactcagaggttagtgctggctatttttccaaaggtcttgagttcaattcccagcaatcacatggtggctcagaaccatctagaatgagatctggtgcctcttcttgtgctcagtcatacatgcaaacagaacactatatacataacaaatgaatcttttaaaaatggcaaatggagatgagggtcttgtagctggcaatctgtcttgggaagtatctgactgactgtgcgggatggagatttgtgttggaattccatggatgcagaaaaggtatttaaagatgctggaagagaagagagggagacacattcactccagtcagcttgctcctgagttgggctgaggccacccatccatcctcattaccaagttcctccccagctactgacctcttgtgaattctatctcgctcctagcttcctgggtgcacacccatgaggggaccatgtctggctttgtggccagtgttaccctgaatggaagccctagacactggacagcgctgaagcctgagggtgggtttctttttgatggacacaatgagagaccttctaagatattgcctagaagacagaggctagaatattcatgtattaccaatgtttacgaagcaaatgattttgaatatctattcttaaagtctgaccagagcctgacccaatgaccaaccttggttaaatgatagttttttcctcccaaaagaatatacaggttagacccaaagaggacagaaaagcagagggcatgggaagcaaatgcttactgagggccaaggttgagcgctgacttcatgtgtacatgctcattttatgagatggggaaatcacagctcagaaagtttcagcatcttcaccgagatcacacagctaacaaaggtgaaaggatttctgtgcctactgggttttaattttgacataaaactttaaagtgtgccaaggatttttcccaaagaggtggagacctgcagtggtgtttgttattcaagagttcacactctgcttacaccttcaatccctcccttgtattccttaatggtagttgatgtctactagggggatggggagagcgagtttcgttgggagtaaagccacctgtaagctgcctgtgctccagtagatggccccatccatgtgcatatgggcagtgctaatactaattgacctcaaagatgtgctggggcgggagagttagggtggaggagct

SEQ ID NO: 208 - DNA, 1200 bp, mus musculus
aagagtgtggtagcatgtgcaggacctgtccaggttcaagtcagatgggatctgagcagagagaaggaagtgaacataacaaagcagccatctacaactgatatctccttgcaaaagaaaaattaggagtcttccactagcagacttcagatgaagatgtagaactctcagctctgcctgcaccatgtctgcctagatgttgccttgctcccaccttgatgataatggactgaacctctgagcctgattcagcttagctgcatttaaaaggaacaagaggaaactaaagctggcagaaagggtggaaacagactccagccagttgaagagaaaaagacaatcaagtgtaaaggaaaaggactcgggcattttggacacagtgggtgctgtggtcctcgatcacaaagggaatgttgctgctgctgtctccagtgcaggcttggccttgaaacatccatcgagagttgggagggctgctctttatgaatgtggctcctgggctgaaaatactggagctcataattcctattccacagcttctttgtggtacataaaaaatcttgctgtatgccttccagtttccatctgtgcctggagctgatcctgtgctgtgccacagcgctccatactcaaatcctactgggagagagctggtctcccaggagtgctgacacacctctgagcacaggtaagaccaccacttctgcacaaattcctggcccaagagggaccttccaagagccatcaggacacaggaaccaaggaacaacaggggacaggatccttccagtttctgtctgtgacctggagctgaccttgtgccacagctctccatacccaaattccaccaggagagagctgctctcccaggagtgctgacacacaggcttataggagggacaagccacagcaagaccaactaacaccagagataaccagatagcttgaggcaagggcaagaacataagcagcagaaaccaaggttacttggcatcatcagaacccagttttctcaccacagcaagccctggatatcccaacacactggagaagcaagactatgatttaaaatcacacctcatgataatgatagaggactttaagaagggactgtattcccttaaagaaatacaggagagggctggagagatggctcagtggttaagagcacagactgagcttctagaggtcctgagttca

SEQ ID NO: 209 - DNA, 1200 bp, mus musculus
ttttttttttttttttgctcagagatggaagaataaatactatctcagacaccctatactgtaccacagacttacagggctcatgtgtgaaccctgccacaaagatttcactatgtggcagtctgtcctatgcaaatgtcaccgtattaacagattgttcattctaaagagggacttccatgctctctgaattaaacattgttcaagaggtttttcctgaagcatcaagctgtttcttcctgttattcaattgagaaaaaaaagggagggaattattattattgtcattgttgtttttgctttctagcccaaagcttcaaaattccctctacaatccttcctaagccgatatgctgaactccatcatgacaatattcctctctctggtaccaaattctcttcttgtttgccctgtggcaaaacagggaccagacccaccttggggagaaaaggatatatttaacttacacttctacatcatggggtgggggtggtgagagtcaaggcaggaactaacatgggaaactggagacagaactgaagcagagaccacggagaaacactgttaaggcttactggtgtgcttctccggcttgctgggctccctttctcatgcagtccacggccacctagagacataccatccacagaggcctgggccctcccctctcatcaacaatcaagaaaacgccccacagacctgcccacaagccactctgatggaggcagttgtccattagcattcctgacttcctggcatatagctttgtgtcaagttgacagaaactaactctgacagctaacttatcaaaaggccaactgtggcatttggcctctttctcctgtgttcccctgaccagcgttcccctgaccagcgtgaagtatgaagtatcggcttcttgacaaacttaaacttgtacttgaatagcctagagctcccagtgaggtgagcagaggaggtgccatgccttcctagttttgttacagagtattgcattctttgtcattagcttggtcagcggcaaagacgtgttttcttcctatatatactagtttctgtgtttcctttctcattttaaaccagcttgacttttctcaaggattgcatatggaagagtaagctttactcaaatacttaaaaatgagatgcagccagaacacaagcccctttgggatgccccagaagttagctctcattga

SEQ ID NO: 210 - DNA, 1200 bp, mus musculus
gcatgtaccaccactgcccagcatctgttcttttctaatgagaaaaaaaaggagtggatatggtagggagaagagaggaggtactggtagtagtagtagagggaggggaaacaataatagagatttttttttgtttgtatgagaaaaaatgttttcaaataaaaggaaaaaaaaaagaatacccctgcacaacagtacagcagccttgctgaaggtgaggcttgagataatagtgttcaacagaagtgggaaaaacaagggtccttcattcgtaggctcatttgggtatgtccactttgtcactccaggttccagaaatgtttcctgagagattccctccaaacgtgttttatatagcttaaaataattcaggtttgaattgcttagtgagacatgatttcaccacattttgccctcagttactactcttctgccttggccctgtggatgcagggactgtggtggttgggactggagggctaaacatttcaccctccagcagaagcccttcccagctccttaatagtccccgattcaaaaggtaagatgaaccctaactcttaataaagaattgaatgtttttcagaatcttccagaaaatacttccctgtcccaactcccacgcatatatttgaccctgcatagcaacctggtaccctgtagctagaacaccctttgacctccatggctgaattcatgctgttctcatatagttttgttcctcatggctgatggccacaatgatatccagtctgtgttcctgaattttccctttttatagggtatcacttacatttaattggaagcccaccatacccaagtgtaacctttccttaacctattacatcttcaagtatctcattcccaaagatgttcacagcccaagacactgaggtcaggacatactgggagttggagggtgtactgcctagttttgtgtcaacttgacacagctggagttatcacagaaaaaggagcttcagttgaggaaatgcctccatgaaatacaactgtaagacattttctcaattagtgatcaagggggaaaggccccttgtgggtgggaccatctctgggctgctagtcttggttctctaagagaacaggctgagcaagccaggggaaacaagccagtaaagaacatccctctatggcctctgcatcagctcctgcttcctgacctgcttgaattccagtcct

SEQ ID NO: 211 - DNA, 1000 bp, mus musculus
tgaataccatgtttccagggctgggtggggaaggccacttagaggcaggagatgtaagacaaaagcatcacgcttttgtctttgctcagcaattcacagggcacagccaagcaccaaggctcccactgcctctttcccggtctgcctttcctcttccttcatattcctagtaaccacacagtcttcaaacattagagtacatgcttaaacacaaaaaacaaagaagacaatggtcaggaaaaatcccaagtcatatgatttcttgccacatctgaagcatagttaaataataccatgaagttctacacgaggatcccttctcagaaaccccatgattcgccattgggaggaaggttcttgcgagagaaaataaatgctaaggacaggaagtatgtaagagaaacatggagacagtatgatagaaaaggctttgtcagatatactggcccacgcctacagcctgtgtgcctcccaggaggtctgcagaaatcaaagacaggtaagaatctagcccaatacccaagccagctgacacaaccatcgggcccagctgacttgagacccacctccccagacccaaagctccacccttcttccagcctgcttcctacctggaccagatctgaggccagatacccacctacatgctacagcctgtttgcctctttggtggtccacagtaaccaaatacagagagcccagctgacactggaccaacctgccctgcaaagctccaccttcgttctggtccactttccacttgggtcagatcagtaggctgatactctccgacacctcacagcctgcctgcttcccaggaggtccgaagtaaccaggaacacaggatgcctgctctaaccaaagacacaagaggcccaccccaaccagagacagcactgcctgccttcaaggaggccagctctagtcagagacatccaggccagttaacaccagagataatcagatggtaataaggatcataagccacagaacccaatgc

SEQ ID NO: 212 - DNA, 1200 bp, mus musculus
ctgcagaaagacaagagatagtgcctgtcatttgttgcataatgccaggcactacttattgttgcaaatagttgtcatcagcacagaggcaggtactacagtatttccaggtggataagattaagaactttaataaggagttcagagtcaagtgaacttgactgagcaacagatctccaagaatcatatttgtctgattttgatccatatgctaagacatttataaagctatttgagcttaataagtgagctcaccaatcaacatgcacatccattgttctgctttgaagaatttatatagttaaaatcgaattgagaaaactattctgaatgtgacggatttttacacctctgttcttatctctcctggtatactcagaagtcatttttttttttattgtcaaaacatataccttgaagaacctaaaggaaattttgactagggattcaaaattattctactaggaggaagcaaacactgcaaacacgaaatgatgatgttgttggagtagcccaacaaatcagtgatttgggagattcttggaaaggtcagcatagcccagaagagccacatctgttcggtaccttgatgttcctgcacagctggtgcagattcgatgggaacatcaccagaaagggtccccagagactggtcacacgcggctgcttcttccctttcatcttctgattctctccctgagctagatgctgtctgcctaactgaagtcagcctctcacagagggcatggttctcactctctagtctgttgatttctgcccgaatttcctggataacccgcacgagtcggatgctagcttccattgctgattttcccagaccaactttttcttgagtcaaatacacaacctacacagtgggcaggatcagcctgcctataaatggtacatgtcacttgaacaatggagctcatgtctctaccgtctttcagcacctgggttagactgcccagggaaggaaaagaagtccatcacttattcatcctgggttttgttttccggaacagtacattcctatctttcatttcatgtcaatcaacagacatagaatactgtttgtgtctgagtgaagagaatattccaaaaatttccagtaaagggcagggcttcttgttttcatcattcatccaccatcatgcttgccatttagtcttttctgttgccacatccggtatcaaatat

SEQ ID NO: 213 - DNA, 1600 bp, mus musculus
gcaggaattaatttaaaagccatctctatagaagaactaagataaaagtgacagttgtagtggtgcacaccttctaggtcagtattaaagagaatagaacaagaagattttgaatttgaagccaatgtaagatacttagcaatgccctgtctgaaacaatagcaacaactaagatatgaacctgcctggaaacttcattcctttagccaaactattcaaactactctccattgtcttatgttgaacatcaggataattatgcccagatggcagatatgataggaaaggagggtgacacataaatatgtgacagatataaagatcatgttcaaaagtgggcaccctacatgtagatgtaggcagttacttaatttatgtggagtaaacaagcaaacaagtaagcaaaatatgaggcttacgttgaaaaatatttcacctcatggaaacaagaaagattaaaggggaaataacctgttagctcttgagtgacatgatcatttgactggtttaaaaactaagagtcgccttccggtcaagcgtcagcctcaggccaccttgagcatgaactccacagactgtcccatagtccccacaggaatctccacatcccaggcaccctagcacacccagaaacttaggattactggtgagtcaaacgcaacatctgttccgaaacagctgtgaggggcctttgccagcaggagcagggacacaggaaacctgcataaccagcagctcaggttccttcctgtctgtgctttgaacacaggggacagcctcaaggtcccctagaggaggtaccccttccaggtgatgcaacatgcctaggatcttaggattccaggatcccaggatcccaggggattggtcacaccaggatctcagggtctcagcggaagcttgactgccaagaactctgacacacccagaatctcaggttcacaggatctcagaataacaggatcacagagaaaactggactctgaggagttctgaatccagctggattacaggaaggacaggctccattcagatataatgagggcagtgaacacttgagataatcagatggcaggaggcaagcataagaacagaagcaacagaaaccaaggttacttggcatcatcaaaaccaaactctcacactataacaagtcctggatacaccatcacaccacaaaagcaagatatggatctaaagtcacttctcatgatgatgatagaggactataagaaggaaattaataatcccttaaagaaatacaggagaacacatcgaatcaggtgaaagaaatgaaaaaaaaaaaaaaaccaaaacattgagaatctaaaaatggaaatagaaacaaaaaaatcacaaagagagaccactctggaaatagaaaacctaggaaataaatcaggagccattgattcacgcataatcaacaagatacaagagatagaagagagaatctcaggtgcagaagataccatagaaaacattgatacaacaatcaaagaaaatgcgaaatgaaaaaaagatcctaacacaaaaagcatccaggaaatccaggacacaatgggaagaccaaacctaaggataataggtatagatgaga

SEQ ID NO: 214 - DNA, 1000 bp, mus musculus
gccgctttcgatcaagattctgaaatggagtcaatggattgaatcaaaaggatctctgatcttaggtgaaagaattaactttctcatgagacatctttaattagaagctatcatttcttgccagtgtgagcacaacccacgttcccccagacaatgaatgctaaaagcactcctcacaatgggctgctcagagtcatctcctttattttcgaatcatattaaggttttgaatgtattctgaaatgtgtttatcattagttttgagttattggattctttagataattatattctctgtctttgcaagaaaactacatatatttaatttgattttgaattgtttttacgaatcaggttctaataaactgtttccatagttagctcatatatcctactgtatggattttaacctggctgggctggtgttctgcatgtgtataaactgagagatggctgctttctggaaaacgaggtgccaagggcaagcagagagagcagcctttctctcatttctgtgcaagcacgttaactgttacttctgctgccctgagagtggtctctcagctcttaacgtgcccagggctttgtatatctcctggtctcagttcaggttctttctgggaatctttcctgagagagattcctgtccccattattattcttgaacatgtcttcctcccttattcaagactgcttcattgatgaagacccttatagtattggaagagaccagttggagcagccaaatgtgcttatcacgtgaacttgaaaagaacccctcaaaagagtgcagcatatcctgagtaccatcagacacagatgtttactataacacagaacaactttgactacgactcaggaaggcataagccgtaaggggctatgggaaaccttaaaagcatgcagctttctctgcctgttagaggacaagaaagtcagaggcctttctttggacatcacactacatgttgattctggctttaaattggagagaggtaag

SEQ ID NO: 215 - DNA, 1000 bp, mus musculus
taaatactcatatacattattgacagagcgtttggtcatagataatataaaatgtccagtttccagcgtggttgttgatgaggctcagagaaaagactctaaagttatgatgggaaattaccatgccattcatcatcatacacattcacctcacactttctgagtctcctatacaaagtcagttctctgccaagggcatggaagagcgaggaacaggatgttaggaagggctgacagcgctgttttagcctgacaggcagatttacaacaggagaatgaatgtaccacttgtataagaaggccatgcggcactgctaatgcacaagttggcagtacatcaacatctctatcgtcctcatattcatgaagcagagaacggaaatggcacactgcttgtaccggcgaataaccaaagtgaacgccctacggctgccattcactgtgtccttccaaaagcatttttctactgagctcttcccagagatttagggtttgcttagacaggtcttatgacgccacgtgataggtcattcttctgttctgaggagcttggagaagatctaatgcctgacctaagctttgaaccccaaatggggaacgccttttagaccaagtattggactgtagagacagcttagaggttaagagcacttcccactcttgcagaggacctcagttccttacctcgcacacaagttgggtaacttacaactgcctgtaacccaggatccagggagatttgatgcctcggattcctcatgggcacatagccatacacaaacatacaattaaaaataaaataaatctttaaaaatagaatgtgttgtaggaaattctataacagaaaaaggataaatcctctaagttagacaatactaaaacagttatagttatatgcacagaaattttcttctcagattctcatcctatacaccctatacatcctatacatagaacattgatgggaggatgtgggtttctagaaaatgaagctgagttg

SEQ ID NO: 216 - DNA, 1000 bp, mus musculus
cttcaatccttttttttcctgtccagtcattatttccctcccagtccaccctttgacagttcctcatcccattcctcctcccctgtcttcaagaggatacaacccccactccccaccccataaggcctccctcctccttggggccccaagtctcttgagggttagttgcatcttctcttactgaggtcaggccaggcagtcctctgctgtctctctgtcagaggtctttatcagctagtgtatgctgcctggttagtggttcagtgtctgagaaatctcaggggtccggattagttgagtctggtgtctccttgctcctcagcttcttccagcctttccctaattcaaccacagggattcccaacttcagtcccttggttgaggttaaatatctgcatctgtctcagtcagctgcttgttgggtttcttggcgggcagccatgctagactcctgactataagcacaccatagcatcagtaatagtgtcagtccttgtcctccccttgagatgaatcctaagttgagccagtcactagacatcctttccctcagtcttttctccatttttgtcctgcagttcttttagacaggaacaattctgggtcagagcttttgactgtgggatagcaatcccatacttccacttgatgccctttctttctactggaggtggactctacaagttccctctccccactgttgggcatctcatctaaggtccctcccttttgaatcctgagaatctctcatctcccatctctggtacattgtagagggtcctccccacctcccacacccagatgttatatatttccattcattcttctggcccccagaggtttattcctgtcccaccaccaccaccacaatacctaattatcttccccctttcccctccctgtcctttctcctacccaggtttctccctttctctgccccccccctcccccgtgattgctttcttttccctcccaaatgggattgatacatctccatgaa

SEQ ID NO: 217 - DNA, 1200 bp, mus musculus
ttctttctaattgctgagtagtactccattgtgtaaatgtaccacattctctgtatccattcctctgttgaggggcatctgggttctttccagcttctggctattataaataaggctgctatgaacctagtgaagcatgtgtccttcttatcccccatctggtccaccctccgactgttccacatcccatacctccttcccctgccctgctcatctccatgaggatgtccccactcccccacccctgacttcaacagatctccccactccctggagcctccagaatcttggaggttaggtgcatcttctctgactgaacccagacccagcagtcctctgctgtgtatgtgttgtgggggcctcatatcagctggagtatgctgccttgttggtggtccagtgtctgagagatctcagggttctaggttaattgagactgctggtcctcttactgggtctccctcctcctcagcttcttcaatgttttccttaatttaaccacagtggtcagctgcttctgtccattggttgggtgcaaatatctccatctgactcagctgcttgttggttctttcagagggcagccatgatagcctcatttttgtgagtgctccatagcctaagtatagtgtcaggccttggggcgtccccttgatttggatcccactttgggcctgttgctggacctctttttcctcaggctcttctccatctttgtccctgcagttctgtcagacaggaacaattatgggtcagagttttttactttggaatggcaaccccatccttgacttgatgccctgtcttcctgtaggatgtgggcttgagaagttccttctccccaatgtaggtcatttcatctatggtccctccctttgattcctgagagtcttccatctcccaggtctctggtacattccgaagggttcccccacctcctacctcccaaggttgcctgtttccattctttctgatgaccctttagtccttttcctccacccaatacctgatcacgacccccctttttccctccctgtcccctttcctacccatgtccctccctccccatcctgtgattgctttcttctccctccaaagtcgaattgaggcatcctcacttatttctattggttcatttctcattttttatcattattgtatcttgaacatgctagcattgtgtttgcatattaatgaaga

SEQ ID NO: 218 - DNA, 1000 bp, mus musculus
agcctcacttgcaaatgttcattgcagtgagtcactggtctggttcaagatctctcgtttctgtgacatcatcaatattggatcctcattgggaatccttccagttctcctgtcgttgccccgtgtcatggagatcctacagctttggaacagcagaactgtccctttcacatgtcctacaccccaaccattcagagatgatacagattttgaggtggtttgagccttggttcttggcctgggtgatagcagagctggttagctgatgggctctctctcccttatccacactatcaggacacgctctccagcactgctctggctgggccacctaggtcacctttcctgctctcatgcctttggggttggcttacttggtgtccccactagcagaatcagctagctatagccaatgagggcccagaattagctctcccactctcatgcctgtgggataaggaggatctctcctgactacagggaaaagagagggcacaaccctcaaacccacatcacctcacaccggaggagtggtagggccagctcattcactctctggacctagtgtctactaacttgaacctcatccaccaggtccagctctggtatgtgctgcccaagcaaggtgcagggtccattctcctgaatgctgcagctgatgaggtgtacagctagctctccggaggagatcatgaccttgtaggcagctttcccaagtgccagaggtgaaggggtgagagcccacattctcccacactcatgttctgaagacctgcttccagggccaatgccactgtgctgtcggggcctagtacaggttctgctttccagcaagtgctgccaagggtgagagacaggggcagctcagctgtttttcctggacatccaggtggtccccagtggcttcccagactaggagcatctccatgttctctagtgataatgtgaaccacagacattgccacagactcagacatggccctcattgtcatcttgagct

SEQ ID NO: 219 - DNA, 1400 bp, mus musculus
ctgactcaataacatttaagtctctattccctgggatatgacctagaggtaagtagtgcaagaaaggacatgagtgatccaggattactgcctggagatgtttctgaggtcagcatggacctggattactttctgccgtcatccatcaacccatcctgtgagagtgctagccactgccacttggtgttgttgagaacagttttcttgatatcaagcaaaggtctgtctgtgaagaactgttgaagaatgttttctccttcccagtcctaaaaatagctgtatttctcataagttactggctttgttctatatcctatgagtgatgtgagttgtaaaattgatcttgtttcctttttgacatgcagggttatgaaactcaatcccagagcaggtccacgacctgtatcttctcaaacatttgcagagcagcctagggcccaagaagcaaggactagttctcaggatgttgcctcagttgacctgcatatcctgccaacaaacagctatgtcagaagttcgtctaagtgtctctagctgcatatgtatcaaaagatggcctagttagccatcactggtaagagaggcccattggtcatgcaaactttatatgccccagtacaggggaatgccagggccaaaaagtgtgagtgggtgggtagtggagtggggggggtatgggggactttggggatagcattggaaatgtaaatgaggaaaatacctaataaaaatattaaaaaagaaaaaaagatggaagatactgtgaactaaactgaatgtctcttaatccatggtttccttactaatgtgtgttattatcttgcagtattctatttttattttacattacattcatttgttcatttatgtgcacagccatgtgccagagcacacacgtggaagccagaggactacttgcagtggctactgctcacccacaatctgacttccaaggatcaaacttgggttgttaagcttggtgacaagcaactctacctgctgaaccatttcatcaacaatttcatgtgattttttaatgaagccagtctttcacttgaagagcacaattaagaaaagtttctaaaggtatatgaacctgtctgctgctggtatttgtgtaatgtttacaggtttatttgttttacgaaatggttagatgataagagatagtgaagagaaagggaggaaggaaggaaggaaggaaggaaggaaagaagaaaggaaggaagggaggaaggaagggagggagagagggagggagggagggaggaaggaaggggagggaccaagaagtggtgaggggaggagtgatgggtttctgcttttatataagccatttaatagccataaaactaggggaatggtaacatgttgcctatgtgcttttgttctacaactat

SEQ ID NO: 220 - DNA, 1200 bp, mus musculus
cagaaataaaaatacacacaggaattatggcaggaagaaatctataattttttctgggaaacggagttgatgaaacttgtaaaaagcttctagaatagaaatcgatttcaagcatatgaccaggcactgaaaccatacaaaagttttcagtgcttttgatggaatctagaaaataaaatcctcctatcccttccagtcagcgccagcaccaggtcaccttgtgcacagagttggtggacacccccaaagtcccctagaggactctccattccatctctagaccactggtgagtggaacacaacttctgttccaatccaatcctgcgggacctgagacagcattagggaagcagaaaagccggcctgaccaggatcacaaatcccttccggtcaacaccagcactgggtcacctggacacagagtaagcagacatccctaaggtccctagaggacagcttctgaggcagaccccatttctggttccagacatctgggcaccttctcctgccataggagaggggtcagccctgcccaggagggctttgctggagcacctgggggcgccatcttggttcttggatccctctgagactagtctgcacgggtgagagtgtggactacagaagctaacagcttctgagacaggccctgttttgggccttcatcttctgccaggaggcaggtctgaacgccagatatctgtgcaccttccctgtaggaggagagcttgcctacagagagtgctctgaccactgaaactcagaagagagatctagtctcccagttctgctgatagaggctaacagaatcaccgagaggtacaagctctaaccagagacaactataaaaactaactccagagattaccagatggcaaaaggcaaacataagaatcttactaacagaaaccaagaccactcatcatcatcagaacgcagcactcccaactcacccagccctgggcaccctaacacccgaaaagctagacccagatttaaaagtatatctcatgatgatggtagaggacagcaagaaggactttaataactcacttaaagaaatacaggagaacactgctaaagagttacaagtccttatggaaaaacaggaaaacacaaccaaacacgtagaagtccttaaagaaaaacaggaaaacacatccaaacaggtgatgaaaatgaacaaaaccatactagacc

SEQ ID NO: 221 - DNA, 1000 bp, mus musculus
tgctgcagtttccacctgtgtccttagcttcatgtgcctcgcctctccttagctcctcgggttctaatgctcagccacgtctcctctgcaacccaccctccaatcgcgctctgctccttctttggaacttccattttatataacaggctccatacgccacagacctggggcttcagcctgcctttgtcttatctctcaccttccaaatccatcccatcgtcagtcctatagatactcactttaagtttattcaaatttttcctgctccagtaaggtccatcaaatataccaaatagggtgttggtaattttttaatggtcatatacgaggaagtattgaaggctgccactcagctccattgagatccttaaagcagagggggaaagaacaggagctgaccaccacaatggactgtttctgaaagtcccctctccctaaatcctgatagatgggaaatgtaactgtcacttggcacagatgtgtgtgaatttcaagcttaaaagctctgtacattctgattggggtcacaggtcagctcccgatcactgttctgtatccccgatcaatcaatagatgcttgattacaataagttttttgttgtggccatagacctggtgtttgagttgtgttggatctaagcagactttgccgtaactcttctcttcaaagcagaggctaataaacagtcagcattactgtcaagaaagtgctgaccccccttcccctccaggacaagggagcaaaggaaacaatgtctgaaaaccttacatcctggtgaggattaatgttgccagcttgacaggcattgtagccacctaggagatgaggtacatctgtgaggccttatgtgcctctgggtgtgtctgtgaggggttattttgattcatttaattaaagtgggagccccaatctctaagtgagagcatcatccttcaggctgggtgggtcctggattgagtagagaagggctgagcttgaactgatcctcctgttcccatc

SEQ ID NO: 222 - DNA, 1400 bp, mus musculus
tcaagctaagagtcaattgaaacatttgtgaaagggttttaaaaatagctcttggtagttcctgcttccttcccctcagggagagttcatgcagggctgtctcttggagacagaggaaagtgctgtaaatgagtgttgagtttgaggttggtgtaagagaagaacattaattaattaattactttgggaagatggagccaggagtgttatgctgtgggaggaggagcttccaggaccgaagggcgtggatctaaagagccccaaaggatgcccagcttagaaggagccaggctggcattcaggctagcatgtggactggtttgtcccatcacccatctccagtatcctttcaaaaacagtacagtagatgagaatctggagccagaggcagactcttggctctgtggtttcctagaaggaccactgaggttgcagtgcagttacccaatttgagtaggaggtttgctgctatcagatcctaatttgagggagaagcagagtcacagggaaccctgaactactgttataaaccccgtggggtgggcagattagcacagtgtggggatctatggttctctgtctccatggaaacatctttgctaattctctatagtaagtaaagaagtcggatgtcctgaatatgcttgcaacagataaaggggcagtgggggcttggggtgctgtgagcagcaagttcacttgcagggtcaggccacgagcatcaccccctcttttgcctgttgcaggtaccccttgtatcccaaatgcaatgggcctttagttctgaggacttctaaagccatgaacctgaccagaaagggcagtctgctggtgagttctcactggtgcttggcttagcctcctttgcccatttcagtacaagatggagcctgaggggcagcctgtgtgtgactcctcagcagtagccagccctagtctaaggagctgcaacagctggtgtaggccctcattagcgtgagcaaacagccgggagcctgtaagtaagcaattaaagataaaaaagaatttccttatgtgaaggagcttctatggaggaagcctgataaggaaggggagagatgggatggaaaaaacctaattagcaatccaaagagcagcttgtggatgcttccagaacacagggggaaatgctaaggtgatggctacacctgagaaggtggcatgtccagggatgacccgtggaccaagggcctgggtgagggggaagggctgaagtagggtggctggagacgtcccagacagatcaagaccatcaagaattgcatcattcattccaacaaaaagaaggcaagcatcatccacttaatagatggggtgagtggctcagacatggggagagtgaggaaccctgacagtgacagggagctggccctgggatg

SEQ ID NO: 223 - DNA, 1200 bp, mus musculus
aagctggcaactcaaccaactgggttgaatacttgctcagtcctgtgagaagtcaagactagcatgttatactacccttcccaggggctatgaaaatatgctgtgactgagtagtgcctgtctctactaatggttgctggcactgggtctctcctacagaggctactgcgcatgatagcctgatacctcctgctgggcaatggcctaccttctctcagggactgagaactactacaaagcagttttccctggcatctggcttagaactttgaaaccctcttgagggtttagttggtgccttaagtttgctgagccacatttgggttacagatcagctaagactggcagcaccattgtaatgctaggaacatcactgtcacacacttggctgttgggtctatttgcagtatgataataacacccctattttttttaaatggaaagcacataccagtgctaatcctttgaccttcaacacacacctggatagggcagtttgctcactgcagagaacagtccccagaaaggaactctagaccttcctggataatggtcaggattgaagtagggagggagctacaggtgacacatagacctactctgaaactcaggcttctgttctggtacccagggcttccagtctaattctggttccttctatggaaattctttgccttattttcaggccctgatggcctggaactgggtgagaaaaggaaatggtctgaatgaaagatgagtgaagtggaaatttgtgatttctttggagactcagttgtgtgatgtcatgtttttctggaagctctcttctgagaggatgttttgttgaagcagacatgtgagaggacgctttgcagagaatagacatatggtgtctttctggacgctgtcttgtgaagaaggggcatgtgatgttttgctggagcagatccttgagaggtcacatgatatttggaaagaatttaagtataacccaacagacagtggataacgctcttgcattggttagccttgctttccttgtcaatcttcacttgtcacaaagtgatttcatagagaaaaatgcaccaaagaacttctcatgatattctggtggcttctgaccccttctgcagcctcctgcagattgaccagcagagactcgtggtttcttctggatcgagcctctgctgccgatccatgtttggtgttctgctagtg

SEQ ID NO: 224 - DNA, 1000 bp, mus musculus
ccaactgcttcaagttcccacctagacttttctgcaatgatggcaggttctgcaaatcactgggggtgctcttctatgttccatgccttcatggaacacggatactctcccagcccccagtagcagagagcacctcactgctttgcaagttccagtccttccggttggtttctcttagtcagcactataactgccactgtgtgctcccaccaccaccaccacctcttcctcatagtcacccagaagaaatcctatcttcctgctccctctgtgttccacacccataggtaccaccttaaataagtattgctttcacaaggaaatcccccccaactcccaaccctcctcctcccctcctccccccttctcacccctcccactccacccccacccccacccgccccagtccaggggcaggagcatagataggtctctggacttggcttgccccagggacttctcttcaaggctctttcagacttttggtcaattgtctgtgtgccttctgtttactttgtgggtggcactggaggtcagaagtggatcagtcttgttttctgttttgtgtctggctaccttgtgcctctgtttatacctaaacaactaacaaatcaggacagtggccaggacactatgaatgcccataccagggcctatgctgccctctgctggacggtccttgtactgcgcattgcgtggattgtttatctgggaccttatgcagaggcttgattggtcagggtaaatccatgcccttgcccatcatgctgtcatttgattgtcatgatggaactcaagaaaaaggtaaaagactcagaggagctaaaatccacttaggtgcttctgaatgcttttttttttcctttacaatgaaaaagcgaatattcccagatgcctctttagtctttttttatgaaacacttaaggaagcaggagcccagatccatgctgactgttgtcctcttctttcaccccagaggaatctcctcttgctctggga

SEQ ID NO: 225 - DNA, 1000 bp, mus musculus
tggggccatttgttcacatcttactgatccaagaaagcagagacacaggaagtggggtcagcctatgaacctcaaggctcatcccccagtgactcacttcctccagctaggttctacctcccaaaggttccataacatcccaaaacaccacaatcaactggagatccagtgttcaaagcctttggcatgagcctctggcatacattttacaaccaaataatagcatgctgtcatggcttccataggtatatagtcatctgataatgcaaatgcatccagcccaagttttaaaatccccagtgtcctaacagtttaaacattacccaaatagtccaaagtctcttctgagactaaagtcaatctcttatgttaatccctattaaatcaaaaggggtatccacttctttccagcatacaatggcacagaacacacagttccattactaaaggaaggaataagcacaatcaggaaatatcaaaccaaattaagactgaaatctaacagggcaaatgcaaaaacaccctgtgggtccacgttccgcatttgggactgatgacctcatctgtgctcccgtacataggcttgattagccctggccctccagctctgttgactgaagccattgtagttcctcatctgggccatttccacccagtgactgcagcttgccttggcaaacttcctggatttctgatctccattgtaatataggcttcacctttacagcttcatgcacagcagactcggatatcccatgaagagaatatggcctggtgttagtgtgtaaaggaatgtgttaggggtttctttttttttaaataatttttattaggtattttcctcatttacatttccgatgctatcccaaatgtcccccataccctcccccccccacacacactcccctacccacacactcccaatttttggccctggcattcccctgcatataaagtttgcaagtccaatgggctgctctttccattgatggccaactag

SEQ ID NO: 226 - DNA, 1400 bp, mus musculus
acatggaatgcagaagcagaaggatcaggagttcaagttcagccttggctatatagggagtccaaggctagcctgggctaaagtgagacatatcttagaagtaagattaatgctggtgatgataaaacaaatttaagcaactgtcatttgactgtttgaatgaataatcagatcttatactcactcaaatcttctctttcagcagagaacacagaacttgcatcgttccccagctgaccctagtgtaagtactgactcctagctacaatccctgaaaggccccgtctcattggtgctttgcctgtgacttggttgcctctcccttaaagagactcaactctcaatttaggtatgctgtatgagtgaagtgccatcattaccagacctgtcccacaaccaaggcaggaggagccacactgggtgtttgggtcagaaacatcctactacatggccagcatgggttctcatatcctcatttaccctagaggtgggagatagagttctagatcactggggtccctggtacaaaacctgacatggcagtgggcctggctggctttggatgaagggtaagaacaaatacaggaggagacaacatttgcaaagggcagtgtatggaatgaaaacatcctagcttgtatccagtgtgcaggaagaactcaggaggccgggcctcctgtgcaagttctagttctgggcctctccttgtcctgcagaaagttgcctacagactgagtgggttttcacagaaaccctggggccagtctgaagagagccatgggggtccactgctgatcggaagcaaaaccatcacactgagcaaatcactgttttttctatgtccgcttggctggtgtttggttataggcaaaccatcctaacacctaaggtcctgtccattctctgcttgccagtatccttggactttgtggatcttgctagaacaaagaaacattttaaataagcttaaaagttagtgttcagaagacaaagagctgggtgcatttgggaagtgagaggtttgatgcaggataggtttgtcgtgtatggagcatgttataaatggtagagacaaagagaagatcagggtacagtaggaacatggcccagagtttagcaggatgagtttgagctgtatccagggagccctagaagagacatggctgggcattaaaacacaagaagctgaggagagaagagacaccatgaagctgaggacacaggtggaaactgcagcaggagagtgactccgatcatctggacagactgtagataaggatggaaaactgaggaattccatcctttgcatgtggaggaggagaaggaccagcgaagtaaagtggtccagcagtcaggtgatacagcaaaccaccaagactgatgcagaaggaccgacttct

SEQ ID NO: 227 - DNA, 1200 bp, mus musculus
tttttagaactttgactcaaggttttgctaagttactcacaccactgtggaactcattgtataggttaggctgaccttgaacttgtgagcctctgagtgactgaggttacaggcctagaccaccaggaccatttcataataaaatgtggtttataagctttcaaacttgtggaaatatagaaaggataagacccctcagctgcccccatatacttagcccactccttgggctcaatcttccttatattatttatttttaattttaaggcatggtctcttggtcttttttattatgttgtccaggctgaccggaaacttgctatgtaaacctgcctggacttggacttacaatagagatccatctgcctctgcctcccaagtacagggattaaaggtgtacaataccatacctgggtctttcttattgtctacaaaatatttattgggcgcgtgcgtgtgggtaagagcactgactgttcttccaaatgtcctgagttcaaatcccagcaaccacactgtggctcacaatcacccataatgagatctgacaccctcttctggagcgtctgaagacagctacagtatacctatttataataataaataaacctttgggccagatcgagcagggactgagcagggttgactggagtgagtggggccaaccgtagcgagcagaagtcctaaattcaattcccaacaaccacatgaagactcacagccacctgtacagctacagtgtgctcacatacattaaaaaaaatacataagtctttaaaaagaacatatttatttttattcttttgtgttcacctattctgcctgcatctctgtgtgcatagcacttatgtgtctggtgcccatggaggccagaaaggaacactgaatcatcacatggaactggagttacagatgttcgtgagctcttgcgttggtgctgggaactgaacttgggtcctctgccagagtagcaagcactctcaccccaccgagccatctcttcagcccctctacacatctaaaacaattaaatatattgtttatctacttatgagctgtgtgtgtatctttgtattgtgtgggcatatttgtatgagtcaggtgctgtgcatatggagaagtaagagaccaaatgtggctagttggtttcttcttcagtttcagatgatgatctgagtcacagggatggaactcagacta

SEQ ID NO: 228 - DNA, 1000 bp, mus musculus
ggaaggatttattctgactcacagttcaaaggtaatcaaggcagaaaaggaagagtggaagacaccaaccccagctatggtggtaggaatatggggccatttgttcacatcttactgatccaagaaagcagagacacaggaagtggggtcagcctatgaacctcaaggctcatcccccagtgactcacttcctccagctaggttctacctcccaaaggttccataacatcccaaaacaccacaatcaactggagatccagtgttcaaagcctttggcatgagctgttggcagacattttacaaccaaataatagcatgcggtcatggcttccataggtatatggtcatctgataatgcaaatgcatccagcccaagttttaaaatttccagtgtcctaacagtttaaacattacccaaatagtccaaagtctcttctgagactaaagtcaatctcttatgttaatccctattaaatcaaaaggggtatccacatctttccagcatacaatggcacagaacaaacagttccattactaaaggaaggaataagcacagtcaggaaatatcaaaccaaattaagactgaaatctaacagggcaaatgcaaaaacaccctgtggctccacgttccgcatttgggactgatgacctcatctgtgctcccgtacataggcttgattagccctggccctccagcactgttgactgaagccattgtagttcctctcctgggccatttccacccagtgactacagcttgccttggcaaacttcctggatttctgatctccattgtaatataggcttcacctttacagcttcatgcacagcagactcggatatcccatgaagagaatatggcctggtgttagtgtgtaaaggaatgtgttaggggtttctttttttttttttaataatttttattaggtattttcctcatttatatttccaatgctatcccaaaagtcccccataccctcccccccacacacactcccct

SEQ ID NO: 229 - DNA, 1000 bp, mus musculus
ggaggagccacactgggtgtttgggtcagaaacatcctactacatggccagcatgggttctcatatcctcatttaccctagtggtgggagatagagttctagatcactggggtccctggtacaaaacctgacatggcagtgggcctggctggctttggatgaagggtaagagcaaatacaggaggagacagcatttgcaaagggcagtgtatggaatgaaaacatcctagcatgtatccagtgtgcaggaagaactcaggaggccgggcctcctgtgcaagttctaggtctgggcctctccttgtcctgcagaaagttgcctacagagtgagcgggttttcacagaaaccctggggccagtctgaagagagccatgggggttcactgctgatcggaagcaaaaccatcacactgagcaaatcactgtttttttctatgtccgcttggctggtgtttgggcataggcaaaccatcctaacacctaaggtcctgtccattctctgcttgccagtatccttggactttgtggatcttgctagaacaaagaaacgttttaaataagcttaaaagttagtgttcagaagacaaagagctgggtgcatttgggaagtgagaggtttgaagcaggataggtttgtcgtgtatggagcatgttataaatggtagagacaaagaaaagatcagggtacagtaggaacatggcccagagtttaccagtatgagtttgagctgcatccagggggccatagaagagacatggctgggcattaaaacacaagaagctgaggagagatgagacaccatgaagctgaggacacaggtggaaactgcagcatgagagtgactccgatcatctggacagactgtagataaggatggaaaactgaggaattccatcctttgcatgtggaggaggagaaggaccagggaaggaaagtagtccagcagtcaggtgatacagcaaaccaccaagactgatgtagaaggaccgacttctcct

SEQ ID NO: 230 - DNA, 1200 bp, mus musculus
cttgaccttgaactcacagagctgcctgcttctgcctcccaagtgcaggaattaaatgcatgtgccacccagcttagctttctactccttgatccatggaaatataaagaagctggatgcttcatgctccctactatgtcctggccacagacgggaactgattctaacactatacagtatgattaccccaccataaaggactgtatcctctttgaccacgagccacttctatctcagcaaccagaaatgcaaccaagaaattggctgtgttcagtgggcagagttatgaggtaagtgctaccatggaggatcccccttccaaagtgaaggcacagactgtatagattccaccaaggtccagcttcatagccaggcaacatggattatttagctcctactatgtgtcaagtgttctgtgaagttttgaacttccagggtctctgcctgtaaaaacttttgagttggaagatcctttcaaagaaccagaatataatcatttgagatgttgtgaagcttacggtaggttgaaaccccctaaatctattgttgttgcctctaaggcaaccacagacagcgtgggtagttgtggccatgtaccaatatggctttatgggcaatggcttagagcagagttggaaacacacaaacaagacctcaggataccggtcaggcccctgctgaagctcagtaggtggccttgtggtattttatatgtccccagcttccctgatctgtggtagctggccgatccaacaattgacattagtggataaaccagcagagacaacggcagctgaccagaacagtgtctgaagggctggaagggtctgacgcaccatgaggttttctggagccttctagccttttcaatccctagtccactttccaggtcccatgaggcccagcccagggaggtttggctatggccccagacagccttaccttggaacagggtgtcctgttttctctcttcccatatatagttggtcttctatatttatagttgccatatctgaggagccaatcaataggactgaaaatatctggggaaatgcatttgtaaagaacacctgcagaagtttttcttgccattgttcccaaccgggcacaagctgtttatttaacatttatatggtatcatgtcatcttaagtaacataaagatgatttaaagtatatggggggtgcactcagcagataa

SEQ ID NO: 231 - DNA, 1000 bp, mus musculus
ccaccctaggccctgccttggtcccttcgctggaacccacatcacctgatgctttgacagccacgtttgcaccaggttctgatcatccagcctggttccagactggttactgtcacttgggtactcagggtctggagtccccttgggaaacatgaactttcggcctccaccgaggatcacctttggtcagaggatcaacacaggtagacttagggctttatgagttccctacccttcctgaaagacagcccctatctatgtccccaccatgtctgtgggttatgcatctcctggatgttccacacccaccccttacatatgtaaactgcaggggacttggagttcaggctgtttatgcctggaactatggccagtccaaggttcaccctttgtccaaccctccagctggttcttggagctcacatcaatgtccatgttggagatgagttgagtggcgatgtccttgcagccgtcctgcagtgcagaggcaggcatctctgcatctgagtaccaattacggttcaccgtgtgtgcgtaggtgccggctggagaggcatgctgcaccctggtcgtggtcaccactcccacagacttccctgcagatgatagaagatcatccagtgaccctgccctgccatagcacccagaccagcaccaacctacctgctttcttggcacggtacatcactgagaagacctcattgccaaatgtggtgttgcactggtctaatcgagcagctgcactcaggccgatggtcttgtagttggccttgaccccacagagataggcggttgctgtgcctgcgctgtctgggacctgtctgtccacgttgtatgtctggggacagagacactctcagctctggtactggtagacattagtccctgcttcctgagacatgtctacactgtcctggttgcaaacttgggctccagttcttctgggttcttccatctcttgtcctctccagcccctttcccgtcctagtgtgttccagtg

SEQ ID NO: 232 - DNA, 1000 bp, mus musculus
tcaggatcacccaggcagtaacagtgccagacacacacaggcaggtgctgttggcccacagctcacagaaggtaaacctggatagagtgcatgatgactgccttccaccactggggagagtgcacaggggggcaagctggaccacccatgcctctgggtagggtgggtaccagctgacccagatcttgcagactcaccttgatcttgaactccatcttcttctgaatgctgatcatctgttctgtgcggctcatcttccggacaccctcattgcatgcctttaccacctggcacagggaggacttgtcaggccagcctgccagcatgtccccaaataccaccgagcagctgacactgactgactagcctcaggttggcaggaactctttctctacgacactctgggactaagtgaggatgctttgtgcagtctagcagtggttctcaacctgtgggctgcaacccctttgggattgaacaaccttatcataggggttgcatctgcagcagatacctacattacaattcacaacagtaacaaaattacagttatgaaataacaatgataataattttatggtttggggattgccacaacatgaggaactatattaaagggtcgcggtgcagcataggaaggctgagaaccatgggtctagaggatgatttatctccttgtccttgactagaaagccaacctcccagaccaagaaaagggatctttcttctcagtttgactaggaaaggaatggctcccccagattgacttctcatgccctgggggtgcacaggctcccactaccctggaaggcagccaggaaccaacatgccattaacactacatttccccagacccctgggcctccactccaggatcagggccataaatggctcatggtgtctaggacagagcctggcctgatacaagtgctttgtcagtgttaagtagtgcagggcagaaagaagcatatgaggatgttcctttcagtgtagcttagaa

SEQ ID NO: 233 - DNA, 1000 bp, mus musculus; identical to SEQ ID NO: 232

SEQ ID NO: 234 - DNA, 1000 bp, mus musculus
attggccatgtttttcagtgtgaaatggccaccagacaaatgctgaaaagggagacatataaagagggggtgtggaaggtgtgtgtgaaatagatgtcccacttagggctgagcgttctacagcctctcattctctgtactttgcacagctgtagttctctgcattaatctccatctactgcaaacagaaggttctctgatgctggctgagcagtgcactaatctatggttatagcagtaagtcactgagagtcagtctaattctatgcccacttagcagagtgacagtcataggttctcccctagggcctgagtgtctcgccacaggttccattaacaattctgggtgcgagttttatcttttggagtgggccttaaatccaatcaggaagtgattggttacctccatgacattcatgcctcttattgcaccagtgggcatgtcttgcctggccagctgctattgtagctcacgggatccacagcggggtaagactgaggattgcttttctactctggcaatgcatagcactttcctgcactgtgaacgctagtcagtagagatgaggtttccaggtcagtattcgcttgatttccccatgttctgtgactcttgtgggtggtatctttagcaataggctcttcttgtcaaggataataccttggtgggagttggtcaacaactccccaaaaggtaacccataactggccctggactttttcttattagtctgtgttgtcttggatagcctttgctgcccacttgttggttgggatgatgtgggaggagctggtagaagcagtgaccagaatcaaaatgcattgtgtgaagttctccaaaaactaaaataaatgagaaagaataaagagcaggcagagagtggtggcagacagtagaggtggaaagagatggtagatcagagatggagagatggagagagatcaactgggagatggttgcatgccttctctttatctgaaacttaaggtttcttgttct

SEQ ID NO: 235 - DNA, 1000 bp, mus musculus
gaatgtaacagaaaggtattgtgatctgtgctggtcattatagactccagggcatacgcaatgcagattagaatggtgacagtagagacgtgacagttttgtctgattccagggctttgacgtgtggctctgatagttggatgtaatagcctggcttccttatgtgtggcccgttggtctgtcccttttcttcctgcccacgtccagccttcagcactaatgagcaagacaaggacaactggaatggacagctgaagcttctgctggagtggaaccagttggaccttgccagtgatgagatcttcaccaatgatcgccgctgggaggtagcagaagcctcgggggttactcctgggttagcagggacaatggtctcagcaggagatggtctatatccaacaaggtcatcaatctagaatcttgttaatgactctgtcctggtatatcagtgttgtccagcctcatttcccttggttgtaagacgggataacaatgctgacttagtaggtttcttgcaaacaaatagcatagccaatggctgtagtggaggctatccttaatgtacggccctgtctgatgtggagctatgggtgtgctctcaggaggggttgcgtgaagggatggggactattgtggaattgtcagtctagcttgactaaaaagatcaagacagccacattcttttgccacctccccacctagcaaaattctggtaacagatttgtcagggatgagatgtatgagggagagtggaacaactttgctgaagacactcaccagtgtctttgagtgaggttctcgggatgccctgggtcaaaagagcacttccaatatggaagttgcatgtgcatttaaaaactatacatttccatcagaccacttttctagatttttccatttgatgaacattttaggagcccactgatggggttccatgcatctaaagttcagtcagccttggaaactctgttcaggaggaacaattgaaccatcaaacaga

SEQ ID NO: 236 - DNA, 1000 bp, mus musculus
tgtgagtcaccataaataatgacaggccaatataattatagggttgtcttttaaaaaaaaaatgtttgtgtcatttgtgacatggaaaaatggatgtcaacttttaaaacatgaactttccttttattaaaacttcctaatgttaagcatatttcatttcggcaattaagaactcgtgttttgtctctagacaaattgtgttagagactgaagccgacatcataattgatgatggccttgctttatcactgtaaattatatttatttgtttaatatttaatagtaacagatttgctgaactcaaagcttcacatagtcctaaaatgaaaaataggcaaatttctcccctcctcccctgctggcttcttgcttctgactcatttccccaaaaggatggctggtatcgatgccttaactactcctgagactgcttcagacacatctacagcttaaattgtgccccataacaaacatatccccctggcctaaccccttggtagcctggtgactagggcctcacttggaaagagtctgtctgccatgtaactaaagacctctggctaaggtcactaggacaggccctaaggacaggtgccctttaagaggagagagatggaaaaagataggagaacctgggaagagagctgtgtggagtctggccaaattctgagagacatgacaccgccaggaaccaggaagactctggtgtgcccagaagccgagcatgcaaatgtaggatttttgttagaacccgcagggagcagggacctgctagcaccttgatttaggtgcctggtctacagaatgtgaaaagcgaaattcaagttgctgttgtttgagtttgtggtggcggtgtcagtcactgtagggaactgcccagctcctaagaactctgcattcactctgtgtggtgtccttcttacaaggacctacctcgctgggcgtggtggcatactcctttaatcccagcacaggggaatttctgagttcgaggccagcc

SEQ ID NO: 237 - DNA, 1200 bp, mus musculus
atccagggtaaggctatggagcacgaccccagtgaacatctgcattgtgcttttgggaagatgcgattgaacctatctgagcatagacctggctgggggaggggtgaatgaagagggaaactatttaaagagaagtgaaccagacttgaacactctgtggagctctgtgctaacacaggtcagtgaggttgccctgtgagaacacagtgtgtcctctacgggctctgctcatcttccatttgtccagatgtagtgtgactccagagtctaaactcaatgttgcagtgttccaagggaggtcttccgagtccttccagcagggggagccccctgcccctcactctctctgaaggcttctgtgtctccatgcctgaatggaggagggaccctggggtcctctgactccttggggtaaattagattacagatttcctaagggtgtccgtgcctggtgcacagggcctaagtgtgatgaggcaaggcatttaagacaagaaatcagggcaagaatgacacaggagtcccctcctctgttccaaccggttacatggctgataagattcgtgggctaggacaatttacagcccatcccagaagcagcagtagccaggtcagcattgtcaccaccccaagcccagctctctcaagctggcatggcacataacatgcttaccctaaactcaggacagtcgtctgtagtggggggggcaagccagtcacccctacttttgccatagaaactgacattagttaccacaggtggtagaaagtcctccccttctctggggaatgcactgtccctgtcatcagtttgctctgcagacactcttgaaataaaacaaggtgttggtggtcacatccacgagattcaaggaaaaccaaggtctacagagagctgcctgcccacagtggctagtagggctcagaagtgtggtgaagccacaagagtgtcagggtacaggaggaaaagatggccttgttccagcagacttagccccaaagagtccagtggacacttgacctcagggagtagacacttcctttcaaggcccttgtctgtgactgcatcagaaccctcttctatcccatcaaagaggagacctaatatggcttccagtgtggggcttcagactcctccaaagatcccaactttatgtcatcttcccaggcataccaacaaaatgctatctgaaaaagtat

SEQ ID NO: 238 - DNA, 1400 bp, mus musculus
cctcttctcttgccgtttcttcctcccagtagctgacacagcctgcctgatgatgcctccttagccaccttgggtagcaactgaccagcagtccctagccaccgtggcccaggctctgcagtcctgctcctcagagaatcctgtggcctggccttcagttagagctcactgaatctgcagccgactgcagtgtgactgcgggtctgaatttgcggtttgctcacctgagctgctcatgggataagcttctagatttgtctccagcactggggccaggccttggattggttgttaggatattggagatccttgttagtgatgtgtgttctcagggaagtggcttgaaggggtgcaggagatcacagccacatatcagggcaagcttgctttgaggtccccaagcctgtgggtgggtgggtaatgggaagcccccagtagcatggacacttcagtgcagtgtggtcgaagtatggctctgtcttgttctagtagaacagccaggaaggggcctctgagtgtcatggaaatgactggatgatgtcttgcatctcaagcagtagtaggcacacaacaggcacaagtcccgatatgggaaaatgtttgcgtacccaagttagtgacttgtgaaattagaatctgccacaagtaattgctgaatccagagagaggttccccagagcgccattaccaggtgttggcatttgtcttctctggcgtgtgcatggcacttctcctgcatgaatgaacacattaactaactctccacagagcccacgaggtgggcctgagacctccctttcagagacaaggaatgtggcacctggagaggtgggtgacttggctaattctatccagatagttggagcagaattaattttaaagtaggtgtgcttgcctgtggcaccaaggtacagcctctgactgtactcaggagagagagagaggaaggagaggggtgtggccctgggaaccatggaaactctgggagaaggaaaatacagagaaagagatagacatacatacaagaagaggggagaaggatgagaaagagggaaagcacagggagggggaaggagggagaggatgaggacgaagagaagaaaagtgaagggggaggaagagacaggcgaagagggacacatggaagaaacaggcttcaggtgtgccctcggaaagaaagacctcagaagccgaggaagaaaatattctagaaaagtcaagtttgcctgattttccagggttaccacctgagtcctggtcctcactggacttgatggttgagacatcagtggtatcaacaacaggagtagtagaaagagctctatgaattcaggcctcgggcatggctgccagatatttaaaaaaaaaaacaaaaacatttctttcctgaaaatgcgata

SEQ ID NO: 239 - DNA, 1000 bp, mus musculus
caggcagcaccgatgcccagcgcacaccacctcatgcaaaagagcgcaagaaacaagggaagagcgagcagcaggcagaggccttggattcaccgcagaagaagacgaagaacaagaagaagaagaacaagaagaagaaagctgcaactcccgcggaaacctgcagagatgccaatgaagagttgaactgtcaggacccagatgtgggtgacatggaggaggaagagcggctccaggtcactgacaagaaacaggcatcaggaagcccagagcagaaaatcagagcgggaagcagagaacctgtcgaagatcctcaaagtgggtcgagtggaaaacagaacaaagtggaagaggatggtcccacggaaggtcccacagacatcttggatcagaacagtccccagtgtgaagacagggagatctccccagtgggagagaaaggtccccaatgcgatacctctcagataggtagtgaagagggacatgtgacctcccaacacggtggtcaggcagttgagaaccacaacctagataacagtgacctgtcagggcagctggagggcttcaattcagaaagtggagggcaggcaagagaggaggttgggaatagcaagagtaaggaggactgcaccatgtcgtgaggaggcagagcaggagacttagcccagtaagctccgtccctcagccacccactatatcagaacctccatccttccgctccactgccctgctgaggtttattgaatgttccagtttctgtggatgctccatgtgtccatcaccaagtatcaactacttaagtcttagactgttacctgtagatttgtactgaaccactgatcgctgagccagtactgttttttactagcagttctagctgagaacattccattagcatcaggggacaccaggtgtgcattccagcctgaaggttaaaaggtagcgtttgcttcaggccaggacgaatgtggatgttcttgaccaaatgcatcagtatctg

SEQ ID NO: 240 - DNA, 1000 bp, mus musculus; identical to SEQ ID NO: 239

SEQ ID NO: 241 - DNA, 1000 bp, mus musculus; identical to SEQ ID NO: 239

SEQ ID NO: 242 - DNA, 1200 bp, mus musculus
tctctgtagttggtcaggaggccacagccggtgtctcctttcctttctcctgtctgctctgtgctccacattctgtgctaagaccccagcagaggcttctcagtagtggagaggtgtgggcccactggtggaatgttcgagactttccttcagtgactgtactcttgctcttggctttcacagctagggtggaagtacttggaagcatgtggtgcaccctacttttcagacatggctcctcacccagctggaggatctggctgcttccccagtgaggtcaggctggcacctatggctacacatctggacacgcagatgtatgaagatagagtctccagactttatattaattactctgagctgggaagcctgggtaccaaagcttaggtgggcctgggagtaaggtgctaggctattagagagccctcctcagctgtctcttcctcttttctccacaaggtcatggacactgaggagatgtgggcactaacctcctccagcccagctattgcttctggctatgccttatactccaccatccactggggaattgccaacttaggaaatctgttgtcctcaagggggacttagccctttgcctgtgggagaggacctcctcagatggcccttggggtcaggaaactgaactgtcttattctgcttgtgaggtgtgtgaggaggcccctggcaagcagaggggacttgcaaagaaggaaacaggacctagagagagatgggcctgaggtccgttatgcctccagaagacagtgctgcctgctgcattcccatcatggagagggtggacctgaggtagcttctgcagggttagcagtacatgaacttctcctgtgggcgcctttcaactgaactgtgtgcctgcatgctgcagtctatctgctttgcaaacacccacttccctttcagtttgcttcattgtgtacagatgcgcgcgcgcatgcgcgcgcgcgagcacacacacacacacacacacacacacacacacacacacacgaggatgagtcatgccttaagtgttctgaaagtcaaagaagagaaaatgaacagatgccttgcaggaggtccaggcccggtattgttttcatcaaaatgaagacaaaggaggaaacacagaaacctagggttttaagagaaaatcttcatggcaggtgactccatgaccttcctaatcctctggctccc

SEQ ID NO: 243 - DNA, 1000 bp, mus musculus
cctagtcaggaagagcagtgggtcaggagcttccagaattctccactggattctgacactgccagccctggtcagcacatcagctttggttctgctttctcctgggcacctgggtctgtggtttatttggaattaaagccctgtttgaagttgtttaacaaagacatgaatttctggggcacttcccaggtcagtcttagacgatctgcaggttatgtacagagtgacagccacatcatggcctcatactgctgggcggggtgagctttgggctgtctcctctgcccagtgtgatttatcaagggctacctcagtgggaaagcatatggagagaatcccaaggctgctacttgctttggagagaaagtattcttgtggggcatttggaaaatccaaagatatcagtgtgcatgggcacaggatggacccctgaaccctggagcaactgacaagctcctagggcttctggagttgtggtcctgggattccccattaggacctcgctagggaagagagaggtttcctctgtggggttgatgcgtttcatgacacaccgcctgctgcttttagcgtgccacccagcttccctctgggaggaaagggaagggagcagagctgctctatgcttgagacaccgtgcccactggtggtagggtacacactgctacttgagccttcctccatgttctttctcttctcagaaacccatctgggtcacaggaaattgtagatggtttggggccaaaaaggtaaaagtactacagctttttggtgcacaatagacatttagacagcaggtagctccaggcactcacaagtgaagagttcagacctccttggcactcatttccatacctgccacctaaccctggctttctgggccttcaagcttttgatgctctaggtctgctgtcttagaaaaacacctttcctccccctagatatgagcagagtatggcagtgtggggaggaccgttcaagagcctttgctaaaagccct

SEQ ID NO: 244 - DNA, 1200 bp, mus musculus
ccttcttttgtgtcctgtggacagaataagtgggtgggcaattgccctactcccaaacaggccagatctcaccagctctagggtgggtggcctgtggagacctgctttgttgcatctctatagcgtgtaattttaaaagatccctatttgcctggtgactcgcgaggctgccaccagtctctcactctcactcagcttcgctaatggccagttggccattttcccctggagctgtgattgctcccccatcccctcatgcctagctttgtcaaactgtcgccaacaactgccccaatggatagaaaacaccagttttattatcttaaaactagatagataactcaatggctgggtgaagaatttcttgccctaatcttatcaactagctccctcaatcttgccttgccttctgcccacagcagaagctataaactctacgagccccaagacctacatgtctacagcatcctactcactccaaagcctggtccaaattctgctttcttctttctttcttctgcctgggacctacaacttcaatctttttcccttcattcaacaattagcttctgcctcctttattgacacaatcaagaaccaattagagaaccaatacctctccctccacatctttgggaagagaaccatgtgatttcttggatggatcttactggacagtttgccctgtggcatgtattctctgagggctgcagcagagttgtctagccccagattagttaccacagtgacagagaatgccagaactcattcccaagggcctgagtggggtttgctgtcatatcaagcaggccttggattggtaactgtggtccacctggctaggccattccctcaggttttgtttgttttgagacaggttctctctacgtaattctgactgttctggaacttatgatgtagaccagatagacctttaactcacagagctcctccatgcctctgcctttacttctgccccctgagcaatgggattaaaggcaagtgccactacacccagcttaccttgttcttaaagacctgtctggttctaagaagatgtggagggctatgattgcctgcagagcctgacctttctgggtatgggacagttccctaattgaatgaatagaagcgactttcagtcatgtggtctacacactattctctatcacttggcttgtctcatgacctggcagtctg

SEQ ID NO: 245 - DNA, 1600 bp, mus musculus
tctaagcatgagagatatgaaaaacactttacctgaaaattaaaagaggtctaacctcagtgacatcattcattcaaatttattaagggaatcactacccttgatcaggaatgaattttaaaaatttgttaaaaagccactgaggctttttacccacccatcataactgacagaagtgctacttacagcagcgacaagaataaacagtacaagctggtcactgaatctaaatgtttgttaaatgtattaatgaaggacttgccacagacaccaaaacctaacaaaactttattttaaaaataaatagttgtcatttatctcttttgcacattgcaaaaataaaaagaagatgaattaacataaaacacacagagatcattattaaagttcagcatgaaataaaagggatcttcggaggtagtgaattgaaagcaattgtaatttatttgagcaaataacaaatttactaagagtttacaatgaaaagaacagttatggctagaaatcaaggagtgacatacagacaaaagcttgagatagttatgtttgcaaaaaagggaaagagaacaatagtttacatggaataattggacccaacatgaaaaacattactaattatgaaacagacaatctggtcattcaacacaatgaaaaggcacatttcttttttaaagttgatagaagatccaacttcttcacaaagccggctctcatacatcctttcctatgggctggagcagtgagtcttcctgaccctcccacttactcatgctccacagctgtccagatctagcctgtgaaccacatccagtgcccagtcaaagtctggctatagctgtcttgtttgtaaccaactctggaggcttccagccagaatcctccctacttacccctgcaaccaacagacctatcccatgccatccgacctcagaagaaaatcagaactactggcatgatcaaggcttaggccaggaaacatcctgtacagggaccagttcctctgtcaatatgacttcatttcactcaatctctagccccaaatctgacttcatttcactcaatctctagccccaaatctcttgtaaccatttaaataatctaatgtttagaccaaaaaagacacaggggggtataaacataagaacttgaaagctcagcaagatgactttattttcttgacttaatttatatacaaaatacctatttataagcttgattctacaactaaactgctagctctttagaaatctttttctttttttttttattttttattaggtatttagctcatttacatttccaatgctataccaaaagtcccccatacccacccacccccactcccctacccacccactccccctttttggccctggcgttcccctgtactggggcatatacagtttgcgtgtccaatgggcctctctttccagtgatggccgactaggccatcttttgatacatatgcagctagagtcaagagatccggggtactggttagttcataatgttgttccacctatagggttgcagatccctttagctccttgggtactttctctagctcctccattgggagccctgtgatccatccattagc

SEQ ID NO: 246 - DNA, 1000 bp, mus musculus
catcttagtatgcatggcttatactgccacctgagacccggtggatgtctttggcctatgctgccaaacctgtcagtatctggatccacggtctgactgcagtgtctgagacccatgtgagttttactgccaaaggtcttgcatgtccaggcatgtttggatctgtggtcctattacaactgggggccatgttgagatccatgggctgtgttactatcaaaggccatgcagttgtctttggtctgtgctgctggctgcagtcatatttatgtccacgggtcatgatgtgaatctatgggggccatgtagatgtgaatggcctatactgccacctgaggtcatgttgatgtctttggtgcatgtttccacaggggacacagagattctgctgtagccaggggccatgttgatgtgcttggtctgtgttaccaccaaagggcagacagatatctgtggtctgtgctgacacttgaaaccatgttgatgtcagtaggcctggtatccaccaggaaccgcattgggggttcatggcttctcttatctcagaggtaatgttgatgtctgtggcctatgcagcagcagagggctatgatgatgtctgtggtttgtactgatatggaagaccatgctggggcccatacttgtatccatggtgtggagtgcaacagattaaggtctgtggcctgtgttatcactgaaggccatatagatgctcgtggtggtctgtgctatggcttgaagccatcatgatgcccatgagcccttactgaggctatgttggtatctgtggccatactgtcagaggagatcactctgaggtctgtagcaagtgctgactctagagtccaggtggacatccttggtccatgctatttccagatactatgtagagatttatgaagcatatcccagttgagtgaaaaggacaaggaagcttcctttgcagtgggtatcaatgactgcatgctcacagttatgaaagagagaaatagaaggctcg

SEQ ID NO: 247 - DNA, 1000 bp, mus musculus
gtagttatgggaagggccttgttagtattctcagagtgggtttgcattttagaaacacaatatgaacatcccttccccccaaacacatacatgatataatgaagtttatcatgatggaaatccgcaaacacatgtttgtgagtggatcaagctgtccctgctgacctgtgaagtgaactgccaatttccagacaacacagacaggagttattccacaaaaactttctaaacaggcctgcttcccccatatcctatctattttgctacctttgatgggaggtggggtacaaggaaggtgaaaacatttaagaaccatcattaaaaataggatttaaaaaaattaaggttacaatcatgcactggtcattttctgcccacccacatagggtgtagaatcccctctgtgcatctctggttcctggtttgttaggtaccgatcctgactatgtgactgttggtactcacatggctggcttggctatcctccaacctagccagtatcgcaagttttgtcaactgtactaagctgtcttcacatctgcaagagtcagctacagttgtttgtagttaacttccaatgttcaagacctcagtgtttgtggtcttgactctgaactaggtaaaggctttcttaaaagctatctgtcaaactcagctgcactatgagaaaatatctgtaaaaggttaacagcatgcacatcacacattggaggagggtatgaaaggacaacttaaaggaagctagctagttgtctgaccaatactgcccttgcctcttgggaactgcctctggcaagcctgtttggatatgtcatacataacagtaagttctgattcatatctctaatgctcctagtctcaccactccagccttgccatgtcctttgaactttaagatctatccccaacttcacgtgtgtgagcagtttgcagttgtcaccataggccttcgccaaagcccttcgccctttattacttcagaaatttaattcttgactta

SEQ ID NO: 248 - DNA, 1000 bp, mus musculus
aagggaatgtggactgagtgggggagcagtggtgggtagaggggaacatgaggtgggtagagggaaaaggactgaagtcctgagggacagcaaaagaatgtaaaccaggcaacctcaggaaataggaggttagcaggaccccccagaatgcaccagagatctgggagatgagagactcccaggattcatagggagggacctttgatgaaatgccccacagtagggagagggaacttatagagcccacctccagcaggaagacaggacatcaagtgagggatggggttaccatgccacaatcacatctctaacccataattgtttctgtctaaaagaactgcagggatggaaatggagaggaacctgaggaaaagaaggtccagtggcagtcccaaagtgggatccaactcaaggggaggtcccaaggcctgacactattactgaggctctggaaggctcacaaaaaggaatctatcatgactgccctctgaaagacccaacaagcagctgagtctgatgtagttatttgcacccaaccaatggacagaagcactgacccctgttgttgaattagggaaggctgaaagaagctgaggagaagggtgatcctgtaggaggtcccaattaatatggacccctgacatctctcaaacactggactaccaaccaggcagcatacaccagctgatatgagacccccaacacatatacagtagatgactgcagggtctgtgttcattcaaagatggtgcacctaactgtcaagaggttggaggccctaggagtttagaggtcaggtgggatgggggtgggggcatccatgtggagatggagttgggtagggagaaagtgtgagatgtggagcagtcagagggtggatggggaggggtggggaatgtaatatggagtgtaaacaaataaaatttggaaaaaaagaaaagaaaagaaaagaaaagaaaagaaaagaaaagaaaagaaaagaaaagcctctcatgactta

SEQ ID NO: 249 - DNA, 1000 bp, mus musculus
caccaccatccatgccttttctacttctttcctgatctagcaacagccacagaataagttacccagcctccctggtaccttgcatgcatgtcagctaaactctaagcttctgctgagaccctgtctcaacaaacaaacaaacaaacaaaaagtggatattagctgtaaagtacaggatatccatgctatgctccacagacccaaagaaggtaaacaagaaggaagccacaatcacgaatgcttgaatctcacttagaagggataataaagagtcagaagaggcaggtggagagagagagagctgagtgggagaaagatggggtagagcatgggggcacaggagcaggtgtggagagggacaggggagagagccagattaccatttaaatgaatggaaatctgtaactgatagagatggggaggtaaggacgggggcatctccaggatgccacagggaggtgcccaagaatcaatgggggtgaccttagctgtgactcacagcctaggggatatggaacatgaagagaccacctcctgtagccaagcaggaactccagtggagtggtagcaacaccaccaaagacagaggaaatacccaagtaatagcaggtccagctagagacccaactcatgggcaagaacaagtcccaggcgctacaaatggtactctgttatgctcgcagacaggagcctagcatgattgtcctctgagaggctccacccagcagctgacacagagggatgcagacacccacagcgaaacagtggatgaagcttggaagagttgggtgaaggcctgagggctgaaggggtaagaactccacaggaagaacaagagcatcaactttcctggacctttgggattacagagaatgaaccaccaactagggagtgtgcacaggctggaccagggcctccatacacctgcaacttgatcttcatgtggctcccgagcaagcggaggttatcctaaaagctgtttcctatccatgggatatgt

SEQ ID NO: 250 - DNA, 1000 bp, mus musculus
cttaaaatccatgttccattgtggtaacatttcatgaagtttttataattaaaaaaataagtcataaatcatggcactttccaaatacattgggaatatcaatagttgattacagcaagagaagaaatctcaaaaattgtcttttgatatcacttgatgacattttttgcctttttgttcctaggagatagtggcctgttcagttcagattttcaaaagctttcctctgatagtcatgaagatgtcagacaccgaggtgggcaagcaaggctagagggataaaggtaactcaagataaattggaatgtggctctggccgtacacattctgcccttccaaaatcattaaagttcttgtcagtgaatcagcctcgtgatttcaggtgaaattgtttgttttaggaactttgtctatagttacgcgcatttctccattatagtcgcaacaaattttaccttaaatatgttgctcactccattcttatcttctttcttatgagttacctttttttattaattgtgtacaagtgtgattgctgaacatctcaataaagcaatgtttagttttccaaaagcagcactctcagaaacctagcatggctttcctctgagaggctcaactagcagctgactgagacagatgcagatactcatacccaaccattggactgaggtcagggccacctatgaaaaagataagggaaggattaaggaactgaaggggatggcaaccccataggaagaccaacagtgtcaactgatcttgatccctggaagcagagtcttagccacaaactgaagatcatacagatcatacatggggtggtccaagggccctgtcacacacaaagcagaagtctgccttgtctggcctcagtaggagaggatgtgcctaattttgaagagacttgatgccactgggaaggaggatccctgggggtacaacctctaagaagcaataaggagggagcatgggataaagaactcaagaagggaggaaa

SEQ ID NO: 251 - DNA, 1000 bp, mus musculus
ctgtgggggtggagtctagccagaataccaggagcttgggacattgtctatgtgactgatagtcacaggactatggagttgaggacttataatgtcatatgcctgtgtctggaagcatagtttactgttccatcccttgaggaattttccactgggtctctggagtaagtttcactcaaccagaacacagactgtctttcatggtccaacaagtgcctatatgtgacaggagtgcgttttcatgtagtcctaatagaagttgtttaatgctctgacctttaatgtctgtcctgtcacctggcactgtgactcaaactagcttgaatagttttgatttagatttaggtcatttaggaaactcaagctatgcttggactaggaactcattataggacaacagataggtgaagctgtaaagtgtgaaaccttcaatagtacttagtgaaactgtgataatattgctgtaaactagctcactgttggtcagcaagacaagtaatgaaagggcttattaaagatcttgaggacacagtttctgtggacatgcacaagcagatgctgctgggtgaatgtcatgggtccataggcaatgctgggtgaagatacaagacaatgaataaaatttaccctgtttttaaaaatgctctgccagaacctgacaaatacagaggtttgccaagcattggactaaacatggggtcgcaaatggaggagttagagatatgattaaatgagctgatggggttttcagcctcgtaggaggaacaacaatatgaaccaaccagaactcccagggactaaactagcaaccaaggagtacactagagccacccatggctccagtcgcacatgtagccgaagatagccttgtcagacatcaatgggagaagagacccttggtcctgtgaagcctcaatgcctcagtgtaggggaatgccagcaaggggaagcaggagtaggtgagtgggtggggaacacccacatagaaggggaaggtgga

SEQ ID NO: 252 - DNA, 1200 bp, mus musculus
taagatatttactgtaattataatgcattcctttgtagatcagtgaatatttcatttctcatctgcaacatctttgccctttgttcaagaagactagcatctaactgaattgttcattccaatttgaaaaccagttgttcatttttcagaaaataattttacatgaatatatgttatgggacatacttgtgatgatatttttatattcactaagattttagatatttcagatatatgataatatatgtatgtggggcaaggggaccatgccaacagacagaagacctggtaaggttgaagcaggttcaaacaccccaggaatttttgtaattgagaaaaataggtgtgacctccttcagcctaggcaggctgtttcagaccatatgccactgaggcagggccacctgccatgctgcttctccactcaactagtttcctttgatgttacactggctgccacctgccaagaggccgaacaaatggttctccaagactttctggagttaactacgaactgtgaatgaaggggaagaggaggggagggggagtgaaggggaagaggaggggagaggagtggagatggggaggaggaggggtagaggggagtgggagaggaaaaggggaaaaggaaatggggaaggggaggaggagggggaaggggtagtgggaagaggggaagggggaaaggcaagtggggagaagggggagtggggagaaggggaggaagaaaagggaaggggggaggggagtggaaaagggggaaggggaagggggaaggggaaaaggaggagaagagagagtggatggggagaggggaaggggaagaggaaggggaaaggggagtgagagagagaacttgaagccatcttcagttgcaaaccttcaagaaggccatacatcttaatccttctataacatttctctcacaaatagaccaagtattcaaatatatgggccaatgaatgtctttctcattcaaactatcatatgtctacttctctttctttcagttcttaaagtctctgcccatttattgaattccgtgaaggccatatataataaagtttaatgaaatagaaagggatttggcacatatcatctagatttgaagttcttatccggtaaagccttcgacagtaaaatgtacctcaaaattgacaaattcctatgaacatttgagttgagaggggtcaaaataaa

SEQ ID NO: 253 - DNA, 1000 bp, mus musculus
atattagccaagtcaatcactaactcccaggtagaggttctggaaaactgtggccattcagtagtgatggagagaccgaggaagacagccaagctcattgtcgactttttagcttctgtgcataacacagacaacaagaagctgaactgaggctgttgctgcagcctgcattgtgcacacagcatctgctcccacccccaaaacctgtcacagtaaccactctcagggatcctgccccaaatgctgtctgggcaccaatagccctgaggaagtcagttgcctatcccagtacccttggttccacagagcatcaggggccacaagaaactctccaggatccttttttcaaaatagaaacctaaatggaacaaacaaacaaacaaacaaaaaaatatctagccatgaagcctaccagaagtcttcaagttcatgtcactgagaagccagtgctaagcagcccccctggaccatgagcaccacggacactttctttaaggcatttctcatacattaaacatcatctatttttgttgttgttgctgcttccgatgtatcctctgcatggtcagtggcttcttctacaggagctttagtcatttactgaaaactcttgtttagagctaattcaagttttgcatataggccatgtgtgaatgcagctgccaggtaaccgcaagactgggaagagacagagaactgtggaagaggtttctgcctcaaggcctgatacacaggaggctgaggcagaaggatccaaggtcaaggcctgccagacaggtacagagtgagttcaaggctggcctgagctactgactgaaatctgtagaaatctacatggggagtgggagtggggcatttcttcacctcagtcagccctaagaattgaccaagcagaagaacatacagactgatgagtttgggcacccacaggtcagatgcatctgaccaaccacagaagaacacctgactgggaaagttccctaggaatgacttacaactt

SEQ ID NO: 254 - DNA, 1000 bp, mus musculus
agaaaaatagtgttttaagaatgtaataaaaaaaagaatgtaataaattgtgaaatgttgtaaacagaacataattcagcagtcaagtttcttttttctttctttttctttttttgtttttttgttttttcgagacagggtttctctgtgtagccctggcagtcctggaactcactttgtagaccaggctagcctcgaactcagaaatatacctgcgtctgcctcccaagtgctgggattaaaggcatgagccaccacacccggctagcagtcaagtttcttatgtcatgacaagttttattgtacatctagtgatctcttgcttactagaaaattatgtaaagatgtatcaaattatgtttctagttgtatatgtaaattttcctgggatatgtttttgaagcatgttggaatgtctgctttatatacattatgtttctaagtattaataatgtatctcctagctgtcctgaatcatgtaaagatttttagttaagacaataccatcatacttgtttggtttcactgtagatttttatttcttgcatttgagttctccaaattggtttcattgatttcttatataatggagtatattttcaactcaataccttgtgttttttgccatacacacacacagacacacacacacacacacgtacataatgtacatactctgaggtatatgaaattctttcttagggggaaattatatatattctcttttaattaaatgtattttaaaacataattccatttgaatgttttgtattttaaaatgatagtctatgcattatgaataattttcaaatgaatttgtagagaaagcatctctatgacatttaacattcaagtatgtgagtgcttacaatacaatgcttaggcattcatttaaatgagtaggattttactttatctgtaaatgctttgttcaccttgaatatttgagcaacttatttgggcatcttattttttaattggcaaacaaattgatagaaat

SEQ ID NO: 255 - DNA, 1000 bp, mus musculus
gaaaagattcaacccagaatttaagttggtcaacaaatagcatgagctaacttaatgccaccttcccatccgctctctattggaggccagatgctgatacccacagtgtggagtgtaccctgccaggcaggtggctaaagaccttaaataacaagaaagaattatgttctctgacttttattccgctcatgcttggaaaataagccaagggtcatataccctctcttttcccaccatgtcaacctcaagactacctaatgattcgacttaccagagcaatcctgatcctccaacttaccttgagatagggataatatacagaacgagatcaggaaatagttaatgttgttgaaacgctgcaaagaagggaaaaccagaggccccaagccgaacggcccctccaaggaagcatcttgcattgtatctgataactgcgatgagtcttcagagacaggattttggagacttgcaatatgtaacatggcagctgaaagttttgtctgaaaatggacttctctaacgtcattcaacttctccaccggagcctccccagtgatgtccactggaggctccacagtattgtccaccggggcttgcacagtattgttcacccaggccttcacagtgctgttgagcgtttgttccggattctggtccatgtcttatctttttcagaagcaggtccctgcaggtgtgtttcaagatacctgtgtactccctggactcagatgactgatgctgtcgctgccactctaacctttgcagggaacgttacttctagtgaaggaagccaacgtcccttcagaagggttgagtgacgcggccgaagttccaaggctagattccatcttctctgcgtcacagagaagaaaagaagaggagagaggaggtgaatatattcaaacctgatgttgaacaatatgctcaaataactaataaaaatatttgtaaaaggaaaagggacaaataaacaaataagcaaaggacctcagaagcaacc

SEQ ID NO: 256 - DNA, 1000 bp, mus musculus
ccaaaactcacaggcagacactgttcagtaggattctggggcatctctgtataccccacatcgattcttccctctgtgtaggaagtcagagaactcctgtcaggcttcccaataacactgatggatcagggcctggtgtctcccctgcccagcagtccctctcccagtatgttacattgttccaactccagtccctagtatacctcccaagtcttgaattcacaaccctctaccctgtgggtttgcttttaagaacacagaatactcacactccctgatgcccctctgggtgagagcaacactggccccagagaatttagtgtttcctcacctaccaacgcaaacaaacatttttcagaacaggaatgacacggtacttgattttttaaaaagcaattaattaaccactacggagcatcgagaaagaattcctgaacacgagtgtagaactacctgctggagaatgtccaacttacccagcagacatcaactggcaagacctcctcagctggggagtggggaggtaggaactcctactttggccttgtctaggtcctgtggggcaaacacagccacggagttcatgagagcagaggcactaccatatctagtaagcactttcccggtagtattttctaacctttggcatttagacttcttcctccacttttccaagatggatattttccctgattttccattcgtttcccatgttaagttcccatgtaactatcacagataccatttccaaagacaaatgaaaaacctccaaaaccaagtgaagggcagaaacggttgtgtgctgagcagaccctctgggagtcagtgcccactgcccagcactgggcaccacactatgtgcttcacctgggcatctcattccatccctcctaacagcccagctctctagatttagctgctgaggtatgtattagtctaaggaacacagctaacaaggcacaaccaacttgcacggcctgaacttgacaaagcacacagt

SEQ ID NO: 257 - DNA, 1400 bp, mus musculus
tgactcctttattgacctcagctatgtggtctacatgttccagtatatttctactaatggcaaattcattggcatagtcaaggcttgagaatcggaagcttgtcatcattgggaagcccatcaccatcttccaggaccaagaccccaataacatcaaatgggatgatgctggggttgagtatggcctggagtctactggcatcttcaccactgtggagaagaagggtgtggccgaaagagtcatcatctctgccccttctgccgatgcccccatgtttgtgatgggtatgaaccaggagaagtctgacaactgctcaagatcctcagaaatgcatcctacaccaccagctacttagacaccctggccaaggtcatccatgagaactttagcatcatggaaggactcatgaccatggccatgtcatctctgccactcagaagactgtggatggtgcctctggaaagttgtggtgtgatggtcttggggctgcccagaacatccctgcatccactagtattctcaaggctgtgggcaaggtcatcccagagatgacctggaagctactggcatagccttctgtgtttcaaccagcaatgtatccattgtagatctgacatgctgcctggagatacctgccaagtatgatgacatcaagaaggcagtaaagcaggcatctgagggctcactaaagtgcatcttgggctacactgaggaccaggttgtttcctgtgatttcaacagtaactcccactcctccatttttgatgttaggtctgacattgctctcaatgacaattttgtaaagctcatttctggtatgacaatgaatatggctacagcaacagggtggtagacctcatggccaacattgcctagaaggagtaagaaaccctggaccacccacccaagcaaggacactgaaaggaagagagaagccttcagttgctgaggagtccctgtcctaactctgcctccaacactgagcatctccctcacagtttccatcccagacatccataataatcggaggggcctaggaagccctactgtccacattaataaagtctgctgcatcaaccccccctccaaaagaataaaacccaacttctcagtggtagctctgaaagctaggagggcctggatggatgttctacaaacttggagaatccacagatgccagagcagactactatgtcaagcaaaaactatcaacacaaccaacagtgaaagaaaaaattccataatcaaaccaaatttaaacaagttttatttaccaatccatctctatagaagacactagaagaaaaacatcagtctacataggttaaatgacataagaagacacaaggagcaaataacttcttgccaataaatggaaagtgggggatacacaccataa

SEQ ID NO: 258 - DNA, 1000 bp, mus musculus
tctttccatctttgtccttttaaacagatcatgagttctacctttttagcagtgttctgtatttctttaaatgagttattaatgccgttcttaaaatcctctaccagcatcataatatatgattttaaatctgaatcttgcttttcaggtgtgttggggtatccagggctcactgtggtgggtgtactgggttctggtgatgccgtgtggtcttggtttctgttagtaagattcttaagtttgccttcgacatctggaaatctcttgtgttagatgttttaactgtctctgagtggagcttgttcctcctgtgattctttttttaaaggtattttattcatttacatttccaatgctatcccaaaagtcccccataccctctcccccactcccctacccacccactcccactttttggccctggcgttcccctgtactgaaacatcagaagatggcctagttggccatcagtggaaagagaggcccattggtcttgcaaactttatatgcctcctgtgattctgttagcttctgtcagcactcctgggaatccaactctctccagattcccagtgctcagagctcactctgcgggcaagctctcctgttgcagagaaggtgcccagaggtctgggtctcagctctgcctcctggctgaggatgaaggcccaaagggaccctgttcaagaatctctgttacttctgtggcccacgtgctctcctgcttggactggtctctgagagacctgggatacaagattgcgctctcctctgagatctggagtcagatccctctctggaggcccactcttatcagtgatccttagatcctgggtgtgctagggctcctgaggcatggaaagtcttctggggactgtggaactgtctgctgagcttgggcccaaggtggctcggggatggcctggcctaaactttcttttatgcaggataacttatttccgaattttgtgcacatactgaaaacatagccttaggtctc

SEQ ID NO: 259 - DNA, 1000 bp, mus musculus
gatttctttactaggatttctatctctagagttttcttgctttgtgatttctttattgtttttacttccatttttaaatcctggataggattgttcaattctttcccctgttggatagtgttttccagtaactctttaagggattttttttgtttcctctttaagggcttctagctgtttacctgcatttttctgtatttctttaaggaatttatttatttcctattttaagtcttccattattatcatgagaagtgactttagatccatatcttgcttttctgttgtgatggtgtattcaggaattgctatggtgggagattttggttctgattttgccaagtaaacttggtttctgttgcttctgttcttaagcttgcctcctgccatctgattaccacaagtgcttactgcccttaatatagctgattagagcctgtcctacctataatcctggttgatttaagactcctcagagtcctgctttctctgtgatcctgtgattctgggctcctgtgcacctgagattctgggtgtgtcagagttcttggtagtcaagtttcctttgagaccctgagaccttgatgtgaccaagctcctgggatcctagtgtcctaagatcctgggcgtgtagtattttctctggagatcgtggggctgtctggtgtatttgaaaccaaggaataccagccctgatcagaaggaacccgagctgctggtcaggcagggttcccatgttcttgctcctgctgtcacaggcctgtcacaattgttttggaacagagatgttgtgttccactcaccaatgattctaagatcctggatgtgctaggtcacctgcagtatggagaaccctctgtgtaccataggactgtcagccgatttattgcccaaggtgacctggagctggtgccgacaggaagggcttccagtgtttagtaaagtggctatattaagaaaaataatttaatgcagtatatgtatccattgcatacacacc

SEQ ID NO: 260 - DNA, 1800 bp, mus musculus
taattctttatctctatttttggaacattatctgcagccagtgattcagccacctcaaacaagtgtctaagaaaataaatgctaaaaacagattcctaaggtgtagcaagggaaatgacaacacttcatatctatagccccatggccatagattgtaatttggccaccagtcacacattgcaccaaagtttaattaaatcaagctttgacatggttgaaataaaaacctaagaaaacatctgccaaacagaaatcatggtacgctcttatacaagaagaatgtttatagcaagtgtgacatctgagcagtcataaaaccagttttataatcttttatgaaattataaattgatgttattgttgtgaccaggagatatttcttgaattcttttgcactcaggtagagattcttccaactgtagagaagaaaagtagaagtttactcatatccaaataacctgacaattcacagaaattcatttttcttctttgaatttgttttcatttttgtggagaccatgttgacaaaagtgatttgactcttaatgagcactctttagaatctccagtgagtagaaagtattctggctagtaacctcaaatattcggaagtttttacaaagtttgttttcaatgtcaacttgccacaaatgaatcagttgtgtagggagccttacttagagacgtgctttgattgtcttttatgtgagaaggacctcaaaattgtgggcagtattaccttgttcagataaaaatagaatttctctgttcctatgttctgtggtctctaacttatcctgttgttgttgctgctgctgctgcttgcttttctgacagcatttccagctccctaccccctcacctctaccccttgcagttgcaggtggggatcagtaattctatagataagttcctgatttccagacccaaacctccgagggatccaggctagtgtatataggggttgtcagctctatacctctgccttggtgagggacagccattactgcattgtttctattgttcaggcacccagcatcagtcactaagtaattaccaagttctcacattcatctgctgtgatttagctgttgttttttactataaatctgactcaataagttcttgtttaactctgacacactttgccaataaactagatgtggaaagaggatatactggcattcaaattgccattgtgtgatatacaaatccagaaaaagcttctctctctctctctctctctctctctctatatatatatatatatatatatatatatatatatatatatatatatatatatatatgaatgtgtgtatgtatatatagttggttggttgtgtacatgtgtatgtggaagttcacactcaatatttttctcaattacttcttatcttattttttgaaacagaatctctttctgaacctaaattttccaatttggctaattaatcaggccaaagagccttatggatactcttgtctatgatactgcttcaacagatttgagcttagaaacattcaccatcatgggtagtttttttttttatatgtatatgggtgctgggaatgagatatagactaagtcatatcctcagccactgaccttcctatgttattaaagttatatcagtagttatttaaaatcaagagcaaataagagaatgggattgttaatgttatgttagactatatatccaatgaagaacaaggtagagatcagcccatgaacatgaacaaacaatggagactccagatctgctaagtcattagtatcttatcacatgactgggaagc

SEQ ID NO: 261 - DNA, 1000 bp, mus musculus
catgtcttatgataaaatgcccaacaaaggagatttgaggaaaaagaatttgttttggctgactattcaaggagtttcagtttatcaaggtggggaaaggtgataataagaacacggagtattaagtaacagctgtattaagattgaatttatatgctggtagctcagagtgcacagaaagtctcggtgggctataaagcctaaatgcccagctcctgtgacctacttttagcaagcttctactcagcaaacaagaacaagagctggtgaccaagtcctcagtctgccagggaaatttcacattcaagcacaacaaattgtttaggcatggaaagacgttgagggcacatcccagtctagctattttgagtttggaggatggggtcatgaacaaagtaacaaggtgcaagctagaagagtcaaggcaatattcttccagatatttgaggctcagattttggcacatacccagaaatgtctctatctaatgattctccattatgtcttctaagatcatattgatttggattctgaggcattgggaaaaaaatgcaccaataaattgctggatgattgctcacacaatataacatataatttgtaacccgaaaaataatctttaaaaggataatccattcttcccaataagttagcagtatttttttcttcttttcaaaattattttgtatttcatacatttataaacagaattttggtcattctcacaccccaaaaaccattctcatttccttgtctatcacattaaagtctccttccaaacaaggaccctccaaagctccttcaatcgggcctttctatgacccactgagtttaatgaaggctgtataattttgagttgggagatatttgctagaacaaggacaacttgtcagtggctactgaaagaaataacctctcctctgcacccttctctgcccatagtgtcttactgtggggttggcaggtaggagccatgataaaattacaataggtctagcct

SEQ ID NO: 262 - DNA, 1000 bp, mus musculus
agacacctgtagttcatgttataggattaattttgtaccttcattattttcaatacatagatcatgcactgtgattactctcttccccaagctcttttatttcctttcaattcctgccaagcctcatctcttccctaccttcctcttgtcaagattcatgatttgtgtgtgtgtgtgtgtgtgtgtgtgtgtgtgtgtgtgtgtgtgtggtgttttaaaaccagtaagtgtaatcaagggtatctgtgtgatcattgacttggaaatatcctttagagcaaggcaggattaagactggcaaacacgtcatggacacaccagccatcagttctatagagttgaaatagcaaacacaaatcagcagtggtggcactacttagcagagactgccaggcttcaccctcagcaggagggaccagaaggaaagtaaagagaagttctcagctgtgcctctcagtgaagtgaagatcagtgaagacatgaagccaacaagcatttagctattcaagcaagcctagctaatccaccatcactgtctgtcaggccctatttatattccctccaaacatcatgtatcctctatgggtcctgcctcagtacatgcatttttctcagctgacatcactctgctgatcagcttgggtccagggaagcaacaagaaactttgacacaccacctaaagtatttttgatgtgtttctctctttggaatcccaacaaatgaagctgaactacataaagtatgccagaccactgtggttagaaaagaatccttcatcatatgtcctttcatatgcttgccttatccaatattaacttgtgaactgaactgccaatttccagacaacacagttggagttgctccaaagaaacatctaaacagatacacttctcccctgacctttcttttccactgcctctgatgggtggtgggctaaaaggaaggttaaagaatttaagaaccatgattaaaaataggcttacaaaaataaatttatat

SEQ ID NO: 263 - DNA, 1000 bp, mus musculus
tttttaagatcttctacctatttatgtgtattctcctgtatttctttaacggaatcatttatgtccttcttaaaatcctctaccagcatcataagatgtgatttttaaatccaaatctttcttttccggtgtgttggtagatccaggacgtgctgtgatgggagaactgggttctgatgatgccaagtatccttggttactgttggtaagaatcttgtgtttgctttcaccagctggttatctctggtgctagatggccttgctgtctcttgctggagcttgtccctcctatgggtttgtaagcccatatcagcagtcctaggagaccagttttctcctggtagaacttgtgtacacagggctgtggaactgcccaagctccaggtgcagatggtgacaggaaggatcctgtcctagctgctctactgttcttgtgccccgtgtgctccttgctagtcctaccctggacagttattgtagagaaaatagctatctcacctttgaacctgggagtgaaagcattcctgggagaccagctctctcctggagggacctgtgcatagcgtgcttttgaacaaccccatctcttgggtgcagattgtgactggaagatcctgtcccagcagggtcactgttcctgcactctgagtgctcctggctggttttgatcccctgaattttttttcttactttcttcattgccagtgatataaaaaatatctactttatactttggaactgaaagttccaattctttgtaggagacaacaaaataatattgtgcaattttttcattctaaatgtgtcacttttgttattattatttattttctttttattaattcgggattgctttttacacttatgagtatagatgccaacctgggccagaagaagatatcagatcaagggaactggaatttcctccagtatgggcttcctgaagttgtgctgtgaactgaactcatgtgctctggaagagtagccagtgctcataact

SEQ ID NO: 264 - DNA, 1200 bp, mus musculus
cctgtttacctgtgttctcctctgttttttaagggagttatttatgtcattcttaaagtcctctatcaccatcatgagaagggattttagatccgaatcttgcttttccattgtgatgagctatccaggacttgctgttctgggagaactgggttctgataatggcaagtaaccttggtttctgttgcttatgttcttatgcttgcctcctacaatctgataattatctctagtgctatctgctctcacaacatctgactggatccttcccttcctgttgagtcagaactcctcagagttcacctgtttctatgatcatgtgattctggatcctgtgatccagagagctcctgggagttaaactgcctctgggatcctgagatcctcatgtgaccaagcccctgggatactgggatcctgtggtcctgggcacgttagagttcctgatgtgaatcttcctctgggtgttgtgggactggctatggttttaacatacaaggtctgctcagagcactggcccagacaggaaggaacctgtgctgctgatcaggcagatttcctgggtgtctgggttctgctggtcccagttacttcctgtgttggggcagatattgtgtccttctcacctctgatcctatgatcctgggcctgttagagctcctgggaatgtattttcctctaggtgttgtgggacaggctctgatccttatgtcctgggcgtgttagagtgcctgggagaagagttacttctgtgtgttgtgggattggctgcagaattagcgcccaaggtctgctcagggcacctttgatcctatgatcctgggcatgttagagctgctagattcggtttcttaagaaagagtattcttccaaatatagaattggtctaaaatattgaaaaaaaatggaagtccaatagcatggaccagaaacatatggcagtatctggctcattctgtcctccctagctttttttctgttcatatactgggggattatcatgtaaacaatcattctcttccagttatttctgatgatggtggggttccaatctttctctgtaacttttttaaatatgtcaatattttaaaaatattttatttttactttgatgtattgcatatgcatctgtgtatgggaaactctatccactggaagaaagttagagtttatgaggagcctggtgtgggtactggaatc

SEQ ID NO: 265 - DNA, 1000 bp, mus musculus
gatttcacttttactttgtgcctgcttcctggcaactttatattcgcctctgttttatccgtggtccttccctattcaattttactttgtgccttcttcctggcaactttatattcacctctattttatccaaggtccttcccaaaactcctggtgtcgtaagtttcagttaccatgaacttaccctgctggtaaacactgactgctgaaagttctgaactcattagtgggggagtaggttcttcatacgggcgaccacttgtcgaatccattctccaccagcaagaatgacacgatcaccagttcttctaacagcagtttatccagcaagcttcagtcttcatctctctccctcttcatctctctccccctcgaactcccggtctctcactcttatatactctcagaccccatccactcacggcaggtcacatcacctcaccaggcatggcttcagccaatcagggcagcaggagcatgtctccagtaaatatgaacttgtttacactgccagcatcatggtgcacctgcacagttctcatgatggttgtggcttattttcaggtgtatgaggaagtcaggtgcaagtcataagacttagcagcagtcccgggcaccatcttggaactgctgccacaccctctcctcacagtatcagagcaaaaggcatcacaatgggaacatctaagatttcttatctcaaaacatctgcctgcagatgtctggaagctcacttagagtggtggaaatctactgaagcttcatagcacacccatgtcactcaccttatccaataaggccataccttataatccaccccaaggtattttgccaactgagaccaagtatcaaaatatatgcaactaaaggtcctaaactaccactacaaccttttcttcaaatgtggtcaaggttttagaaaagttgcagaatacattttatcatgtgtttgtacttagacttgcaataattaagcatacttttgcatacaaggcatgat

SEQ ID NO: 266 - DNA, 1000 bp, mus musculus
aagatactatctccttgagagagcattgcagtcatccagcacagtgaccatggttgcatataaacagaggatgggagatcagtgaggttacagaagtggcttttatttggaaaattatggtcttgtattaactttagctattaaatattctgttattcagcaacaaacttgaaggggagggacatttaaaagcataagcatgagtctgtacttgggagctaatgaattgcttttgaaatacctcactgactggtttctaactgtggccgaaatctctgggctttcttctagcagaggccatcttctaggtgaaataaatgaagataagttgacttctattctttgtcccttccttatctagagaaaatgggtaaaggagacatgtgagtcctctgcttacattgaaattcatgtataactgagtctgaattcaaaaaatatgtttctgagtcaaacatttgtttttcttaaaacataaccaaacaacaacaaaaaaaaaaaaaacaaaaaacaaacaaacaaacaaaaaaaaaacaaaaacaaaaacaaaaaaacctttggtctctttgtatgtaaactcaccactccagtattttatctgtttttaaagtttcttgtcacagcagagagttctaaatttgagatgaagattagttctttgagagtcctgctaggctgctgcctgcccagcaaactgtgcacactcaatcgatagcagttgctaaagagacatccccaggcagcagactctgggttcagctttgcacttctttctttttcagatccctgtggtattaatggagcctttacatgtgatgtcaaattagcagaaatgtcataattgttttaatagtgacaagaataatgacacagaagaacatgatgtagtttgataaagatggagatgaagaaggtggtgatgaatgtgaaaatgatagtgatgtaggcagcgcagtgtttatccaggtcccttattcaattcctgaccatgtagcttcag

SEQ ID NO: 267 - DNA, 1000 bp, mus musculus
gccattgagataagaaaggcacaaaaggacaatctctggacaagctcagatgagtaatgggccacctactaatatggtttcagcttagccagatgtcctgtcaaccaagataaacaccctccctttagagttactgacacatagtgctccctgatgtttaaactgcccacttgtgtgtaactgtgccaatttcccctatccccccactcctttcctatataaacccctaacttttgggcctcgtggtcgacacccctgtctcctgtgtgagatacttgtcagtccggagctctgtcattaaactacctcatgtgtttgcatcaagactgtcttttgtgattccttgggtgtgcgtgctatctcaggacttgtgagtgggtgtctgccctttaggttctttcagtttcattctgttcatttgttcatggaggaaaattattctaacagggctaaggtataaggtagagtgagcaagcagttaaggtttattttttagcagaggcaagagagagaagtggacagtgcagtgtatgaaatgcagagtggagccagcagagcagcattgccatcttaacttctgttccatctcggcaggcctgacaccctcacagtttgaaccataacatttgttttaattgccacatcagccatcacagataatggaaggggggaaactgaggaagagaggaactaaaaagggaggaatggagggagcaggccaggaaaagtaatggggaaggaatataagaagctttcagaggatgtggggaagacgggagatgggcaacagaacctccaaaaatgatatttggacattggcagttaagacaacctaaggagactagtaggtagataaggaagcaaaagcaaacttctggactcatgcagcagctacatggtttggcgctgatagactgtactcctttcctgaacaagagggaccacttgcatggccgcactaggctccctctctcacgttgtcgtctgggactttaagacc

SEQ ID NO: 268 - DNA, 1000 bp, mus musculus
actgaaaaaggtcaacaagataaagtgcccatgtgagaatggcccagtcccacctgggagggagaagaaagcaattacaagtgaggagggatagagggacctgggagggaaagtggctggaggggggtaggacatgatgtgatattgggtggggggaaatgaaagcttgccctgggggcaagcagaaagaatagaaacaggcaatctcttgatgtaggaggttggggggaccctccagaattcaccagaaacctgggaggcaagagactctcaggacacaatgggaaggaccttagatgaaatgcctgacagtagggaggggaaacttatagagcccacttccatcaggaagacagaacatcaaatgatggagggggttgacatccctcagtcacaactctggcccataattattcccctctgaaagaattacagggatggacatggagaggaccctgaggaaaagaaggtacagggacaggcctgaagagggatccagctcaagggaaagtccagaaacctgacactatcactgaagctatagagtgctcacaaaaagggacctagcatgaccacactccggaagacctatccaacacctaaaagagtcagaggcagatagttgtgtacaaccaatggacagaagctgctgacccctgttattgaattagggaaaaatggaaagaagctgtggaggaggatgaccctctaggaggaccagcagtctcaattaatctagacctccaagatctctcaaacactggaccaaacaggcagcatacaccagctgattggagattgccaacacacattccagcagaggactgcagtgtctgtattcattcagacatgatgcaactaaccctccaaacactagaaaccctgcggagtttagaggtcaggtggagtaggggtggggtggggacctccacgtggagacagggctgtggggaggaggaatgggatgtggagcagtaagagggtggcaggttggggaata

SEQ ID NO: 269 - DNA, 1000 bp, mus musculus
ctcagggtttttatagtgtgggatcatttggaaatgctttcagataaatgattggatacatatcgacaatggacatagcatttttggttatgattacaaaaagctgattgtatgtgagagaatttattttattttatttttatcatttgtgtgtgtttgtgtgtgtgtgtgtgtctgtgtgtgtatgctgaaatatacccccttttttcagtgctagaaattgaacctagggccccacatatgtgttcctagtaatctaccactgggctatagctcctgtcattctctacttctatttttttttgaggcactgtcactcacaagctgtacctgggtaagtaggttacactggctggctagccagtccccccacccccacaaaaaaacagtataaacccgagtacgcttttctacaactagcatttttcttaaagtttatttatctattttatgtttgtgcatttgagtgcatgcacacataacatatgtgttgggaacaaaaaagtgggggcccctgaggaggtcctaggggagaacggggagggggtgaagaaatagcccatgtccggccagagttcctgtgctctgggcaggcagacatggggcgagcggctggacagtttctacttggcccgggtgggcatctaagcctctgaccccactcagcagagagtggacaaggagcagcccctgaccgggaaccctgaggtgacaccctgttgtcccggggttatatgagagagggagaaggaagaggttcccaacactgaccagagtgcacagccgatgttgatggagcagagactctctatggtttaaaagcattattatagaaattctgggggaaagagaagagagagagagagagagagagagagagagagagagagagagagagagagagagagagaggagaaagactagagagaaagagaataagagagaggagaggagaatacaaagagaaaaaaagaggagagagaactgagagaagtgagag

SEQ ID NO: 270 - DNA, 1000 bp, mus musculus
tcccaatatacatcttattgttatattttctagtttattttatccaattttttaaatctacttacattctaatcacaacagcacctccttcctgtcctcacagtcctacacttacaaatttcttgacctattgtcccttccccttcttcttacacaagacaaagattccatggttaacacctcacccttcgacaactagtaccagaaagactgggcacatcctctcacattaaaggccaattaggggaaaaagtatccaatgtcaggaaacatggaccaagacagtcacagctccccttgttagggccccacatgaaatactaagctgcacatttgctgcataagtataggggacctaggtccagtccctgaatgctccctcattgttggcacagtttctgtaagtacccagaagcccagattacttgattctgtaggccttcttgtgatgtccttaatgcttccctcttttacaattctatctccaactcatccataagaacccctgaactctgcttgttgtttgcctgtgggtgtctgtatgtattttaatcaggtgttagatgaaacatattacgagacatcagtggttctactctacaacatagagtataattaaaggacaattatgctgggctgtagagcattacaacctcagcaaagtgtcttcatggcttattcaaatcctgttctaagcagactcagcttaatgcctttcttatgacctccaggtaccaagcacattctgggctttacctgtttgatcatgctattacttatattaattcaagctatcctaatgacttcttgcctcttttagaaaacaaagacagcctcttgcttttcttttatactccatattctgttttcttcattttccctttgtgaacacttattaaattggtgattatctcttcactaacatagcaacattaaaaatgatagttggcaaagtataccattgatttttttctatttattttacttatatttggttaga

SEQ ID NO: 271 - DNA, 1000 bp, mus musculus
gtctagtttgaagtcacttacctctctgctatgcatgccttaacaggaaagagtgtttctgtaattgtgggatggtgggctctgcacagacagctggtccttagttgggcaaaggtatggaaccccagtgtacaactgtgccacctgggcccctgcctcctactgcaggtacagcctccctcagcaccccacagagaggtgtgtggccatctgtcatgtagaagcagcagcatcaagccctcccatgagcaaataagttttccccaaaactctcagaccaaactaatgagaagtgcctcttgtcagacccttaccccctcccaaaactgtatataaccatcttatctggaaggattaacgatgtgtgagaactactcaatcatccgagccttctgtcctaagagctggagcacttgggaagaggtctgctcttccaaaatgctgcctgaagcaacaccgcacttctcactgactggtgggccttgtcaacccagcccaaatgagtatcatggaaggcatggcagagatggaggtgaagccaactacagcagcagaagcggtggaatcgatctatcctccctgcctgtacaatcttcccttcactagaactctagcaccaggccaagccagagatctcagtggaaagcctatggcaagtaggcctacctgtaatgattatacctgcctgttcctggtttgatagggagcctgggtacactaacatagagcaatgtgtgtgaaaagaggtgactgattcattttctgttagagatcaaactgaaaagaatgaacagaagttacagtcacaatgtggaatgcagaaactagaatgttccctctagtgcagcatgcaaagcagttgtcaaactctccattcacaggacatcatcttccctttgggaagagaaaacacaggctctaggaaaattcagagtctctctctctctctctctctctctctctctctctctctctctctgtgtgtgtgtgtgtgtgtgtg

SEQ ID NO: 272 - DNA, 1000 bp, mus musculus
agacaggtagatcaatggaatataattggagacccataattgaacccacacacctatggttacttgatctttgacaagggagctaaaaccatccagtggaaaaaagacagcatttttaacaaatggtgctggcacagctggcagttatcctgttgaggaatgagaattgatgcattcttacctctttgtacaaagctcaagtctaagtggatcaaaaacctccacataagacaagagacactgaaattaatagaggagaaagtagggagtacccttgaagatatggacacaggggaagatttcctaaacagaacagcaatggcttgcactgtaagatcaagaattaacaaatgggacctcataaaattgcaaagtttctgtaaggcaaaagatactgtcaataagacaaaaacgccaccaaaagattgggaaaggatttttaccaatcctaaatctgataggggactaatagccaatatatacaaagagcacaagatgctgaactccagaaattcaaataaccccattaaaatggggtacagagctaatcaaaaaattctcaactgaggaatacctaagggctaagaattacttgagaaagtgttcaacatccttaatcatcagggaaatgaaaatcaaaagtgttgggagccgcgcccacattcgccgttacaagatggcgctgacagctgtgttctaagtggtaaacaaataatctgcgcatgtgccgagggtggttcttcactccatgtgctctgccttccccgtgacgtcaactcggccgatgggctgcagccaatcagggagtgacacgtcctaggcgaaggagaattctctttaatagggacggggtttcgtttttctctctctcttgcttcttgctctctcttgcttcttgctctctggcttcttgcactctggctcctgaagatgtaagcaataaagctttgccgcagaagattctggtctgtggtgttcttcctggccggtcgtgagaacg

SEQ ID NO: 273 - DNA, 1000 bp, mus musculus
tgaatttcatccagaattctctgccctgccttaaccacttgttgacattcctcgtcctttaagcacgatcttattagcttccacaatggcatggttcctgctttaagtttgccattctcctgctccccaactaaatctcccttgagtttctcccaagaggggatagttaaggaccctgagaacgcaaaccatggtgctatgcgatctacctcttttacaaagccttctagtgtcttggtggtgactttcaagccacgctgcttcatgaccgaccgtaaggcggtcaccacagagtgggagattcacatactggttgctgtccaggcctgaccacaactgagaaccagtcagcagttccagcggtggaagcaaaacaaaaccgaaagggaaggaacaatcaccatgaaaacaatcaaaagggcgtctaactctggagaaatttcaaaactgtacgtatccttgcaaagctgtaaagtgtcccatagttctgaacacgccccgtgaaatgagggggggaggagggtgttctcctatcagcgcctggtgatgataaattcccgggtttctcagcgccacttttcccccgagctagtatctcgccggcaagaattcactcggacaaccagatccttctacagcaaagcttttattgtttcaacataaggaagaccccgaacccagaaaatggcgctgcttatatagcccgcagtgtgacgtttcagcacctgatgtggtgtgacagcacctgattagttgctcgcccatcaccccattactatgccccgaggacagtgacagggcgtgaattcacacttgtacttgcgcataaggcgtgtttactagttaggcgcagtggaatccagcgccatcttataatggcgattgctcacagcatggctctccacacaaaggtacacccagctattatttagagccagatagattatttatatgaaccatgaatcttgtgaattatgaaattatttataggtccatttta

SEQ ID NO: 274 - DNA, 1400 bp, mus musculus
tgtttgtggaatcttctacacctgagattctctcttccatctcttgtattctgttgttgatgcttgcatctatggtttctgatttctttcctagggtttctatctccagtgttccctcactttgagttttgtttattgtgtgtacttccctttttaagtcttggatagttttattcaattccatcacctgtttggtcgtgttttcctgtaattctttaagggagttttgtggttcctctttaaggtcttctacctatttagcagtgctctcctgtatttctttaaatgagttattaaagtccttattgatgtcctctaccatcaacatgagataagtttttaaatccaggtctagatttttgggtgtgttggggtgcccaggactgggtggagagggagtgctgcgttctgatgatggtgaatagtcttggtttctgttagtaagcttcttaggtttgccttttgccatctggtaatctctggagttagttgttgtaattgtctctggttagagcttgttcctcaggtgaatatgttagcctctatcagcagaccttggagactatctctctcctgagtttcagtggtcagagtactctctgcaggctagctctcctcttgcagggaaggtgcccagatatttggtgtttgaaccttcctcctggcagaagatgtgttccactcaccagaggtcctaagatctggttgagagtcctgtggggaccttgggggtgtccgcatactctgcttctaaggtgtcctggtgctggtgcagagtggaagctttttttttttttttttttttttgcatttttaagtggcatttacagacaatgttaaaataacaacacgagctagaatgtcaacagccaagaagaggatcatttaaataaatggatttgtaaaacatgattgtcttaagcttgttcatgtcacaagtgtgatttgaattaaacatagagtgattgtttttactgaatcagtaagtgagacattacgtttgcagagcatgtcctactccacagacaaaactgtttaaccactttctgaaggttatattgcagccacaccctattaaagttgtttaacttttcttataaagttgctctttttacaatattaagattttttataatattattacttctagtcatttgccttggtaataaaatatgaacatgtttgaagacacttttcctaatgaacaaggtagcttcctttatagttcctactggaaagccagaaaaagtactgtaaaagaataaagggtctgcctcaagatggaactcctgagtagaaactggcttgagataagaaataattctttgtataagcaatttagtggtccatggtagttttggatttcatacacttggtttaattggtgagtggtagattcc

SEQ ID NO: 275 - DNA, 1000 bp, mus musculus
ggagggagaaaaaaatcaatcacatgggggaaggaagggatttgggagggaactgggataagggggagcagggagggtaacatcatcaggtattcagtgggggaaagaactgaaatccctgagggccagcagaaagaatggaaacatgcactctcagcaggtaggaggtagggggcccctacataatataccagagacctggaaggtaagagactctctggactcagagagagggacctcagatgaaatgcagtacactggggagagggaacttgtagaggccacctccagaggaagtcagggcatcaaatgagggaggaggttgccttgcacagtcaaaactctggcccataattgttcctgtctgaaagaactacagggatgaaaaggaagaggagcctggagaaagaaaggtccagccacaggctcaaagtgggatccagctcaaggggaggtcccaaagcctaacactattaatgaggcaatggagtgctcacaaaaagggacctaacatgactgccctctgaaagacccaacaagcagcttaaagaatcagaagcagatatttgcactcaaccaatggacagaagtgccgagctctgtagggaaaagctgggagaagttgaggaggaaggtaaccctgtagatggaccagcagtctcaattaacctggacccttgagatctctcagatactagaacaccaacttggcagcttaaaccggctgatatgaggcccccaacacatacaaagcaaaggactgccaggtctgggtttaatcagagaagatgcaactaacactcaagagactggaagccccagggaggttagaggtctggtagggtgagagtaggggtggggatatcctcatagagaaacagggggcaggaaggaggtatgggatgtggaacagctgggatggactggaagggtaataaaatctaaagaagagagaaagaaagaaagaagaaagaaagaaagaaagaaagaaagaaagaaa

SEQ ID NO: 276 - DNA, 1400 bp, mus musculus
cttccctgttacttcctgaatgtcagggtggaaacacatgtaagagagattggaaccagcttgtctgctcctctgaaatcattgcagtctgaaggcctcttaggaattcccatgcactcatgacaactagtaaaggaacacccccatcctcacaaagaactacagcagctgggaatcctgcaaagcctcagaaacttgaaacccatcaccccccaaaacccctgccccctgaattacactccccttctggcctgtgccttttgccagggctgatcagcagcttgtctgctcctctgaagacaccacagtatgaaggcctcccaggagttctactacatgcaaggcaactagtaaggggccctcttaaacagccacagctgctgggagccctttggagcacagtggacttggaacctatcacccttgctccccaataccttcccctccatacctggaattttactcctctttggcctgtgccttttgccaggtcagatcaccaacttgcatgctcctccaaaggcaccacagtctgaaggcctcccaggaggttctctgcacacagggctactgacccaacattctgaaagcctccctggagaatagctaccctcagaggaacagcttgactggtcctctgaaggctaaagagtcaaagggcctcctaggagatctgctgcagtaagggcaacagatcagcagattgttcagctctctgaagaccccacagttttaaggcctcccagaagagttgctgcagccagagtaacagttcacgagtgtacatgcccctctgaagaccccacagttggaaggccccacaggaggtctgctgcagccagggccacaggcccaccaggacacatgtaccaaaccagggacacaaaccagacaggatccagaaagagatacccagaccagctaacaccaggcacaaccagatggtgagagataagcacaagaccataagcaacagaagccaacatactttggcaccatcaaaactgagttctcccatctcagcaagccctggatacaacaacacacctgaaaatcaggaagctgacctattatctcatgaggataatagagttctttaaggagaatataaatgacacacagaaaggcataaaggaaaacacagataaacaggtagacacccttaaagaggaaataaatcctttaaagaaatacaagaaaacacaatcaaacacggaaaggaatttaacaaattggttcaagacctaaaagtggaagtggaaagaataaagaaaatacaaatggaggcaatccttgacatgaaatacctaagaaagagctcaggaattatagatgtaagcatcaaccaatagaatacaaaagacagaagagagcatctcaggtgtagaagatattgacac

SEQ ID NO: 277 - DNA, 1600 bp, mus musculus
ttgagttttctttattgtgtctactgccctttttagttctagtatggtttttttcatttccatcactggtttggatgtgtcctgtttttctttaaggacttctaactgtttggttgtgttttcctgtttttctttaaggacctgtaactctttagcaatgctctcctgtatttctttaagtgagttatgaaagttcttcttgatgtcctctaccatcatcatgagaaatgtttttaaatatgggtctagatttttggttgtgttggggtgcccaggactaggtggggtgggagtgctgcattctgatgatggtgagtggtcttgatttctgttagtaggattcttatgtttgactttcgctatctggtaatctctgaagctagctgttatagttgtctctggttagagcttgttcctcaggtgactctgttagcctctataaggagacctgggaggctagctctctccttagtttcagtggttagagtattctctgcaggcaagctctcttcttgcagggaaggtgcccagatatctggtgttcgaacctgcctcctggcagaagttgtgttccactcaccagaggtcttaggatcacgtggggaatcctatgtgcgcccttgtgggtgttgggagactccgctggcaaggcaccccggtgctcgagtggaccagaagggagttgtgccctaagtcaggccctggtcgtccgcttccctagttaatgcagtctcaggttctgcgagattggattggggcagacactgtgttccactcaacagaggtcttaggatcccatggggaatcctgtttgggcccttgcgggtgtcgggagactctgctggcaaggcaccctggtgctggagtctgtattctgtacttttaactgtgcaggatacacttggcggggtcccagaacaaagatgtctgctgccgatgctcaggcaaagctctcctgggctgggcagatccctatcctctggccgggaaagtggccagctgcctgtgcaggatacactcggcggggtcccagcgagatatgattttagatctaaatcttgcttcagaaggtagaatggtttatgcaggacttggaatggtgggataattgagttctgatgttgccaagtaatcttggtttctgttgcttatgttcttaagcttgctttctgccatctggttatatttaggactacctgcccttgctatatctgactgtagcctgttcttccttttatcctgattgtgtcagaaatcctcagagttcagctgtctgatctctttcatgcaaattccagtgtatatctcatcactttaggggttgttctttttttttttttcttttttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttccagtgatggccgactaggccatcttttgatgcatatgcagctagagtcaagagctctggggtactggttagttcataatgt

SEQ ID NO: 278 - DNA, 1000 bp, mus musculus
gcatcgaactccctcaggtcctacggctgctcctcacataaggccatcatctgccacatatgtggccagagtcatgggcccctcaatgtgtactcttttgttggtggtccagtcgctgggagctccaggggtctgtctagttgatattgttgctccccccatggggctgcaaaccctatcagctccttcagtctcttctccaactcctccattagggaccccatgctcagtccaatggttggctgcaagcatccacctctgtatttgtcctgctctggcagaacctatcaggacacagccatatcgctttcctgtcagcaagcattttctggcacccacaatagtgtctaggattggcaactgaatgtggaatgaatccccaggtggggaagttactggatggtttttcttttagtctctgttcgacaatttgtctctgtgtttcttcctgtgaacattttgttcccccttcaacgaagtaatgaaggatccatgctttggtcttccttcttcttgagctttgtatggtctggaatagtatcttggatatcctgaacttttgggctaatatatatttatcagtgagtgcataccatttgtgttcttttgtgtctaggttacctaactcaagatgatattttcaagttccatccatttgcctgcgaatttcatgaagtcattctttttaatagctgagtagtattccattgtgtaaatgtgccatattttctgtattcattcttctgttgagggacatctgggttgtttccagtttccagttattttaaatatggctggtatgaacatagaggagcatgtgttcttattacatgtatatgcccaggagtggtatagctgggtcctcaggtagtactatgtccaaatttctgaggaaacaccagacactgttttccagagtgtttgtaccagcttgcaatcgaaccaacaatggagggttcctctttctccacatctttgccagcatctgctgtcacctgtg

SEQ ID NO: 279 - DNA, 1000 bp, mus musculus
aaagttgtcagtctcaaattttagttataataatgaagaatggactaatataagggatagtaaaatagcctttcttgagcaccaagggatggtcttaaagtactgcatggctgttaaatacaagatcctcaaaagattcaatgtgacacatataatccttgtcttatctttgagggaactgaaatcttgaagcataaggaaatttatccataggcacacaataaataaagtgttgtttatagctttagctgccctgactatgctctgggaacaggccgagctaccagcccccaccgagctccccttgaatccatggataaaagacacagacacacagttgttcattttcaacttgccttcttggcacaattgctgggcattattacattcccattgctagtgtacccttactaatactcttagctccacacctcccacctgtcctaaacttagttgctcagttacatcccagactgttcgcctgtaggagtggccataggctacactgctctgacagaaatctcacacgaaggttcaccttttctctctcagaagtttggccaactctgtctctcttcctttgtgtctgtctcttttccatgagggacctcctattccttctgctcagcaattagcccatggcttctttactgacatatcaagaatgatttggggaacaggagagcatcagaacatccctacagtaacaaccaatggtgacataagctggccctgcaatggcaggctgcaggcttacctaagaaggcccaatgctgaccgaggagtgtattccctttcattttccttatggtgatgcttacctccaagtatttttcccattatgaaatgaccttcagtgatctctcttcctaatttagatcatctttgagattctaaagactcccacatccaagaaaaatgcacagtatagaatagaaatgaagaacatttagtaagttaggaatcatcttcttatagggaacatagttcactaggaaat

SEQ ID NO: 280 - DNA, 1000 bp, mus musculus
acaccatgctctttgctgatattgcttgttgtgactgtaccaaagatcttttggtggtattctggttgcttcttgccgattccacagacttgtttcaattggtggagcctcatggtttcttctggatcaagctgatgctactggttatgtttggcattttgctaatggactggatgctgacaatgaatattggaatcatcacaaagaaaaatttctaaacagaatcagggctccatttcctatgaactttcttttcccataccactggagagtggtgagctacaagggatgttaacacattaaagaaccataattaaagtaggttctaaaaaaatctaagtctatgggaaggggtgcaaatgaggtttgggcataataagtaattctgcttctaatatagtagaagaaaagccaggttgtgatgggttggaaatattacttatggaggttggcaaaaaacagaaacttctgacattccttggtctccttctttggttctggactagattttctggttttacttcattgtcttcgaatttagcatttgaaaacaattgaagggaaagctgacaatacttttatgtttgtgaagattgcagagtttgctatgcactttgggagtttacagatagagagcttggaaagccaatgagccagtatatggagagcaacaggtttcaggcttggcgtctgagaccaggaatttgctacatgatgaaagagggaagcaaacttggctggtgtgtaaactgtcacctgactcttctccatacactttcactgccaggtgaccagaacatatctgtgagacaaaggaccagggagaggaggagatagtacagagtcaatgtgttagtgttcagccaagtgaccaacagagaattttcttggggctacccaggtatcttcagccttctcagtctttgtgcaacatatgcttgctaatggtgaacatcgtgtttataatgcgttgaccgggcatttgatagaaatgctagat

SEQ ID NO: 281 - DNA, 1600 bp, mus musculus
gaaagaaactttaattttctgaaagatttaggtgagtagttcttaatgtcctcatgacatgtttgtctaaaagtaaggaactcctgggcttgtatgtttctgttattaggtaacaacagttttctcattattctgggttctcagcaaagtattattactcatgcctttttattttgccacttatttatgaaaaataaagtaaaatgtcttcattttcatcttaatgtgcaactttctttaactcaactcataaagaagtatatattttgccccctttttgttacatgagcatcgccccaagtccttctataatttccatattgcttataataagacctgactaatgccactactgaacacatgtatctctagtttcctagatattaatctctgtgatttcaagttactatgttgtattatttttagctcagtttcagtcatatctactctgtgtcccacaaggtccctcacatgccagcgtggctataattttggcctaactctgtagatcataatgccatgttacaatatcaaaacacacacacttgaatgacaagtgatgtgtcaggaatattcacaagcaaggtcagtcttttgttcatgtacactttgtggttcacttttgtcctgacccgcaggaagacaaatgaggactgggggactacctggaagagaatatgggaacaagaaatgcaaagaacagacaacaagtcaaaaaaaaatctgatcaagctgacaaattttatttttccttggcagattttatacccaaatagaagcagggtatggggaggagggtgaactaggaatgctttgtcttccggggaaagcatctgttctcaagaacaggatattggctggatacataaagaacagaacagattggttgctaggtacctgtccactaaaatctatagctatttgttttacctcactttaaggtctacaacttgttttccattgggctagcactttcccacagatgtctcaacttttcccacagagatctcaactgaactagtacttttcccctaaggccaagactgtgtaagtaagcacttatggctgacaaggcagttaacattcaaacagggtctcttccaacacactttcaaatgcattttggaatatcgaatacatgaagtgtgctttcagaagatataaaatccatggaagcaagttcactggagtcgcctacaattcttgagtacattctgcccaatttttctgcacactagtacctactatcaaatatatgaacaggttttgcctcttcttcttgacccatggtgtattttagagtacgtagtagttgaagttttggatggaatggaaatgtggctaagtatctgcttccattgagaaccactgtggagagaaatatcatcctcaactcttacttattttccacagctaaatatttgaaaatattaataggcataagggttatgctaaatgcttgatcctctattgagttagactgtacagacaggttactaagtaagtagtatttcctggaaatagctctacacaagggatagtatttttaggaaaattaagggctttctttgctttctgactccaccatagaaggatcttc

SEQ ID NO: 282 - DNA, 1600 bp, mus musculus
ttgaaatgggaatcttcattctcttctatacatattattcttaggtttggtcttttcattttgttctgaattttctggatgttttgtgttaggacctttttgcattttgtatttactttgttttgtcaatattttctatggcatcttctatgcctgagattctttcttatatctattgtattgtgcttgtgatgcttgaacttgtgaatcctgattgctttcttaggttttccacctgaaaaactgtcttcctttttaatgtctttaattttctatttccatttttcaatcatagacagttttgctcaatttcctcaactgtttcattgtgttttcctttatttctttgagggatttatttatttcctctttaagggcttctgcctgtttccctgtgttctcctgtatttctttaatggagttatttatgccctccttaaggtcctctatcatcttcatgtgatggggttttagatcagaatcttgctgttcaggtgttttagggtattctcggtttgctgtgatgggagaactgagttctgatgatgccaagtatcattgatttctgttctttatgcttttgtgtttgcctctagacatctgattatcttgagttttaaatggccttgctgtctatggttggagcctgtcattcctttgagcctggtttattgtgcctgcttcagtcaagctgtctctcgatgtgggagtgtgtctggagtgcctgatttgtgaaattggctgtggcagacctcccgggagtcatgatgactctaggtgtgggtgtggttggaattgctggtgtacataatctatgtcctggcctagttttgaatgggaaggaagttggatctctgtaaaggagccaaagcaggtggtctcaattaagctatgttttggggcagaggggaggaactcacttcttggtctggtggtatcagaactcctggggctcaaactgactctgggtgtgggcagtgtgggggtggctggaacacagttaaaaggaaaattaacaattgctgctcccagttgtagttgttgactggaagcagcaattgttaattattcttttatcttatgtaagaaccaattttacttgtttttgttatcactgaaatttagtagtgtggtttatcatataccatttgtgttggtgataactgacatataaaatctcctccagtgtttcaattatttacactttgaagcacaatatcattgaaaaggaagtagaacagtgcaagatggctttgataataaagaataattctttgcagagatcaagagagttacttttttttttttttccccctttttttttttcttttttttttttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaa

SEQ ID NO: 283 - DNA, 1000 bp, mus musculus
taaaaaaaaaaaaaaaaaaaaaaaaaaaaaaaaaaaaggagagctgcccttacagtcagcaccagctcctgactaccttggacatgaactcggacaacagttccacatttcccagaggactctacagaagaccttaggatcactggtgagtggaacacaacatctgttccaaaccaatcgtgacagcagcagggatgcagtaaacccacctgagctcaagtcccttccagtcagccaccttgggcacaaattcagctaacagtcccatggtcccagatgactctccatgccccaggcaccctagcactcctagaatcttagtatcactggtgagtggaacacaacatcttttccaatccaatcatgacaggcctctgacagcaggagcaagaacatgggaggcctgcctgaccagcagatcatgtttcttctgatcagtgttggtattccttggtttcaaacacaccagacagacctatggtccccagaggagacagcaattctaggagctgtaaagatcccagaaccttaggattccaggataccaggatcttggtcacaccagtatttcagggtctcagaggaagctttgtggggagccgccctcacattcgccgtaacaagatggcgctgacatcctgtgttctaagtggtaaacaaataatctgcgcatgtgccaagggtagttctccaccccatgtgctctgccttccccgtgacgacaactcggccgatgggctgcagccaatcagggagtgacatgtcctaggcggaggataattctccttaaaggggacggggtttcgccattctctctcttgcttttgctcttgcactcttgctctcttgcgctttggctcctaaagatgtaagcaatagagctcttgctctcttgctctctggctcctgaagatgtaagcaataaagctttgccgcagaagattccggtttgctgcgttcttccaggccggtcgcgagaacgcgtgtaagagttggtgct

SEQ ID NO: 284 - DNA, 1200 bp, mus musculus
tccctggtccaccctccgactgttgcacatcccataccacctttccaccccctgtctccaagaaaatgtccccaccccaacccccacccaaccagacctctaaactcattggggcctccaagtctccagagggttaggcacatcttatctcactgaatccagaccctgcagttctctgttgtatatgtgttggttgcctcatagcagctgatatatgctatctggttggtattccagtgtttgagagatcttgggggtccaagttagttgagactgctgtttttcctacaatagtcgtcctcctcagcttctttcagcctttcacgaatacagccacagggttcagcagcttctgtccattggttgggtgcaatgtctgcatatgactctttcaactgcttgttgggacttcaggagtgctctcaagataggtccctttttgtgactgctcaatagcctcagtaatagtgtcagacctgtgacttccccttgagctggatcccaccctgaccctgttactggaccttcttttcctcaggcttgtctcaatttccattcctgtaattctttcatacaggaacaaatgtgggtcagagttttgactgtgacaaggcaacctgctccttcacttaatgccctgtcttcctgctgtcagttcgctctccctactgccaggcatttcatgtagggtcccttcttttgagtcttgagaatcactcacttcccaggtctctggtgcattctggagggtccctcaaacctcctacctcccaaggttttatttttccattctgtctgctggtcctcaaagcttcaatccttttccctcacccaatgcaagatcaggttccactctccacaggaccctaccaggtgcctaccatcctccccacttgtaattgctttcttctccctccaaagttggacggaggaatcctcacttaggcccttcagctggttgacctttttgagttctgtggactgtaccttgggtattctgtacttatctactttttttctttcttttatttgttttttctttttttggcaaatatccacttattagtgagtatataccacgcatttccttttgggtctgagttacctcactcaggatgatattttccagttcgatccatttacctacaaatctcaggatgtctttttttttttggttagcttcttgtgtcctttatatat

SEQ ID NO: 285 - DNA, 1000 bp, mus musculus
gcatggtatttagtcactgataactggatattcgtcagaaagtacagagtaccctttataaactcaaaagactcaaagaaattcaacaagagggaaggtccaagcaagaatgcttgaattatacttagaaagggaaaggaaatagtcataggaggtagagagagtggagggctgggagaggggaagggaagaggaatggggtttagaatcaggtgtgaggagacgcaggaaagagatacagaaggtccaggagaatgagtgtacatctaaagctgctggccataggggaaagggagaaatctttagcaagtcccagagacctgggatgtggatgctcccaggaatcaatgcaagtgactctagccaagacacctaacagtggggtaatggaacctgaggagactaccttctgcagttaggcaggacacccagtggagggataaggacacctaactacccacagatttttctactcaaaatttgttctgtctaaaaaaaatacagggaaaaagatggagcagaacctaaaggaatggccagccaataacctgtccaacttgaagacgccccccccccatgggtgagcaccaatccttgacattattcataaaactctgttctgcttcctgacaggagcctaccacaacctcctctgagaggctctgtctaactgcttattgaaaaggtgcagattccttcagtgaaacattagatggtggttgaggactcttatggaagaagtgagggaatgattaaaggtctggtagggacctgaaatgggaaccccacaggaataccaatggaataaagtaacctggacccctgggaactttcagagactgacccaccaagcaaagaacgtacatggtttggaatgaggtcccacggcacacatgtagcagacatacagctctgttgtcatgtgggtagccaacaagtgaagtagagcatctccctaaagctgtaacctgacagtgctatctgttcagtctggcttcct

SEQ ID NO: 286 - DNA, 1200 bp, mus musculus
ctcttccatttcttgtattctgttgctaatgctcgcatctatggttccagatctctttcgtagggtttctatctccagcgttgccttgctttgggttttctttattgtgtctacttccctttttagttctagtatggttttgttcatttccatcacctgtttggatgtgttttcctgtttttctttaaggacttctacctgtttggctgtgttttcctgcttttctttaagggcctgtaactctttagcagtgctctcctgtaattctttaagtgacttatgaaagtccttcttgatgtcctctatcatcatcatgagaaatgtttttaaatctgggtctagattttctgttgtgttggggtgctaaggactaggtggggtgggagtgctgctttctgatgatggtgagtggtcttgatttctgttagttagattcttatgtttgcctttcgacatctggtaatctctgaagctagctgttatagttgtctctgttaagagcttgttcttcaggtgactctgttagcctctataagcagacctgggagggtagcactctccttagtttcagtgggcagagtattctctgcaggcaagctctcttcttgcagggaaggtacccagatatctggtgtttgaaccaaactcctggcagaagttgtgttccactcactagaggtcttaggatctcgtgtggaatcctgtgtgggcccttgcgggtgtcaggcgactcagctggcaaggtagcccggtgctcgagtggagtggaagggacttgtgccccaagtccggcacgggtagtctgcttccctatttaccacagtctcaggttatgtgcgattggattggggcagacgctgtgttccactcaccagaggtcttaggatcccgtggggaatcctgtgtgggcccttgtgggtatcgggcgactctgctggcaaggtaccctggggctcgagtggagaggaaggggcttgtcgagttagtttttatagtggatttgtgttgatggatttccatatactgaaccatctctgcatccctgggatgaagcccatttgaccatggtgaatgattgttttgatgtgttcttggattaaatttgtgagaatgttattgagtatttttgcttcaatattcataaggaagattggtttgaagttctatttctttgatgggtctttgtatggctttggtatc

SEQ ID NO: 287 - DNA, 1600 bp, mus musculus
aataaagaatactctgtacttcataatacaacagtaagaacattaaaagatagaaataacagtggctaaatttgggggtaatgttagctacctctgaatccacagctattaatattgtataatatgaaataattttaatttgtttcttcttaattttatactttgcatactaatgctgagaaactatcttctacaacaaagtaatagaaatctgaccatcccttatggtcagatcaatttttaacacatgattccatttgtgacatagaattaaaaacatttaaagtaccttgtataacctgtgaacagcccagtaaaatggtatctatactaaaattcatatctatgatatttactatggcatataaaaacagccatgaaaagaaacagtttataaggcttccaaaattgtatagaaatggaagaaatatttttatgagttatatggttaattccctcaacccaggcatggagagtgatgatttgtgctgtctgatttacattcagtgatttatattctgaattttccttggatctcaggaagtaactactcataaaagaaatataataattttagtttatattttcttgcttgttttgtttacttttgaatatctattgctaataaaaaacaaatctacataaagaaaacaagctttaaaagtatttaaacaatatttatttttctctagctgcttgaacagcagggttactaaagtaataatggaaaaggaaatacaaagttaatattccattactttctttgaaaaattgtaggttgaatattctttttgttgttgttgtttgtttttcaagacagggtttctctgtgtaccccttggctgtcctggaactcactttgtagaccaggctggcctcaaactcagaaatctgcctgcctctgcctcccgagtgctgggattgaggggtggaacaccacgtccggcaggttgaatattcttattgtacatccttgtgggcagcaaagctaacaaatactgtctgtgactaacccatttatctcccagtttaagattattaccccatgttatttctctagagtagagtcttcatagatagcagaatcttaagaaaccctcaagataaatcaatctgaaaatggtgttttatgaaataaagatcaaattttaaaatctattcagacattatacctacaaaaattaatttgtatgttctaaaaataagaaatatatatttagaatgttataagtttatttatttaatttaatctgtatgagtactatagttgaatggatatatgtgcaacaggtctgtgcctgtatccttggaggtcaaaatagcttattggttctcctgaaattacagttaagtgtatactcaaaagatgatccaccataccacaaggatataagttccactgtgtttatagcagcctttttcatagtagttagaatccggaaataatcaaaataatacagaaaatgtggtttatttacacaatactattcatccattaaaaatgaggacatcatgaaatttgtaggcaaatggatggaactagaaaatattatcctgagtgaggtatcccagagccaaaatgaaatgtatggtatgtatt

SEQ ID NO: 288 - DNA, 1000 bp, mus musculus
atgtgagagagagataaaataagaaaagtagattataatagtaaaacttactggagtaaaagaagtggtcattggcaaaaaaaaagcagggcatatgctatgtttacgaaatgtcataatgaaacatcattttgtacaataacttgaattgactaatattttaataacgtagaaaacatccattcaaaacatttcttctaattcctcaaatttgtttatggagtatatttgtaaaataatttattgcattttatgtgtaatatttggcttgcatatctgtacatgccttcctacttttatggacagataagaattgggcatcagatctcttgaaactaaaattacagataatcttgagcaatcatggaaagacaactcaagtcttctataagagataaacactgttttatttgatgattaatctctacccctggttgaatataattttatcctggacagaatttgcccatgcttgatacctgctagattgctagaaattagaagtctaggatagaaccaacgataactggcaaaaataaaaatatgaaacctaggtcaatattctgctatactcacatattcgtgcccttccttgaacagttgatgggagcagacgtagagacccacagccaaattaggaccagtttaagaaaccccagagaagccgggcgtggtggcacatgcctttaatcccagcactcagaggcagaggcaggtggatttctgagttcgaggccagcctggtctataaagtgagttccaggacagccagggctatacagaaaaatcctgtttcaaaaaacaaacaaacaaacaaacaaacaaaacaaaataaaaaacaaaaacaaccaacaacaacaacaacaaaaaagaaaccccagagaagaagagtggaagggtttgaggacagaggaatagggtacaccagaagaacacagtccaaagtataaagtagggttcatagggactcacagagactagcatgggtctgtgctatgtt

SEQ ID NO: 289 - DNA, 1200 bp, mus musculus
ggattctacatgtttacctgtgttctcctgtatttctttcagggaggtatttatgaccttgtaaagttctccatcagcatcatgagatatgattttaaatatatatcttgcttttctggtgtgttgagatacccaggatttcctatagtagaagaactgggttctgatgatgccaagttgccttgctttctgtcggtaacattcttatgcttattcttaccatctctttgtctctggtgttagttggttttgctgtctctgactatagcttgtatgtactgtggttctgtaagcctgtatcagtactcctggcaagaccagctctctcctggcgggatcacttacagagggctgtggaacacctcccagctcttggaggaaaatggtgactggaaggatcctgtcccagctgctccactattccagtgtgcactccctgatagtcccaatttggacagttattggagaaaaagtggtgatttcacctctgagctgaggagggtgagcactcctgggagatcagctctgtctttgtagatctgcatacagagggctgtggaacagcctcagctctgtggtacagatggagatgggaaggatctcattctgatctttttagccattgtttgctatgtataatcaacagagatccaatttaacatccttaagattaggtcttccttgtactttacaaatttaagttaacactgaaacttacacaaaatcgtctttgtaaaagaattgcattccagaacatcaatggtaaatattttagctattatagtggcatagcatgccaagagctattcatattctacctaccagtactgagagtgctgacactgccagctgtccagcaagtgattcattctctaaatcccattttagaatttgtttactaagactgtttctgataccaactgtcctagatcaggatgtccttgaagatacaacataagacataagatctgataaagaatattttctcaaagtccttttagcaaggatgcttgtaaggatgggaagtatgagaatgagagaaaaagtaagaagctgagtgaactgaaatgttgctcaaatctccccaagatggatagaagcattattttttgtttgtttgtttttgtccccaagtgacagtttacatacttgtatttgaaagcccctgaataaagaaaaaaaatgaaggttactattttt

SEQ ID NO: 290 - DNA, 1200 bp, mus musculus
gataggtcattagaattgcattaactatcagttgacagatgcacacctcttcctaagtctacttttattgatttagtgtcagagagttgttctctttcttatgaaaggctactacaaggcatctatattagtgaaacgtacccttgaattgactctcggtttttagcatccaatagggagagagggtggagaacatatttgttggctactgctcagccttctttggtctgaaaaataaaaccactgtctcttttcaggcatcattttcttgccagcattgctattattcagtattttggtttctaagtggtatcaggggtctaaacttctcagactgtatatagatatcaaaaaaaaaaaaaaaaaaaaaaaaaaagaaaagaaaaagagaatgaatacatctatgtgtcaagttaaatacttttccaaatctttcagaaaggtgctatatactaaatccttaacttgttttcttttgtacatattattgttgagtgattccaaccgtcctgaattttataaggatttatatttattgcttcaacagcttgcagtgcatcacagtgttctttcttggaaggaaaaagaaatagaaaatgttttttacttcattagaaggcttcaaacccatatcttaaattgagaattttagaaacttccagactagcctgcatgcacgagttaattccaaagggacagaaatgcaagtgtttgtgcagtgaataagagagtctgactttccttgctctggtggcaaaggggagctgagggcaaaccatgtgacagagtcctgtgtgaccatctccctagcctctaacaagcagaggagatctaactctgaccaacagtacaacagtgcctcctctgggaatttgctggttctgcagagaagcccccttgatcactgccccctcccccaccttgtcttgcaagactcctcactgacagaatgtccagggccatttaatatgcagatgtctatccatacattcagttcttattacagaaaagatttttcattcttgaaaattttatttcaagttattttgtaaagtatttattggaacataaagcctttcacggaagtcgtgtaaatcacacctgacagaaaggtgtaatacaagggcaaattaaaaactaaaactagaaaaacaagattttctataataataaaatgtaaagaggtagccctagaagtac

SEQ ID NO: 291 - DNA, 1000 bp, mus musculus
taaattcagacgctattgtggatgccaacaagtacttgctgacaagagtttgatatagctgtctcctgagagtctctgccagtgcctgacaaatacagaagtggatgctcacaaccatccactggactgagcagtgtcctcaatgaaggagcaagagaaagtactcaaggagccaaaggggtttgcagcctcataggaggaacaacaatatgaactaaccagtactcctagagctcccagggactaaaccatcagcagaagaatacacatggtgggactcatggctccagctgcatatgtagcagtggatggcctagtttcttaccaatgggaggagaggcccttgatcctgtgaaggctttatgccccagtgttggggaatgtcaggatcaggaagcaggagtgggtagattggtgagcaagggaaggcaggtggagatagggcttttcagaggggaaatcaggaaaggggataacatttgaaatgtaaaaaaaaatatctaattgaagaagaagaaagaagaagaagaagaagaagaagaataagaagaagaagaagaagaagaagaagaggaggaggaggaagaggaggaagaggaagaagaagaggaagaggaagaagaaggaggaggaggaggaggaggaggaggaggaggaggaggaggaggaggaggaggagcaaacaaatatagtcctgagctctgtctagtgcttttgtctgagttagctgatggtggaagctagtagaggacagtcatgctaaacttctgtctaaaagctaacagagtatcattaataatgtcagagtttggtgcttgcccatggaatgtgtatcaagttaggccggttactggttggtcattcccttagtctttgctccatgcccagatttcttgtagatagggccaattttgggttgaggggtttgtgggtgtatgggtgtccccatgggtccactggggttcctgtctggatagagaaggtggccactttagggtct

SEQ ID NO: 292 - DNA, 1000 bp, mus musculus
ggataaacaaatgtcatgtggatgttgaattgcacttatttttagcgttctgtctaaactccaccccacagtaacctggcaacagcaaggtaggcctgacccgctaaaaagggagatgcttgttccctcctccctctcttgctctcttgctctctcttgctctcttgcttctcttctactcttcctctccccttctcattcccttcccccacccctctctccacggggccatggctggcctctacttctctattctttccctctatctgcctttctctgcctctactacccatttaactcccctccctatgccctgaataaaccttattgtattctatactgtcctgtggctggtccctcagggcaaagggatgtcttggcatgggcatgccgagacatcctctttctccatacctcaccacacatccatagaacatatttctttctttgtttatctttttataaacacatcacctatagtgcctagtttgattttgagtaactagttagtttaattgagttattttatgattataataactttttagtttgtgaagcagagttgtatttaataataaaaggaaataccttaaggaagcatttataaacaattttcctgattcagcaaatatcatgtgacatcgataagtagattattgccccaagttaatggcctttattatcctttctaaagtaggactgcatcacatagttttttaaagtctactgacttataattgtaatgtaattgtaatctaaaatctatagtgaaaatacttttcagtatttatcattatgtgtttataatctaatggattattcctttttgcatgaatgttcaatatactagacttgggtgaagcttggcaggcattcagagtaattattgcattatccaagaaacaattagtattttagtacaatatttcaataggatatttgctgaatataaaagttcagaaacagaacactgagcctttgtagccaaagaccaactgtt

SEQ ID NO: 293 - DNA, 1200 bp, mus musculus
acactagaaaatgctcaggagatactgcagctgatgatgatagggacttatgtatttaaggctcaattaatttggccacaggatatgagagataatacatgaataatgtgaggaggagagagttctgcttttagaaagatataaacaccacacagtaaccattttcataagcataaagtgttcaattgcattagatatctattttctgcattagtatcatgattatttaaacatttcatcaaatatgagacagacatcagtaaagcacatatcgactcttttctgaaactaacagaaatatgtattggggttttgattcaatgtccttttactgaatgtttttgtatcaccttaaaacaagctagagacatcagaaagtaagaagcctcagttgaggaaatgtgttcatgaaatccagatttaaggaaatttctaaattagtggcaataggaaaggccccaggctattgtaggtggtgctatccttggtttgctggtcctgtctttgctttctgtttcctcgttctataactcagcaagccaggggtagcaagacagtagacagtaacccctgaatggcctctgcctcagctcctgcctcctgcatcctcctttgagttcttgtcctgtttttcttcaatgatacacagtgttgtggaagtgaaagctagataactcccccatccccaacttgctttttggttgtagtgtttcatcacctcaactgaaaacttacataagaaagtcctgttatgtgatttagcagaatagtttattgagtgcaatgagtatcacacaagagccataaaagcaaggatatagagagcattatcccggatgcaattcagcaactccagtacatgggatatccctgaaggatgagttttaaggtcttgttatatttaaacacctttgtaaaatgatcttggtttgtagttacagagagctcatttacattttaatgtggacagcaccattttggatgccattgggccctgttcagagaagttcaaggacacttctcatgagtctcttgacatattacaatctaggtttgtggtgaatgaagcagtacataaataaaagcactgtggctctgtccttaaacgtaaatgtgaagagcccacggatcttattgctgtattataatatccgggtctctgaaaaaggcaacagagaatgaacacgaatacagattgac

SEQ ID NO: 294 - DNA, 1000 bp, mus musculus
caaaatgccaggtgatattctcttaagtaaaacttacttttattacagtaaatttgttgaacttgtacattcaacaaaattttgtggtacattgtaaatcaaaagagtttaaaaggatacttgtaagaatccattgagaaatatttcagtgatgagtagtcaaatgatcaagtcattaattattttgaatgttttcaattagaagtagaatgcacaagagtcagtcatgttgtgttttataaaaagacaagaagaaaggtgacatgttttggtggatgtgtaatcatgtatgggagaaggggttgtctccatgggctcaatctaaggcatcccttccccctgagggaccagccacacacaatggtatagtatagaatagattttatttagcacatggagaggggaattaacagggtagtacagacagacagacagacagacagacagagaagaggcgtagagaagtagaagctagctatgagcacttgggggggcagagagatggggaaggggcaagaggatagtgtgggagcaagcaggcaagagtaagagagagaagaaggggcaagaaggccttttaaagtaagtcaggtatacatggtctaaggcttagacatgatgttttgtcctgtgtgccaaaaaagtctagtcatttcaactgaccatagcctcttgcactatagcaatacatctaacctctggactattccctaattacaaaccctgtgcttagtttcagtctggtgagttctttaaacactagcctaactacactctacactttctacaacaccaaatcctacttcaggttccccatcctatgtacctcactaggttagtccagcctactccagtcttaaccactagtgttagacctgaggtaaacgatgttccagacacttctactaaatctgtctgatcataatctcctatactatattcaacttcctggcctagattcagtctcaaaatttgtgcccaagtctggtatggggatgct

SEQ ID NO: 295 - DNA, 1600 bp, mus musculus
aagaactagagtattgcattattcaagaaaaggttagcaagagctaaattccctggtacatgtttttcactaggcccagagaaatagcataattaggtatttactaaggggcccctggtctcgggttaaacaataggctagaattgcacctgggaatattagccctttcacctggctcctgtgaatagctgactttatagctttagggttgatcttatcttagttgtaaacactgcctggttcctggcagcctttatgtatagattttctttgttttgtgtaaagagccattatgcatctcaatataacttggctgatatataccctaacttccttgtttttcttctgcattataaatgtgatgctcactttcagaaattaccttcagatacaacactctctctggtgtccatgtctgccaactccttgtccatctgagagcctggaccctgatttctccttcgggatgagggaccgactgagtctagtccacggcaggctagtgccctgagaagaccttaagtgtgaattctgtagctagtcccataattcccagatgaagatccactctcagctactctaaactcccaggattataggattagtgcaagtctcataacactcagaggaagatcctctcccaggtgctctaacactcccaggatcataggatcagaggtgaggaggacacaacatttgcccccaaactggcaataactggaaccagcgcgacccaggcacccaggatctccacacaaccagtggcatggttccttccagtctgggccactgccctgagtagactttgggcatgaactccacagctagtcccacaacactcaaaagaaactccacctccaggcaatctaacattcccaatataacaggatcaaaggaccacaggatcctaggagcttggtcacaccaggatctcagggtctcagaggtagcttgactcccaggagcttggtcacacccaggatctcaggattacaggatctcagaaccataggatcacagagacagctgaaatctgagaagttctgacacaaccaggatcacaggaaggatgggttccactcagctatagcaagggcagttagcaatagagataatcagatggcaggagtcaaatgtaagaacataagcaacagaaaccaaggttacatggcattattagagctgaattatctcatcatagcaagtcctagatacaccaacacaccggaaaagcaagattcagaactgaaatcacttctcatggtgatgatagaggactttaagaaggacataaataactcccataaagaaatacaggagaacacaggtatacagctagaagcccttaaagaacaaacacagaaattccttaaagaattacaagaaaacaccatcatataagtgaaggaaatgaacaaaccatccagaatctaaaaatgaaaatagaaacaataaaggaatcacaaagtgagacaaccctggaattagaaaacctaggaaagagatcagaaggcatagactcaagcatcaccaacagaatacagtacatagaagagagaatctcaggtgcagacgataccatagaaaacattgacacagc

SEQ ID NO: 296 - DNA, 1200 bp, mus musculus
atttcaaattatagcaaaaagggcttcaatatcctttgtaacaggtctgagaaattaaaactgtcaggtactccaaagctacattgacatttcaggtaataaaaacagttatacattgaaatatggcacttgttgaagttatttttgtataaatggatgtcattgcataatcatttttcaaattttaattttcaatgtttcatttgcatgagcactatacattttctttaacagaacttgaaaacaggcaaaaatttcctccatcaacatcaatatgaactaaccagtatgccccagagctccttgaaactaaaccacaaattaaacaaaacagatggtggaacttgtggttctagctgtatacgttgcagaggatggcctagtctgccatcaatgggaagagaggccctagttcctgtgaaggttctatgccccaaataaggggaattccaggactgggaatgggtatggtttggttggggagcaggaggagggggagaggataggggattttcagaggggaaactaggaaaggggctaatatttgaaaaataaataaagaaaatatccaataaaaaataacttaaaatttttcctccattattttgcccaataaatctctatctttttaaatagtaatatagtattttgtggaagcatggggacctgagttcagatgcccagcaaacatgctgaagtctattcttgtagtgttgatggagctcagacatatggatacacacaactcactggtcagggagctgagtgtggaaattaatctccagactcagtaaggagacatcttttcaaggcagagaatgattattcaggtcactcaatatgatcttctggaatttcaatgtaatatagtttttgaaagtctttgtgcacattaatcatatagcatgcgtgcacacacacacacacacacacacacacacacacacacacacacgaggggggaagagataatgatgattgatgatgatcatagacagacagacagacagacagagagcatgacagacagacagatgactaatagacagagtaggagatatcccctttttgatagagtcccaaatatggtgtagaacacttataaagcaattgcattcatagaagtagatacagtaaagattagtttccagtgaagatagtttttgtttgtttgtttgtttgttttttatcttgtgctaa

SEQ ID NO: 297 - DNA, 1000 bp, mus musculus
cacatggtacacactctagaatgaaggtgcaagagaggatactttaatcccacttagaaggcagaaaatagttttaataggcagagggagagaagaacctaggtaggagaagatcaggtgaggtgaatagcaagacaggattagatatggagagagttggaagagagtcccaaagggaaaggagaatgtccagagacctcagatgagggtagctcccagaagtcaatgtgggtaacattagctttaatgtccaacatttgtgatatggaacctgaagagactacctcgagtagccagacaggaccccaagctgagggactttaaaccaacccacaaaaaacaacaaaaaaaaaaaaccaaaaaacaaaaacaaaaacaaaaagaaaaccaaaaaaccaaaaaaacaaacaaaaatcttttgacagttgctggcccatttttagacccatcccattgacacactctaatctttcacactatttgtggtttgtggtgctatgttgtgcttgcaagaatagcagaagagcagccctctgaaaggctcaacccaacagcaagctgagacatatgcatatacttacaaacattagatgtaagttggtgacacctataaaagagtacccagaaagactgaagggcctcaaggagacttcaaccccacagaaagactaacaacgttaattaacctggagccctgggagatcacagagtctgagccaccaaccaaagagcaaactcagtcttgtccgaggcccaggacctctacatatgtagcacagggctgccgtgtctggcctcagtgggaaagaatgcaactaatcctgtagacacagggtggggtgatgttgggtagggggggattggtgagtgtaactgtgacaggcggccaagagagggcagaatgtgggatgaaagtatataaacaaatgaaaaatgttggtttgaacaaacctagaaaattgtccaattattctagcttttctaagtaatgaaatacatt

SEQ ID NO: 298 - DNA, 1000 bp, mus musculus
atagcccaaaagctccaaatacccaggatacaattcaaagaccacatgaagctcaagaggaaggaaaaccaaattgtgtatgcttcagtccttcttagaagggggaacaaaatattcaaggggagaaaatatggagacaaagtatggagctggaactgaaggaaaggccatccagagatggactcacctggggatccatcccatatacaaacaccaaacacagacactactgcagatgctaagaagtgcttgctgacagcagcctgatatacctgtctcctgaaaggctctgccaaaccttgacaaatacagaggagaaggctttcagccaactattggactgagcactggatccccagtggaggagttagagaaaggactgcaatagctgaagggatttgaaaaccataggaataaagataatatcaaccaaccacataccccagagcttctaagaactaaactattaaccaaagagtacatctagagggacccatggctccagccccatatgtagcagaggatggctttgtcgggcatcattggtaggagagatctttggtcctgggaaggctagatgccccagtgtaggggattgtgaatcgagtgggtggttggatgggtgaacatcctcatagaagcagggataggaggatgggagagaaggtttccagagggaaagccaggaaaggggctaacatctgaaatgtaaataaataaactattcaataaaaaataaaaattagacaaataaataaaagacatgcatactatgtggataattctcaaatacttattgtcaatctacattagcattcctattgaaactagaacccatcatatttaatatatagtatatatttaaatttttaaagctaaaccacaagtcataccacttagcaaaacaatcttattattacaaatatgactatttttcagatgattgtaagcatcaaattatacctcttttcccaagaaatatatcataatatgattgaaa

SEQ ID NO: 299 - DNA, 1000 bp, mus musculus
gttttacaagaagtcataaagagtattcaagaaccagctacaccacttctgggcatatacccaaaatatgctccaaaatctcaccaacacacttgctcaactatgttcctagcagccttattagtaataaccagaaactggaaacaacctagatgtccatcaactgaagaatggattcagaaaatgtggtatatctgcacaatgacattcagctattaaaaaccaaggtatcatgaattttgcaggcaaatgatagaacttgaaaatgtcatcctgagtaaggtaacccagtcccaaaaggacatgcatggtatatactcactaataagtggatattagccataatgtacaggatacccatatctaatccacagatccaaataagctaaacaagaaggaagatccaggtaaggaagcttgagtctcacttagaagcaggaatagaatagtcataagaggcagatggagaggggaaactggggtggaggggatggagaggggaatggtggattcagaatcaggtgtggggaaggacaggagagatggctagatggccatgaagatgaatggaaatatacaaatgacaggggtgaggagatggggggcatatctaggatacggcacatctaggatataggaagcacccaaaagtcaatggccaccctgctcatatgtagctgatgtgcaattgggccttcatgcgggtcctgaacaactggaacagggctatcccaaaagctgttgcctgttcctgagatatgctcaactacctcggcttccttgtctggcctcagtgggagagacttgaagtgctgaggtcaggtacatacccaggccctgcccccgacctgctcagaggagacgggaatgggggagttggtacggcaacagactggtagaatgatgtaaagtgaatacgtaaaaaataaattaattaaaaagaaatgaagagtattcaagtgttgtaaaactcaacaaaatgtaattctcattaagtata

SEQ ID NO: 300 - DNA, 1200 bp, mus musculus
aactgaaaatggacttaagctgaggttttaaactcttaaagcatacctacagtgaagtacagtgatgaccaacaaggacatttctcttaaacctgctcgaagagcaccaccagcttagaaccaactatttaagtgtgaatacaatttcttaaaacactagataccataccctggctcacataggctcactgacatatcacaaagcaaactgcattcagtccaccttcaagtatccctatattctttcatagtctcaacgttgtttaaaaggccaaagtctctgttaagactcaatttaatcttttaattataacctcttaggaaatcaaaaggctaattacatataattaccaagaattgcagggagggacagatgaacctggaatgcgactgcctgtggggtagttttcaggcagacacaatgaactgatctgagcatctttgcatgagagtctttctgtgtttgtttccctgtatcctccatccctcacctccccaccccatatctaggacagccagactggatatttgtgctgcttgcttgtgctgtgggttgcatgagatcagcacacaaacatatgcttccagctgcaactcaaagagggacagataagttgtggctctgtctatactgaacccctccttgtgaataaaagagtcaggagaaaaaggtacaaagggctccgaaacaggtaatacaagagagctatataatattttcatacttaaagatgagaaacacaataatatctttgggctttaagtgatattttgaatagtttgacagcgatggatttagaggaaatagacaccttaccatgtactggtattgcaatatttattatcttgatttactatgtcttctcaaaagacagaaccctcagcggggataggggggatgtttgccttagaaaagagatgacaagtaacacaagaactaaatgttcaggattttattggttaagataagcaacagaaagagaatgaagtttggagacagaagctggaaacgatgcaagaacagaaaattctgaatttcatagacgagtctgagcaaaagagagataagcttaagacttggcaacatgacctagaggaagcaataaaactaaaggttcaggatttcataggtcaaaataagcaacagaaagaatagaatgaaggttggagacaggagcttgaagaaatgctagaaaaaag

SEQ ID NO: 301 - DNA, 1600 bp, mus musculus
gttattccctttcctagtctcctctccaaaattcccctatcacctcccacaccccctgctcactaacccacccacttctgcttcctggccctggcattaccctacactggggcatagagcctttacaggaccaagggcctctcctcccattgatgactgacaaggccatcctctgatacatatgtggctgaagccaaaggtccctccgtgtgtacactttggttggtagattagtccatggaacttctggaggtactgattagttcatattgttgtttcttctatggggctgcaatacccttcagttcctttctttccaaattttatggccttgatctccttcagttgccttctctatctgaaatgtcgagtactatattgaataagtatgcagagaatggacaagtttgttttgttcctgacctgttggtctgtgctgccaccaggagtcatgtttgagtctatgtcctatagtagcaagggtctatttccattcaagctcaggcttacatccatggtctgggctgccaaccagggatatgctgatatccctgtgtaaaacttgtctcactcttcacctgagaatcatggaagatctgaacctgggagcatgacagtatgagaccagacctcacccctagccacctgtagtacatgggaaagcaggccctacatgtcttagaagttgtagttgagctggctctcaacaatatgagcatgagagatctggccctactattccacttaagtgtagtggcatgattaaggagaaatattctctttcccctcactcctcaccatctgtggcaggtgggagagatgtccctaaggtcatgagaataggagaactggccctgcccttccccagctgaagcacttgagagagcaggccctgaacctcaagtggataacacaggagatctggtcctggatatagggttggtgggtgagctgattccaagagagtggatgtgggagaaacagccctgcttcatatctggtgagcactgaagactctgggagaatctgcaatcctcctctcactcatgcatcactgtctagggcaggaaggaaaactagtctcccgttcatgagagagggagaactggccatttccttcactatcacaacactcaggagagtggaccccacacttcacttgggcatcatggtagagctggtctagcttgcaggggttgttggtgatcaggctccaaatgtatgagagcatgagacctgtggggctgaccagttcagatacctcccaggcctatatccaggactttgaattggcccaccacaatatcaatgactgctggattacataaaggagctagtactacagatctaaaactacaagatctccatgacacaggccaataggccatccaagagaaaccccagtgaggttctagttttgatagagtagcaccaggaaccagatgtcttataccagactaatgagtcattgtaatgaatctgtgtaagcaaagatgtgtggacaagtgggtatactgtgagaaacactgtggcacactagaactttcacaacgatattattcttttcctctgttgtggataaggttccaagggtaaaggg

SEQ ID NO: 302 - DNA, 1000 bp, mus musculus
tacttaagggaggaaagacggagtcaaggtgtggagcagagacagaaggaaaggccatccagagactaccccacctggggatccatcccatatacgaacatcaaacacagacactattgtggatgactacaaatgcttgctgacaggagcctgatatagctgtatcctgagaggctctgacaaatacagatgcagatgcttacagccaactattgtactgagtgtgggatcccaaatagaggagttagagaaaagactgaaggagctgaaggggtttgcaacccataggaagaacagcaatgtcaaccaaccagagccccccagagttcccaggaactaaaccaccaaccaaacagtgacccatgactccagccacatatgtaccagagagtggccttgtctaacatcaatgggagggggagcccttggtcctaagaaggcctgattccccagtgtagtggaatggaaaggtagggagacaggagtgggcgggtgggtgggtgggtgagcaccctcattgaagcaggggaaggtaggatggggtagggggtttctacagggaaatccaggagagaggataacatttgaaatgcagagaaataaaatatccaataaaaacttcataaatacaacccccccccaaaaaaaaacaaaaacaaaacaaacaaacaacaacaacaaaaaacctcttgttatctctgctaccaatgccatcagtccaacattcaacttagcttcaagcagatttttaggacaagggtagaaagtagctactcttttttccccaaccatcacaggaatggtttctaggacacttattggtattcttctctgaaatttcttatgctggatactcacagctgagatttcccactgcattctttctatggtactactagaatggctaattaaatcttacctaatgtgtgcaacagcttttatagtccagggtcccaaagtcttccatgtttttccaacagagaaaatggtcatgcctgtt

SEQ ID NO: 303 - DNA, 1000 bp, mus musculus
agtcactcaagtaatgacatggcagccttttattaattataaaagcttgaatttagctggatttctcccaactacttcatataacttaaattgacttgtttatactaatctatattttgttttatggcttattacctctatccacagtaccagcacttgtttcttcttcagtgtctagctggcaaatttcctctgcccttagttcctttgttaacctggaagtcctgcttatccttcctgtcttgctatatgccatcagctctttattaaacaaatcagaagtgatggaggaagtgtctacaaaatatgatgcaactgtaagaatagcaataaccgagctgggtgtggtggtgcatgcctttaatcccagcactcaggaggcagaggtcggcagatttctgaatttgaggccagcatggtgtacaaagtgagttccaggacagccaggactatacagaggaaccctgtctcaaaaacaaaacaaaacaaaacaaaacaaaacaaaacaaaacaaaacaaaagaatagcaataaacaaagtttgggctctaatcagatatatgccagtacagaaactaccatttgactaatataaagaccacatttacactgtgtgcaaaagctacccaacatttgtttatttatccatatttctaaaacattcagagaaatgctcatttaacacatgaacacataggttttgtttttttttttgggggggggggtcaaagccaggctttacagtcatttgctattgacaaaacagatattactatatttctagggccaaattggatttgaaagtatctcctactaaatatcctagagtgaagatgatgtgagctctgtgcccccaaagtccaaaacattttatattcatccaattgcttctatctttattaataacatgttccagattctggaattctagaattaccttcaattctttgcccttttgatatataaaaggccataagaaaggattctagtacatattattc

SEQ ID NO: 304 - DNA, 1000 bp, mus musculus
tattttattaaacagttttccatcaattcctccattcccatattgttcatgctctctgcagccttctttatcccagcagcacaaacctgctctctgattcatgtcttctcctagcaggagcattcagcatcggatgcttaaactctcctagcagtccagaaactgagagagagattcctacaaacctaactggaagcccatgtccctgggtcagcctgagtgtgtcctagccataagccatggactgcagaaatatgctatgcatgccaaaccagcaaaatcttctgtcctagttccaagcctgtgcagctgagggagaaagcacggggttggcttggcttggcttggcactgcttggctaagaaatcaattcttccagccttttaagcttaaagagaaagcgtttgtgttccatttggtaatcttcaattaatttttaaaattgagttcttgcccaatgttgggtgcaatctgttgaattatttttctcattaataaattctggtggaaggttcacaacccacctcaatgttttatgtttctgaaaaaaaaaaataaggcacacacacacagtctttatttgatatgtcttaagcagctcaatagttggaatactgcctaacatccacacgattaatcccaaggtattacttattaactttatgttctaccttgtttactctgaacccagaagattgccccactggcccatgctctgagtcaggcaccccctgtaccttcccatggcagccgtgcctctatgttctgctctgttaagaatggcatctctctttcctccttctccctgccccaaacctgggaatcctaaagtactccctcagtcttccctgcccagctattagatgttggcatatttatacaccaatcagaaccaattggaggcaggctcccagatgctattacaggcactctcatacaaacttttttgttcttttgtttgtggaacatgatcagcattcataatacaggcatctacaga

SEQ ID NO: 305 - DNA, 1000 bp, mus musculus
tgttgctgggttggtgttgggccatagggaagcaccagaaaacggcactggggatgataaagcacagtctgaagtggggcacatgtcaaactgctttgggggtccctgggcctgttatgaggccagggctacctgtttctcaggctcttcgacatccagggaaagttctggctggtcccaacgtgattgcctttggcttgatgggcagcaggcttgagcttggcttgtggtagtcatggctttgggagtgcagagaggccttcgatgggagataagacagcagatctgtcggaaagggaaatttctgtgctgccccatggtagatcctgatgaaaagagctcatggtttcaaggcatttattgtcatggtggaaagtgaatgtgtaaaaccatatcctactcctcagagtgagcctaaggttaattaccttttgcagggaggaatgtctgagaaagaaagcttattggctaaggcctctgggcttctagatacctctttaaaatggagatatatcttgagccttgtgaacactggtcatgtccattgcacgtgaaggggcttggggcattgcccttacctgactgatagcagcaaatctgtgggaagctgtggatagtgacaggggtctggtaccaaggaacagacaaagcacctaccatcagttcagagtctctggggccttgagccttagctcaagcatgaaccaagataactttcactgccccacataggtacatatctttaaacctagtattgtggagtcaaaaacagacattcaaggactcgctgtccaatcaacatcgacttctagttaggtccgtgtgtagagaaaggtcctatcttaataaaagggggcagggtagaccaatacctggtgaaaattgctcatggatgcccttggctaccacatgcatgtgcactcatgtgtacacaagccctacttagaaagtgtcacttggcaattccttactctatgggtttcttgtattatcccttgga

SEQ ID NO: 306 - DNA, 1200 bp, mus musculus
ttgtcaaaccatcatgtgtgtgtgatgtgataggccaagcaaccccagtttttctgtggaagcccatgtgtattatagagactggtagctcacagtagccttgagagtcttaatttatcttacttttataactttctgattgtggtaggcatgcagccttgctctctgaattcagggcagtaggatattgcctgctttattgagtagcagaggttattagcatctagacaataaggttgcatctctggggcagcagaaagcagcactttggaagggcctaggaatccccccaatttgatgctcatgggcttttccatttggtgagcaatcatatggggggcatagctgtaaattttagctcttgtttcaaccccggaaattaccctttgtaatcatatcccactgcatgctgtttgaggaaaaaatctacttgctaagaaacaattcactgaccttcctagtctaaagggacaggcatattttttatttgggaacctaaaattaattttgttaaaagtgaatttttgtcccacgttgggggcaaatatattgtataaaatagttaatgttaatcggagacttctgtcccttcttagatcatccagttcccagaggggggacaaagagaaacagaagttttattcttataataagccttaaaaagctctagagaagtgcagatatatacccaagaatgaaaagacagtgaagtgagagtccacagccacaggagtgaggagatcctttcccaacatacaaggtcatgtgaatgaaaacaattagcacaacagttggcgaagaaaggatgttggttactcatgcttgcccttattccagtgtcaagtacactcccatttctggaatccatctgggctcacagccttacattttatattcttctgaatctgtgaagcagtcaaaattttgcccattttattgatgagaacattatggtttggagagaataaggaaattgctcattgccacagagatgatgtgaattaacaactgatattctcttcttagttcttcttagttctagttcttagctcttctagttcttagttcttagttcagatgtgctaagattgagtcatcaggtcgcctttctcttgttaatgaagtacagcaacagttaataatcctcaacaaagagtgagggccatctctggtcaagggagggtttttttttgttttgtt

SEQ ID NO: 307 - DNA, 1200 bp, mus musculus
ctttgtgttttctttgactgttgtgtaaataccttctgtgatatcttctaagcctgggatcctctcttctatctcatatactcttttggtaatgcctgcatctgtagctcctgatgtcttttctaggctatctgtttccagggttccctctatttgtgatttctttgttgtttctgtttccacttttaggttttgggaccattatgcttaattccttcacctgttttattgtgttttcttgtatttcttttggggatttattatatttttctttagggctattacctgtttgcatgtgttttcctgaatttctttatgggagttatttttatccttcttgaagggttctatcatgttcatgagatgggtttttcagtcagaatattgttttccaggtgtgttagtgtacccagagtttgctgtgtttgagaactgggttctggattctgatggtgcccaattacactgctttctgttccttacattcttgtgcttgcctctcatttttgtgctggccggagtctctctgacttgagcctgtccctacttggaggcagttagagctctgtgacactggttagagcagacctccttggagatacacagtgctcactctgtttgggaagacctcctatgtctcaggttagagcaggcctcctatgtatgtatgtatgtatggtagacctccagggagacaggcaggctgtggtttgtgggaggacaggagctcccaatctgccaaggacagagttgcagtctggaaaagacatggtgttctggcagatctgcccctggcagatttggaaaccagaaggaagatgtggctctggcagaatggataggttataggtagctgggttccatggggtcccagttaagataggaattgaggtaaggtcccacctgtgttcctggttaaggcagacaggccagctgtgcactgtggtagaggggcagatgaagggacaaatctatctttaagggaaaaacaaccctatcttcaggaaaaaaaaatgccatctataaaagtaaaaacctatttctatattctttttgttccgagttgttgttgtgattaactcaggatatatgatcacattgtttttcaagcatcttttcaaaaatttcaagagtccacacaagtgcaaacatacattcaaatcataaattgaataagaaacaatggcagatgtttacatc

SEQ ID NO: 308 - DNA, 1400 bp, mus musculus
tttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatataaacaaactcaaagacgaattttattttaatgaaaggatcatgaactcaaacttacatagatcttcatattcttctaatttttttcttgtttttgaacatatgtgtatgtttataatagtgatttaaattatttcagtaacatataagatctgtctgtttctgagctcatttccataggctacagaaggaaatacagagacaaagtgtggaccagagactgaaggaaagtccatccaaagacagccctacttagggatccatgccatatacagctagcaaaccgagatgttattgtggattctgagaaatgcttgctgatagaagcctgatatggctgtctcctgagaggttcttccagagccttacaaatacagaggttaatgctagaagccaacctttggactgagtgtcagttctgatagaggagaatgagaagggactgaagtagctgaggggatttgcagccccatgcagggagcaaccgtgtcaacagaccagacccccaagaactactgggtactggaccaacaaccaaagaatacacatggaggtacccatggctctggccacgtatgtggcagtggatgggcttgttggatattagttggaggagaggcccttgggcctgagggtgtttgatgccccagtgtaggggaatgccagtgatggaagacaggcatgtgtatgtggttggaggagcaccttcatagaggtagagggagtgagagataggttaggggtttctgaaagaaagtactagaaaggaaaaaaacatttgaaatgtaaatacagaaagtacctaatatttttttactgatataatctgtaataatgagcctaccctttctttgttccattgttcttttcattttgtaaaattgttttagctgattatacttttttgtatatttatttatctatttttgtgcttttttgtttcattgattcataatttcatttagactaaaactacattttatgattatttttccaaaagcttgaaagtaaagtggtgtgatctttaatgtccatatttttcttcatatttttcatggctatatatgtccaagtcattttccaagttcagtagacaaatgacctcagtgaaat

SEQ ID NO: 309 - DNA, 1600 bp, mus musculus
actgagattctctcttccatcccttgtattctgctgctgatgctcacatctatggttcctgatttctttcctagggtttctatctccagagttatctccctttgtgttttctttattgtttctacttccatttttagatcctggattgttttgttcaattctttcaccggtttggttacgttttcctgtaactctttaaaggattttttggttttcctctttaagggcttctacctctttccctgtgttcacctgtatttctttaagggaattatttatttccttcttaaagtcttccatcatcatcatgagaagtgactttagatccatatcttgcttttctgatgtgatgatgtatccaagacttactatagtagaagtgtttggttctgatgatgccaagtaaccctggtttctgttgcttctcttcttaagcttgcctcctgccatctgattatctcaagtgtttgctgccctcaatatagcttattggagcctgtccttcctataatcctggttgattcaggactcctcagagtccagctttctctgtgatcctgtgattccgagtgctggtgaagctgagattctgggtgtgtcagagttattggcaatcaagcttcctctgagaccctgagatcctggtgtgaccaagctcctgttatcctgggatcctgaaatcctaagattctgggtgtattacagctcctggaagtggtgtcccctctggggactgtggggctgtctggtatgttcaaaaccaaggtataccagcactgatcagaagaaactggagctgctagtcaggcagagctcctgtgtccttgctcctgctgtcataggcttgtcacaattggatgggaacagacgttgtgttccactcaccagtgatcttaagatcctgggcatgctagggtgcctgaggcatggagagtcctttgggaaccttggaaccttctgctgagttcctacccaaggtggcctggagctggtgctgactggaagggcgtgcttcctgtttaagagcttctacctgtttacctatgctctcctgtatttctttaaaggagttattcatatccttcttaaagtcctctatcagcatcatgagatgtgattttaaatcaaaatcatgcttttctgatgtgttggggtatccaagacttgctttggtggaagaactgggttcttatgatacaaagttgcctttatttctgttggtaagttcttgcagttgccttttgtcatctagtaatttctggtgttagttggttgggctgtctctggccagatcttgtccctcctgtgggtctgtaagcctgtgtcagcactcctgggagaccagctcccttctggtgggacctgtgtatagagagctgtggaatagtcctagccccttggtggaaattgcaactggcctgactttgttcttgaggtatgtttcttatatgcaacaaaatgctggatcttgtttacatatccagtctattagcttatgtctttttatgggtgggttgaatccattaatattgagagttattaaagatagatgactcttggttcctgatatgcttgttttgttggttgctctatgtgcttg

SEQ ID NO: 310 - DNA, 1000 bp, mus musculus
taatccatttcctggtttctcctctacaactcccctatccctttcccctccccatgcttctatgagggtgctctaccatccacccacccacccacccacccacccactcccacctcaccatgttagcatttctctacaaatggccatcaagccttcacagaaacaagggtctctcctcctattgattccaggtaaggccatcctctgctacatatgcagctagacccatggcaacttcttcagctccttcagtcctttccctaactctgccagttgtgcttagtccaatgactggctgccagcatccacatttgtatctgccatgacctggcagagaattttcagagatagctaaatgaggcttctgtcagcaagcacttcttggcatccacaatatagtctgggtttaatgcctatatactggatagatcctcaggtcggggtagtctctgtatggtctttccttcaatctctgctcgatgctttatccctttatttcctttagacaggagcaattctgggttaaaaattttgagatcagcgggtggcaccatcctccaaacaggacatttcataacctctggatatggactgtatagtttttcctcgcatttgttgggtatttcagctaacatcatctctgttgggtgctgggagcctcttgctttcctggcaactgggactttgtggtggctacccctatttaaccatatgccattgctacacacctctgttcaattttcagacactgtatatcatgcccatctcctcctctgatcctgcctcccctttatccctccctcaattctcttcttcccaagttcctcctaccctctaactcctgtgagtgttttgttttcccttctaatagagaaggactgaataatccacacttttgtcttcctttctcttgagcttcatcaggtatgtgagttgtatttctagcaccacattgaagttcacagccttgtgtaacttcatttccagggaatacaatacc

SEQ ID NO: 311 - DNA, 1200 bp, mus musculus
tttaaatttaattttatttttaatttatattttacacaccatattcctttccctgccctccccatccaccctctaactgctccacatcccacacctcttccccacgtggatgcccccacaaccccaccccagttgacctctaaactccctggggtctccattctcttgagggttaggtgcatcatatctgaatgaacatgtatctggaagctctactgtgttttggggtctttatatcagctggtatatgctatctgtttggtagcccagtgttggagcgatctcagaggtccaaattaatttagactgctagtcttcctacagaatcgcttttctcctcagcttctttcagccttccttaattcagcaacaggggtcagctgcttctgtcctttggtagggtgcaaatatctgcacctgactccttcagctgcttgttaggtctttcagagggcagtcaggataggtcccttcttgtaagcattccatagcctcagtaatagtgtcaggccttggacctccccttgagctggatcccactttgggcctgttgctagactttttttcctcagactcctctccatttccatccctgtaattctttcaaacaggaacaattataggtcagagatgtgactgtggaatggcaaccccatccctcacttgatgtcccatcttcctgctggaggtgggctctgtgaattccctctcccttctgttcggcatttaatctaaggtccctccctttcagtcctgggagtctttcacctcccaggtctcctgtgcattctgggggtgtgttcccccaacctcctatttcctgatgttgcctgcttacattctttctgttggcccagagagcttcagtccttttcccttacctaataccagatcagggtctcctctccccacactcttccctaccctgtccactttccctcgcaggtccttttctctctccccacttgtgattgcttttttatttttattgctacttcataactgtaacctactactacaaattgtattacaaatacctgatatgcaagatagttgatatgggacctctgaaaagactcactgaactgcaaactctcagcctgctgctgattaagaaacactgctctattgactgtatcctttgccttaaaggaaattttctgtttcatgagatctgatttattaattgttgattttact

SEQ ID NO: 312 - DNA, 1400 bp, mus musculus
tttttctttaaggacttgtaactctttagcagtgttctcctgtatttctttaagtgagttattaaagtccttcttcatgtcctctaccatcatcatgagatatgcttttagatctaggtctaggttttcgggtgtgttggggtgtcctggactggacaaagtgggagtgctgggttctgatgatggtgagtggtcttggttcctgttagaaagattcctacatttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcacagatatcttgtgtttggacctcctcctggccaaagaagaaggcccaaaacaggacctttctcagaagctgtgttgctttggcaggtcccagaagctgtcagcttctgtggtgcagactctcacctgtgcagactaaattcctaagtttggtggagtcccggaaccaagatggcacccactactcctgaggctgaggccgcctcctgagccaggaggacacctgtcctctggtccggatggtggccggctgtctgcggcccgcaaagggtgctgcctcagaggctctgtgcctccgcctgtcccagaagctgtcttgttctgtggcgcaccctctcacctgttcagactaatttcctaagttctgcggagtcccggaacccgagaaaatttttaagaagaaacaggctaacaataggtatgacaaaacaacaaaaaagaaactggctaacaaaacatgtccagtctcttttcacataagtatggaaacagcagcaagtcgtgcttattgtctctcatatttatcataccagtaaccactctgaatgttaacaaaataatagaggaataaaaaaagaaattaaggacttcttagagttcaatgaaaatgaagccacttcatacccaaacttatgggacacaatgaaagcatttctaagaggaaaactcatagctctgagtgcctccaaaaagaaactagaaagagcatacattagcagcttgacaacacacctaaaagctctagaacaaaaggaagcaaattcacccaagaggagtagacggcaggaaataatcaaactcaggggcgaaatcaaccaagtggaaacaagaagaactattcagagaatcaaccaatcgaagagctggttctttgagaaaatcaacaagatagacaaacccttagccagactcactagagggcacagggaaagcagtctaattaacaaaatcagaaatgaaaagggaaacataacaacagatcccaaagaaatccaaaatac

SEQ ID NO: 313 - DNA, 1400 bp, mus musculus
ttgggtcccatgaaaccctcaccattctatgacaagatgttagtagaccagtcttgagtaggtcatgtgcatgtaattgtttctgtgctgaatataccgccagggccaaaaaggggaagtgggcgggtaagggagtgggggtgggtgggtatgggggacttttggtatagcattggaaatgtaaatgagctaaatacctaataaaaaatggaaagaaaaaaaaaagagatagtatcacacaaaaaaaaaaaaaaaaaaaagaaaattaggttctgatggtgccaagtatccttggtttctgttgcttctgttcttttccttgcctcccgctatctgattatctgaagtgctccttgccctcgatatatcttattggagcctatccttcctgtaatcccggttgagtcagaactcttcagagtccagctttctctgtgattctgtgatcctgtgatcctgagattctgggtgtgtcagagttcttgtcagccaagcttcctctgtgaccctaagatcctggtgtaaccaaactcctgggatgatgggatcctaagatcctgggtgtgttagagtgcctagaagtgatacctcctctggggctgtggggttgtctgctgagtttgaagccaaggtataccagagcagactggaaggaactggagccactggctgctgggttcctgtgtccgtgttcctgctggtctcaggcactcctggtgatgtcagaacagatgctgtgctcgacttaccagtaatcctaatatcctgggcgtgctagggtgcctggggagtggagactcctctgggaaccattggaactctctgccgagtttgtgcccaatgtggtccggtttactggtactgacgggaaggaacctgagctacacatggcatacatttcctgacagtaggtctgatagtaacttccaaatggctaataatcattggcattggaaaatatggaataattttgttaatttaaaaaagatgatcacttatgataatgatggatgatgtgcctggcttgagtagaatgtcatttaaatgaaatttcatagcaatgaagacctacttcaacaggtcttccttgtaatctgggtcaatgcttgaagcaccttgaattcatataacatttggtacaaggtgatatgtaaataaatgcccatttgaaaattaaaaaaaaaaaagagtaaaaggacacatcctacttggaaaccagtattttgctttcaggaagcattagcataaacttttttatggaaaaatatgttttgtgccaacagacacatttactaaaagcccagtatttcagccaactccaagttggatctcaagagctatctattggggtatcctccagttaagcaccatttgcagaggaaaataaaaatagggtggaa

SEQ ID NO: 314 - DNA, 1600 bp, mus musculus
atgtggagaaagaggaacacacctccattgctggtgggattgcaaggtagtacaacaactctggaaatcaatctggcagttcctcagaaaattggacatagtactacagaaagacccagaaattcttctcctgggcatatactcagaagaaattccaacttctcataaggacacatgctccactatgttcatagcagccttatttataatagctagaagctggaaagaacccagatgtccctaactagaggaatggatacagaaaatgtggtacatttatgcaatggagtactacacatctattagaaacaataaatttatgaaattattatgcaaatggatggatttggagtttatcatcctgagtgaggtaacccaatctcaaaagaactacctgatatgtactcactgataagtggatattagcccagaatcgtagaatatccaagatacaatttgcaaatcacatgaaagtcaagaagaaagaaaaccaaaatgtgaatacgttgttccttcttagaacatggaacaaaatacccaagggaggagttacagagaaaaaattgggagccgaaatggaaggaaggaccatccagagtctgccccacccagggaaccaccccttaaacaaccaggaaacccagacattattgcatatgcaggaaagattttgctgacaggaccctgatattgctatctcttgtgaggctatgtgagtgcatgacaaatacagaagtggatgctcacaggaatccattggatggaacacaggtcccctaaagaacgagctagagaaagtgcccaaggagttaaaaggttctgcaaccctataggtggaacaaaaatatgaactaaccagtattccccagagcttgtgtctctggttgcatatgtagcagaggatggccaaatcggccatcaacgggatgagagtcttgtgaagattatatgtcccagtacagggcaatgccagggccaagaagtgggagtgggtgggttggggagcaagatggctagggggggtaggaatttcagatggggaaactaggaaaggggttagcgtttgaaatgtaactgaagaaaatatctaataagaaataatatagctggccaggcatggtggtacacacctttaatcccagcatttgggaggcagaggcaggcagatttctgaattggaagccagcctggtttacagagtgatttcaaggacagccagggctatacagagaaaccctgtctcgaaaacaaaacaaaacaacaataacaacaacaacaaaatattagagctaagattaaaaaaagaaaaaaagaatgaatcactgaccactgtccaaattttggctctgtgtatatgcacctatttcagtcagctgctaggtagagcctctcagaggacagtaatgctaggctcctgtctgcccccataacagtgtatcaatactaatttcaggtatttgttgcttccatatgggatgcgtttctagtttcatgacaagcaaaataatgaaatatactgcttaaataatactgttaaaatattcctgaaaatgtatgtgggttagaaacataaaagatagaaaagtagaatgcgaagata

SEQ ID NO: 315 - DNA, 1200 bp, mus musculus
gtgtatatatgtatggtggatgtgatagtgtgtgtgtgtgtgctgtgtggtctcagtcttgctttggtgtgcatgtggatgtcagaggacaacttgtgggaactgaccctctctgggacctaagaattggactgaggttcttaggcatggcaacaatgccattaccttctgagccatcttgctggccctgtcatctccctagggtaccaggggaatgttaggcagatccctgcaaaggccccgagataacctggctcccaaggccattatgctcgcacagctcatttaagtgctggaaactgctccgctcaggaatggaatgttccagcaagcccatttgattttcaaatcacttccctcagagctgtagtctcccccagagcaaaccctggccagggtttcctcaaatccaggggctaagctggctggctgctactgaagtgggggaagggcaccctagcctgtgctccctaccctcatcctagccccagttattatcccagttataaaaacctggccccatagagagagcagaacgccctgctccactgtgacagatgccctgggtgcttgtgtggtctcacttgcatttcttactctaatcgtctccctcgggctttccgtacttgtggaggaggaaacttgggaattcccccctcattcctgaattgttcgcctggaacctccctttaggacaaggccaacagagggccccaggacagttgggtgcaacccagttctcaagccttttaagctcgtaggaatgttcccctctgccatctgaggcccaacagggaccacagagcagtcctacctctgagctcagagggcaggtctcagcatcaggagatgagatgtgcacgcgtttatgcaagctaagcaagggacaggtttgtcccttccctcaaacctgtccacgagcagttgatccacctggtttagggtccctggccaaactcttccttttccgacaagatgcatatgtgtgtatgttcccacggagcccaggctaaccttgaacttgctgtgtacttgatgatgaccttgaaaccctcctgcccccacctgctgtgtactaggactgcaggtgtgcagcatcacacttggtttaaacaatgctgggattgaacctagggccacatacatgctaggcagcactctaccacgggaactctatactcagatcacagggtttttgtt

SEQ ID NO: 316 - DNA, 1000 bp, mus musculus
ggaaagaaagagagagagagagagagagaggagagggagggagggagggaggggaggggaggggaggggaggggaggggagggaagggaagggaagggaagggaagggaagggaagggaagggaagggaagggaagggaagggaaggaagaaagaccaacagacatttattgacagatgcagacctgtgtgtgcagagggctccctcacaacatacacccatgagtggacacatgggatacctgcacactcactaggtgttcatggagctatgcacagtaggagaggagggcacatgtagggagaaaccttgatgtgaagtcaatgtcccccaccccacagccttagagaccagcctcaaggcctatgctgcccccaggaccccaggcctttgcctgaactgtctctgtgtctccccaaagctcaattgtcctctccttgaggcacccagagcctcctcagaattcccctggtcaggaatgcaccagctaccctgccttaatggtgtacccccagatgctgggacacttgatcatcagcaccacacagtcacttaaggacccaagccaatagaagctccaccaccagtcttgccagctgagccacccttagtggccatggtagggaagagggacaccggcgggtcaagcctcacactaatgggaagtgagtgaattgtacctctgtcttgttgactggaattagtcacaaggtgccacctcctctcaggggccctgggaagttcaatgctccatgcttgctgtcctctgatgctgcccaaggtgaggagagaaagcaggactgggaagaaagtgcttcatgtacattcatgaaacccagacctcgtgttaaaaaatgggtgccatgacatgtgctcttgtcccagtgctggggaggtgcagatagctgacctgagattctggacagctcacagagccgacttgctgagttccaggtaagagactccgtttcaggggggggggggggaaggaaaactaaag

SEQ ID NO: 317 - DNA, 1000 bp, mus musculus
acctgctcctgcagccatgccttcaccaataacagacggtatccccaggaaccctgttcctgtgagttgctttcatcaaggtttaatatcacagcaaccggaaagtgcccaccaagacaacaattccttattttatattttctttttgtgacactgggcttagctacaaagcccaggctggcctctaattcatgatcctcctgcctcagcctccggagtgttgggattacaggtatacatgatcacacctgcttagaatgtacatgacgaaagagtgaattttggggttagcaagaaagcttagtgagtgtctccaagcgtgaaaagttggcattcgaatccaggacccacgtgcagtccatgagagagagaactgacttgtccctgttgtcgtctgacctccagtgtggtgcaacatgcattcacacacacaaacacacatacacagatacacagacacgcaccccaaaattaataaagagaaaaggtttatttttgactgatagcttcagaacttcactccatggtcctcagggcctgaggtgaggcagaggaggtgaggtggtgcgaggaacagcagaaacggtttctcacgtcccggcaaccaagaagcagaggaaggccggaagggagtgggactctaatatctcttttaaggacacacttccggtgacctaacctctcttgctgagctcaacttcccaaggtgctgtaggctgagggtctgttctttaacattcaaccctttcagagacactcaagaccgggtgctggggagtagctcagttggttgagtgcacacctctttcctgtgaaggcccaagccccatcctcagagcctcataaactaggcaaggtagcttgcacctataatcccagcaaggggaggcatgggaagattagaagttcaaggtcatcctaggctacatagtgcgttccaggccagcctgagctacaggagattctatctttaaaaaaaaaatgttggagttggagagac

SEQ ID NO: 318 - DNA, 1200 bp, mus musculus
acatcttctgggaagtgttttctgagagcacagaagctgtgttccagagatcaaggttgtaccttgtgctgtggctggacttaataatgtgaaagagttacccaggtggtactggttctgaaggcatgaaggggttatgcagagcagctgagcctcagcactatgaggggccatggaaggccattggtgaaggtgcagcctcagttgcaactgatggcccaggacagaaggggtcatgcaaaggagttgaggcttggcaccatgaagagagcctatgagaggctgttggtgaagcctagtttcagcagaagacagcagtgtttggagatgccagtaccatgagatgactaccaagaacagcagcagcagtgaagtacaggcagctggagcctagaagacaagccgtgtactacaaaggacagggctggagaagtgacccaagcccttggaggagcctagaagatcctgagttggatcccagacattggacagttggagtttaatttttgcttttgattgtgactgtgccctgatatttttccctcttgaaggaagaaagtattttagtggagcccacagttaagagactttgaattttcaaagatattgggcattttaatgggactgaactttaatatacaagattgtgggacttttaaagttacttaagatcttggggatgaataagaactaagggttgaggcttactagtgatgtgtttgtatgtcaagttgcaaggggtcaattgtactatgtcaacttgacacaggctggagttaccacagagaaaggagcttcagttggggaagtgcctccatgagatccaactgtaaggcattttctcaattagtgatcaagtggggaggtccccttatgggtggtaccatctctgggctggtacaggctgagcaagccaggagaagcaagccagtaaagaacatctctccatggcctctgcatcagctcctgcttcctgacctacttgagttccagtcctgacttccttggtgatgaacagcagtatgaaagtgtaagctgaataaaccctttcctccccaatttgcttcatggtcatgatgttttgtcctggaatagaaaccctgactaagacaaaagggtcacaacagacaccaaggaaatccagagaaccataaggacatacttcaaaaaactgtactccagcaaactgaaaaacctaaa

SEQ ID NO: 319 - DNA, 1200 bp, mus musculus
aagagacatacctaccagacagtgtggatcttgcttaaacacagatcctaataaacctatgtgatgtaggcacctttggaatatttgagtgcctgtgactataggctggctattagacactcgtaaggaacgtatgctgcttgaacacaggtatgagggacttcacacatgaattatgtaagtgagaaggcatctttgtgttgagaggcacatgctgaaaccgttcggcagagccagggtggttgggaatttttccccacaaaaaataaaaatagacgaagcaagagcggcacccgttgttgcatctaagtgatgggtgttgggagtttactgtgctgtctgcatgagtcaggatctaccccagaggagaaaccgccgggagatatttaaagcacacagcctaggaggcagaattctggttacacagtggatggagaccggaagccaaacaaagaactcagagttgagattgtcactgctggcctgggactgagggcagagccagaaggtgctgccctggagccctgccctcgagccaggggtggggtcactgagtgggtacacaagtaggcattctgggtgtgcagtacctcagtgacagtggggatactacctatggtgtctgacttccatttttgctggtattgcttctcaggccccattccacagcctgcttaatgtgtggtgctgggactccaacccagggcttttcgaatgttaaacaggcattgtacccactaagccagacctccaccccatgcatgcctcttagagctctcactcataaagcactttgcccatggcatcccattgcctgaggtcaccatggagactccttacatctcgtggagagccttgaacagtgcagctcttggggcagaggcactaccttcagcactgtttgacagcagccagcacttttagatcagtcagtcctctctggcaaataaagcaagggctgtactgtgtcaatatggcctgtcagtgagaacccagagtgagtcaacggctgttgcccagagccatcagctctgaaagcctggggagatttggcctcatttcccacagtggtcctgctggtgacctaccccaaatccattttctcagtgttcctatgaataaaacagagactttgttcaggtcgacagtgtacctacccggcagctaaaaaaggcttgcttccttggtactcttgaagtt

SEQ ID NO: 320 - DNA, 1000 bp, mus musculus
gcatgtgggccaacatggtgctggaggaggagcttgagagctctacatctggatctgcaggcatcaggaagagagagactgaccctggcttgagcatttgaaacctcaaagcctacccccagagacagtttctctaacaaggtcacatccatcccaacaaaagcacacctcataatagtgtcagtccctggtgaccacgcgttcaaatctatgagcctgtggggactttcctattcaaattaccacagtacccgagaaacagcatgtgagattgttctctgacctctacccatacatacaacatacacgcaccagtgcattcacacatacatgaacacaaacaggacattcgagccagtggggagcagttcagtggaagattgttgtcctcggatataccggattctaagatatactgtgccccatcatgcaaaagagatttagaatatttgatcacaagatcccttatgccctttgccagcaccactctttgcttagcctggtggcactatgtggggctgggaattcatggagcatgtctgaccctggacatctagtctcgaaagagtggtaggagggagtgggaccactcccctgccccaggcctgcgccctccacctttgtgcacaccagaggaggtcctgtagtcgcagccaggttaaacttcctcttcccttataaggtcacatccagcagcccctggaattcctcctcatgcaaatgaggcatccaaggtgccccgaccccagccaataatggaaacataccctccaacccccctgctcaccatcccaaaggtttaaatagccttggtttccccagttaaatgagctgtctcactgaagctgcctctcttgtgctctcttgccgcctgaggtctccatcgcccgcccggttgttccggtttcccttcccacctctggatctgccagttgtggatctgccagttgtggttgcaggaatcacactgtgaagtgaaggggagtgggtgagaatgaca

SEQ ID NO: 321 - DNA, 1000 bp, mus musculus
cgaaggctacgaggtgctcaagttcgacgacgtggtcaccaatcttggcaatcactacgaccccactacaggcaagttcagctgccaggtgcggggcatctacttcttcacgtaccacattctcatgcgtggcggcgacggaaccagcatgtgggcggatctctgcaagaacgggcaggtcagtgactttctcccacacacccctccctacctttcccggcccaacagagtccgcagaccgttcattacaggcgcccggaaccccagggaactatatactgtttcctgccactctccagcgccccagcaaactctggggtcgggtgggcgctggaccacatgcatcgcccagcttccctgcgtactatgctgtcctttgcataaatgtactgggcgtttgagactggaccccgggtgcacagtgaccctggcacctaaataggtctccagtccccaatcgattgagtcatggcctgaagtggctgggctcctagaaaaacccagttgtctttatcactgtgattgcacgtgggccatccctttccctccagtttattcatcttggccttgaccccctaggacctttacatactgggcaagtaaaccccctttccttgactctgctaccaagagaacttggagccgaggagggagtgtttacactgaagtagcaggcagggagcctgcaaagggatgggcgagggaggccaggcttggactcaggaagaggtgcagggtcccacccgctcgctcttctggttcgccccgcaggtgcgagccagcgccatagcccaggacgcggaccagaattacgactacgccagcaacagcgtggtactgcacctggattcaggcgatgaagtctacgtgaagctggacggcgggaaggctcacggcggcaacaataacaagtacagcacgttctcgggcttcctcctgtatccggattaggggcctagagggcgcgcgcgaggccgggtggcttcaggccaccccatcc

SEQ ID NO: 322 - DNA, 1000 bp, mus musculus
ccggccaggaatggtggcctcctgagcctgctccccattttgtgaggttgactaagttgatcttctgtgaatgttttgtgcaggcagttgcagttgttgtgagatcatgagttatcagtcttgtcatgtccagaagacacggcttcacagcagtgctgtgtctcagacaatgtttctcccattcctccatggcgctccctgatccttgggcaagggtatgtaatatagatttcctacttgtggctgagtgctctgctgtcagccttgtctccgagtgttctacatatcatggttctacaatgggggaccccaaagtgtcaccctggtagactacaaacccctgctggaaaactcagagcagatgcccaagctcccagctcttagctttggacctttcagcaagcctcagacacagcattgctcatgacagctacttcctgtcagactgaagtcagctacagcctacatcctccccctcttcaccactacacctgagtatgctttgtttgcttttctgtatttgtgtcacattttgtgactgataaaaaaattccagcatacagtcccagactcagttcatcagccactcaaaccagggtgttactttctattgctttacttaaccatgtataagacagggaagtaagggggcataaaatagcaacttttggttgaacttggggttcagtctttaagataagagtctgctgactccatgtcttacaataaatctgctttgtctgcattagtctgggttctagtaagtgctggtatgcagatgaacaagcagtattaggcaaactactaacttgtacacagttgtagttgccataaatggaagaacagtggatggaacccaattcaacatgtgatatacatgtcccattatcaagctagtaagcccaggaaagaagctcagttggcaaaatgcttgctgactggtgtgaggacttgagtcctggccacagaacatatagaggaaaaaaaatcaggcatggtg

SEQ ID NO: 323 - DNA, 1000 bp, mus musculus
tttgttcaattccatcacctgttttgttgtgttttcctgtaattctttaagggatttttgtgcttcctctttaaggatttctacctatttagcagtgttctcctgtattctttaagtgagttatcagtgccctttaaagtcctctaccagcatcatgagttatgattttaaatccaaatcttgctttttgggtgtgttcgggtatctaggactccctgtagtgggcatactgggttctgataatgcccagtggtcttgttttctgttagtaagattcttatgtttgcctttcaccatctggtaatctctgctgttaggtgttctggctgttgttcctgtgattctttagcctctgtcagctctcctgggagtccaactctttcctgaatcccagtggtcagagcactctctgcaggcaagctttccttttgcatggaagatatacagaagtctgtagctcagatccacctcctgagtcctggggtcagagccttccctggaggccgactctcctctggtggggaaggtgcccatgggtctgggtctcagatctgcctcctggctgaggatgaaggcctgaagggaccctgtccaagaaactttgttgcttctgtcattcatgtgctctcctgcttagactggtctcagtgatcccaagatcctgggtgtactagggcctgccgagttcatgcccaagatggtgcggggcttgtgcctactggaatgaaccccagctgctggtcaggcaggttttctttgtccctgttcctgctggcacaagactctccgggattttttggaactgatgtggcattccactcaccagtgatcccaagatactggatgtgctagggcgcactgaatttgtgcccaagatggcctagatggttcttgaggtagctgcattcccacttttctgaaaactgccaaatttaattcctaagtggttatacaagtttgcactcttaccaaaaatggaggaatgttccactaggtctgt

SEQ ID NO: 324 - DNA, 1400 bp, mus musculus
aaaaaaaaagaatccggtaacctcattgtaccttgctggtgtgtcacctaacttctattttcttctgtataaaaattctgatgctcaatttgacaaattacattcagatccacactcccttgtgtcagtttgtcacccctccttcttgccaactctttgccctcctgcaacaagaaacctgttccatgcagataggaaacccaaaagaggttagtctgtggcagaatttcatctaaggtccctccctttgagtcatgggagtctcttacctcccaggtcttggtctctgatgctatctggaaggtcccctcaatctcctatctcctgagattgctggtttccaatttttctgctggccctcaggacttcaaccatttttctctcacccaataccagatcaggttcccctcttcccacactgtgccctttccagtttccctcacaggtacttacttctctccccacttgtgattgctttcttctctctcccatgtagaagtgaggcgtcctcacttgggcacttcagcttgttgagctttttgaattctgtgggctaaatcttgggtattggacactttatttacttattttttggctaatatccacttattagtgagtacataccatgcatgccatttgaatccgagttacctcactcaggatgattttttttccatccatttgcctgcaaaactcaggatgtcctcatccttaatagctgagtagtattccattgtgtaagtgaaccacattttctgtattcattcttccattgtgggacatctgggttgtttccaggtcctggctgtcacaaataaggccagtatgaacacagtggaacatgtacccctgtggtgtggtggggcatttttgggtatactcacaagagtgatgtagctgcatcttcaggtagatctatttctaattttctgaggaacctccagactgatttccagagtggttgtaccaattttcaatcctaccagcaatggagtgttcctctttctccatatcctctccaacatgtgctgtcacatgaggatttgatcttaatcattccgattggtgtaaggtggaatctcagggtcgttttgatttgcatttctctgatcacttattttgaacatttcttaggcgcttctcaaacattcaagattcctcagttttgaattctctgtttagttctatacccaatttcttgattgggttgtttgattttttggtgattaacttcttgagttctttatatattttggatattaggcctctatcagatgtggggttagtgaagatattatttcccaatctgtaggttgctggtttgtcttattcactatgtcctttgccttacagaaacttttcagttttatgaggtcacgtttatcaattcttgaacttag

SEQ ID NO: 325 - DNA, 1000 bp, mus musculus
acttttcctaaatttgcattctgtttctccaatcttctgtatcccacttaattctagccacctgtctgcacagacggcgacttgctcacttctatgcaagagccacagacctggacccgacagatcagcccagttaaactgttgctgcctttttacttctctgggttgaagggaggttaaggaaacagagaaaacagatgttatttttaggcatttgatttctgtctctttcctctcctcctgctttagaaaacatgatatggtgcacattcgcctgaacattatgtatccgcatcacaaagacaacccctccccctgcatatcttctaaaacatggtatttgctatccaaatctttaggtagagaagaggtccaggctgcatgtcctgccttgcttatcctgtatgctaacttcctcatgttctccctgggacacagcaggaagcttcgataaaataggaggtaactgtctctgcagactcagtatgatgtcagaactatacaaaggggctttgttttaggccacctgttctgacagaacaaagatgtagcaagctagtgcactggatgccttgatctcaatgaactaattgctaaatgttttccatggacctaggaaatacaagaagaaagagtcacatggcaagctaatctggaagaaaataaggctggggcacttttgtttgggagtgagtggcatttgtcaataccaggagaagacatctgcctataaatttgcatttactttattttattatcacaatactgatcttcattggctggcagagaatctcagtgtacatcctgcctctgccttcccaaagtaggattacaagtgtgtttctggctttttgtttgaatgtaggggatttgaacttaaaatctcaagcttgcacaccaagtccttattgactaaattatcctttatctactgaaaaagaacatccaacataattgaaactttctggtatcatatgattaaaataaaggtagaaatgtt

SEQ ID NO: 326 - DNA, 1200 bp, mus musculus
gatcacctttaccaacatttctaatctaactaactgaaagcaaaataaaacaaaagacaataaaacatacttgaaaaaatgtagcaaaaatgctctccaagagaccaaacattaggtgtgaaggacagtaattctgagggagaaagcgggtttaatgaaccttgagattgcttgcacttactgactagagggacacagggaatagtgctcagtgaacattctagacataaccccgagatcacactcccttgaagtcattgaaggtgcagggtaaatgactttgtggagcacatagtggaaaggtgagaggtccatgggcagaagacttcagcgattttcacataaagaaactctcagagggttagggagggggctcaggggcttgttgagcaaacatgaggacctgagtttagatccttagcactcctgtacataagtaaatgccaggcgatgtgagcatgggttggttctcccactgctgaaaatgagcatcagagacagaagcatcacggaggtcaggtggacaatcagtttggctgaatctgtgagctacaagttcagtgagaaaccatcttaaaaactaaggtgtatctgtcttccatgtgtgtacatatggttgagcacacacacacacaaaagaaagaatgaagaaaaaaataactggagacaagaacagctctgcttctattacacaacactggctgatgtactcagaatactgtgcctcaacagtgagacaaaagcagacttacacagttgtctgagtaacaaaaggcagaggacaagctctttccaaatacctttagcagcatcttagaaggaattttaatgctactcatatgagtacaataataggcagtgtccagattttgtggtgtttactaaaacctttccgggaataaaaagcaagcttatttataaagcataatatggaaaaatcagttggaatatctccattaataccacgacaaaagtatagtgtacacagctatggaagaaaagagaaaaataaagtactgttggtattaacagcataattccaggacagagcagataagcacctgtgaaagagatatcaaatctgtataaagaggaagcacacagagaaaaagactggaaaggattagacagagaacagaactgtgggatactccacctgcaagcagctatgaatacctgtgtattttgaatccctaaagg

SEQ ID NO: 327 - DNA, 1000 bp, mus musculus
tgagccatcagataatacatttctgttccagggtgaggcccaagctgctacccttagccctctctgtgtagggggacctttgattgtggagtgcaagaggcgtaaatataggtgtgagattaccagtggtgggtggtgtgtgcgagggcccatcagtttgggttgattgtggggctcggcatattttcactgttcccaactccccattgatcgcagcatctgttcattcccgagtattgctgggctgtcggatacctgcagtcttggtcagctagctctcttattcagtcttgattccctttctcaaaccttccacacactgcctgctgttctttcctccagcagagcctcagttacacacgagctctggaaggcgactcgtcctctcagggctgctaagccctccagtgcctgcagtactctccaccttcctgtgttctgggctccgcccatctgcagctcttccttcttgaacttgctctgtgttcttctgtcttaacagctatggcactgagccttgatcttgcatctctttccagctactccctggcctcacacccctctcatcctaactgcttcaaaggacagccctacaatgactgtttctctgtttcttctcatctcctcttggaaatctactaccgcctgacctctgccttccctgagccaatgagatagttcccctaagtggccttcctggaatttcaggcttagatgcttgatccttcacagccttcatgttgccatgaagcgtcaaccacacccccacccgccatgcaccccaacttctccttccctggttccccttcctctgtccatccctcaccagctaacactcccagtggtctggtttcaaccctcttctcttctaacctccattgtccttccttgggcatatccctaccctgtgtattctcttcctggcaaggataaagatactctaaagggaaggacagatggcttggtgattaggaaccccagctgctcttgcagaaaactg

SEQ ID NO: 328 - DNA, 1000 bp, mus musculus
cttctccagtcaccatagcccattctctggtcacgcccactagggactcagcaactacccaggattcttttgatgcgagaaagtcagcgacttacagcttgtggttgaatcctccttgctgcccaattttgtaaagaaaacttaggagaatacgagtgtcccagtcactggaggagacggatgaggctatatccaaggacaaaccttcaggccccagcctagtccattgttagcttaacacaaaatatgtatgtgacagaaatattatccccatgtcagcaacctttgcagtacaggttatttgttctggaattcttgatttgcacatgacagtttttcctgtctttctatcttgcttcggttttttaaggaataaggaacagaaagcagaatgaagagagacttctgaactccttttgggacttggtcattcaaatgtgttgctggaacgtccccagcagcctgtgtggaacagtggggcattcatccttggggtgcaggagtgtgggctcctaccttccagccacacctgcttacctcaggccagcacagtttgggctgggcctgtctgggctcatagctgctgtcattcacgccagtcaatgctgttcttgtttctgaggtgacccaatctttctcgggctgcttgacccacattcccaaccctggtggttctctcttacttaaggccagacctgggccacttccgtgctctcattttgataaattaagaacagtgaaatcctctctgcagtccagctacaccttagtgaccctgtctcgtcctcctgcctcactggacactggcgtactttactccagagacattcctagttcagactaacacagccgtgcacctctcctagctcactcccacccacagaccactttcctggtctctcttggcctctaggttctgtcgcctgttatgtctggattctgctggcttctgtctgctgtgctttgttaaagtcccaaactgttcatttgactggctctc

SEQ ID NO: 329 - DNA, 1800 bp, mus musculus
tcttctgatttcaattaatataacctagaaactccctcatatatatgccctgagaattgtcttcttgatgttcttgatcatgctggtggttaatattagtcatcacagacacacaaggctgtctgtcctctggatgtgggccagcagatctgcctaatggcttttgcggtgttagaggcctgaacatggagtgctgagcacttgagtccctggcccggctgttctttatcccttcccttgctcttgttcatatctggtggattagggagctcagctctgcttccctaagatagggcagagttttatgcttgcacataatctcttttctgagaatattgttcaaaaaataggccatctattgtaaaggaaattagctagtaattaaattgaactggaagttacagtattggtgctttcatttggagacagtatgctctcctaattactttattgctgcagttaccctgactgagaattattattatttgtgtgtaggggagggtaatggatagtggtgggaaaggttatatttaataagttagataatgaattctggactcaaaattttttaattggcaaagggccttcttcaaggggaaacttttctttgtgccctcttctaggtctgtctgacagaagtcgccttagtttcattccaaagccattctgctttgtttttgccacctcgtgggactctttttggcaaagaacaacgtttctgcgtagataagaacagtgtagaagaaaacagctgacttggctgctcttcattagtgcagccatggtcacggctgggtgaggcacagtggtctcctggacatactccttcctaagtctgctcctccctccagggccttgagaggggagcagtcagaatacaggctagaccactccctggttcagcagcctgttccctatcagccttgcacactgtgactgggtgagaggagagctgaggtcaggaaagttgggaagggtgaagccccaatagagtttagatttaccctgcccacaggagatgctaagggaccagacaaccttggaggcaacaatgacctggatcctccatgtgtgtgttccttggctgtctcacatttctcttggctttatgatctgtttaggtaacctagtcctgaggaacaagaacaccatggcttctccactttgatccccattgtgtcagtatctttccattaagaatggacatttctctagatacttagggcctctagataaaccagctatattagctagtcttctcatcattgtggagcaccctaatggcacaggagttccttctgcatcatagctgaggggaagcagactgccatggtggggaacacaatggcagcgggaacaggaggcagctgctcacattgcttcacaatcaggaagcagaaaatgaacaagaaatggggccaggctaaaaaaaccttaaggcctatcttcagtgatctgcttccttcactgagactccacctcctaaagatgccataaccttcctaaacagtgcccccagctggggaccagatattcaagcacatgaagctggggtggggacatttcacatccaagctataacacttggctcaggagtggcactattaggaggtgtggccttgtgagaggaagtgtgtcactgtggggatgggctttgatacccccctcctagctgcctgtaagacaatcttctcctgtttgccttcagaacaagatctagacctctcagctccttcagctccatgcctgcctggatactgccatgcttcctgccataatgataatggactgcacctcaga

SEQ ID NO: 330 - DNA, 1000 bp, mus musculus
gctaagaatgagtgccatacagcagcccagcagcccctgactgtgtgaggggagtctggctaatgaggccaagtccattccctgcagctgaaagccaccctccacagctcaccacagtctatgctgtcagagaggaccggtaaaggcgataggtttgtgccttagtcggaaaccatcatcacaggcataaaaatagctccgagctggtgttctgaagctgtgaggtcagggacatagcagggtaaggagagaaacccttaaaatagacttgcaaaaagcgctttgaaagcccttgtggagaatacgagtgggagccagtagttcctatggctctcatgccaacctagcttagccccttgcctggaagctcgtggagaggttcatccatcacttgttcctgcagggagctactggagagtatcgccaaagaacacataggcactacagaaaagaaagcacagccaagcctgcccatgcccataggagcctgctgaaggaatgctcttatttcccttcttctcaagcaggagacacatattttagtggactactgtgaccgaaggatgaggagtgtctttggcatggtgtgtttaatttgtctttttattttcacaaaggaaaagtaattggaacatgttaagaaacattgatactgactttccctgtgaatcaaaactgtgaaaacgaaaagggaccaaggagaaaggtgttggatcttaattagtcagctctgcaaagggaaacaaggggaggatgtctgcgacatgctcatctctctttgtatttctgatccaccctctttcagggccctgctgctgcagctctctctgtggctcttacccagttctcagcctctgttcctggcagagccacaagtggggggaggagagatagaaacttaagcttgagttggtcaaataacgcttagggtattagttgttggggactttgactcttaatattagttgagaaataactttttacgggctagagagatgcc

SEQ ID NO: 331 - DNA, 1000 bp, mus musculus
ttccagcttggtcttctatctcagatgatccaagaagattttcctaatggagctccccttataatgcacccatttccctctgctactgcttgtacatcagagttaacggtccttcccacaccttcctgcagctgtctgaagcatccagtttaacacttaccatgtagaatagtgatggtgaacacttgctgcctcccagcagggaattcttaagagaacattagctctgagcactgtgcctggctgttagttgttcagtagacaattcagttagactgaatgaccagggtaagttaaatgctatgtgtggcagaattttgtgcaggacagtagggaattcagaagacctgggaatattccccatctcatgtgaaagttgtagccatggaaatttttaaacacagtctgctaggatagcccagtcttatctaccttgacaaaaatgtctggagtttaagaacaacccagacaaagagcatatgattttggaacacctcaagtaaaaagcatatgatcaacaaatgctagtgtagagaaacataagcaagaaaactgtgaattcacaagaataaccctggagagctcagattctctgtagcttttaaggcccagtcccagaatttggctattttccttgagatgaaggagacaccaaaagattttcattgtaaaacttagatgatcagaattataccccaaggacaatgtcacttgggaagcatcgaggatcctggaggcaagaagctaagttgcaggactcacagacactgagctgataagtgacaaacaggagtttgaaggtcagtggtagagtggcctgtggttctgagcagcatgatgggaggaaggtgctcctggcagatatgcataatcagtcaaggctgccacttgactgtccagctgtcagctctgccgctggcctggctggggctacagcagtcccgcttgtgtctccccagaatcattgatggaattacgtgagacatctccccacgaccag

SEQ ID NO: 332 - DNA, 1000 bp, mus musculus
ttaaactgagacaaagtttccaacttcaacctgcctccatttcatgccaaatttataatttttgtagtatgtgtgttgtgaaatacttagacttctctttccaccagagttgaagaatgatggagagccttgttttcctatctcaggtccctggggaaggtgtgcaggtgactgcggaccaggcggagcccaaagtcgtgctgtatggtgctttcacatagaagggtggacgagtcccatgtcgaactgtgatgagagcagccaacctccaaaggaaaggagctgtttccgcgtgtgtgactggcacagtgacctgttccagtgggaggtttccgactggcatcgctgccttctggttcctggggcccaaggtgagcccaggcctcgggctgtggaatgtgtgactgcacagcacggtctacagcaccggacagtgcgctgtcttcagaagctcaatagaaccatggtgtccaatgagatctgtgaacactttgctcctcagccccccacagagcaagcctgcctcattccttgccccagggactgcgtggtatctgagttctccccatggtccacctgccccgaaggatgtgggaagaaactgcagcatagaactcgtgtggccatcgcgccccctctgtatggaggtctgcagtgtccaaatctcacggagtccagagcctgcgaggctccagtttcctgtcctcttgggaaagaagaatattccttcagcctaaaggtgggaccatggagcaaatgtagactccctcaccttaaggaagtcgacctcagcggaagaaatatccaggattttagctctgattcaaacgagcaagtcaccctaacacatcagagttacaaagcacaccaccactcccagcctggggatgtagtgatagggtttcaaaccaggcaggtgtggtgtaccagaagtgatggaagaaacgccctgttaaggtaggatgtcctccctgcttgtctttcgttaatgtaggatatc

SEQ ID NO: 333 - DNA, 1400 bp, mus musculus
attagatccaggcatggaggtacacacctttaatcacatgctgatctctgcattcaagatcaatctacagagcaagaaccagaatagccaagcttaggcagtgaaggatttagaaaacataatgctagtgataatgtaatagtacaaggggttcctgtaagcagcagaactcagcagcttcagccatgtggctctggctctagagttaagaatggaaggaactactggaaaaattgatgctggttagctggaggtaaggaattagcagtgattaagaagagaccagcatcaatgaggtgaaatcttctggaaattgttttctgggagcacaaagaagctgtgttccagagataaccaaggttgtacctcatgctgtggctggacttggtaatgtgtaagagtcactcagatggtactgcttgtgaaggaatgaagtgatcatggagagaagctgaagcttagcactgtgagagtccagggaaggccattggagaaagtgaagcctcagctgtagttgatggcccagggctgaaggggtcatgcaaaggatttgaggcttggcaccctgaagagagcctctgagaggctattggtgaagcctagttggagtggaacaccccagtgtattggagatgtcagtaccatgggatgatcacaaagaacagcagccgtagtggagtggatcaacctgagcttagagtgctacagagggcagagctgtaaaagtgattccagtccttaggaggagtccaaaagttcaagtggaatcccagacactgaaacaagaagctgtaacattgaaattgccttggagactcaaagatgttaaagatgccagagccatgagatacatgctgaggaaagctgctaacaggaagtggaaccagcccaggagaaagcagtttgttgcagtcaacaaagatgattaaggagtggagatctgaagaccgctttgacatcagccatggagatgcagagtttggagtttgcccagctgatttcctcccttgctttggagattacagttaattaagttgaatgaatctcagaagagaccttgaactttggacttttatcattgttgctactgctatagactatgagaactttgaaagttggactaaggtattctgcacaggccccagacatccggccactttcccggccagaggataggggtttgcccgacccaggagcacattgctttagcatcagcagcagacatcttggttccaggaccccgccaaaagtattctgcacaggtgagagtgtagaatagagaagctaacagcttctgggacaggccaaagcaactcagccgcgggacaggcctaagcaactcagctgtgggacaggtcctgttttgggccttcgtcttcggccaggagagaggtcctaac

SEQ ID NO: 334 - DNA, 1400 bp, mus musculus
gcttacatatattgaatcatccttgtacctctgagattatgcaaacttgaacatggaaaataatctttatatattcttggattaagtttgctagtatggtagtcaattttgtatttaagctcataaaggatactgtattggtctttaattttctttccttgtgtctttgtgtggttttgttattagggtaactgcttcttcagttttgattttgtcaaataatttgaagagtattggtgttaattcttcattgaaggtctggtagaattctgcactgaattcttctggtcctgggctttttgatttaatttggattttggaattttattagtttatttctaatcagtgtgtctatttcactgagggataggagtcaatttaaattccttatttgatatgaatccatgaatcttttttaaaattagatattttctttatttacatttcaaatgttatccccattcctggtttcccctgaaaaaaaaaaaccctatcccacatcccttctccccctgcttctgtgagggtgttcccccacccacccagccaccctctcccacttccctgtcctggcattcccctacactggggcatcgagctttcacaggaccaaggccctctcctcccactgatgtccaacaaggccatcctctgctacatatgcagttggagccatgggtccctctgtgtgtactctttgattggtagtttagtccctgagagctcggggggagggggaggcatgtgtccatttggctgatattattgttcctcttatggggctgcaaaccccttcagcaccttctgtcctttttctaactcctctactggggaccccatgctcagttcaatggttgactgtgagcatccacctctgtaggtgtcaaactctgatagagcctctcaggagacagctagctatatcaggttcctatcagcaagcacttgtttgcatccataatggtgtctgtgtttggtaactgtacatgggatggaatccatgtgtcttatacatgaagaaacttggtgttctgggatttccaatttggtggggtacatatattcaaagtatattattttaattatctaatttcctcggtgtctgttgtaatatcctccttttcagctctgattttattaacatgagtattctctcttcacctttcaattaatttagctaagggtttgtcaaatttgttgattttctcaagtaagtcagccttcatttcagattcttttagttttgtttgtttgtttgcatctatttcgttgatctcttttattttagagctttcaggtgtgtcattaagttactaatatgagatctctccagtttttaaaatgtaggcacttagtgctatgaagttgcttctcagaactgccttcattataacttatag

SEQ ID NO: 335 - DNA, 1200 bp, mus musculus
taaaagctagccaagctgggaaatttactaatttatagcaattaagtagttaattagaagtctgtaattatctttgccacttcattaagaactctgtgcagatttcctaatgtaacttgttggaaaccttacttatcttggttattggagttttatgaagaaacagctttcagtgtgttaaaatgactgcctcattaaaacgttgctcctctgtccatggaagaacacatcaattcctaagagtgtaatagttctgggcttgctggtgaagtatgactgaaggccagaggatcgaccctagtcttaatcgctatggcagagaaggatttcctgtgatgctcagctgtcatccagctctgatgctagcatccattcttactgctttgtgcattgatttttattgatcaacttatgcatacatgctatgctaatgtgattgtttggtttgtgtcttagggttttactgctgtgaacagacaccatgaccaagtcaactcttataaaggacaacatttaattcaggttgacttacaggttcagagattcagtcaattatcatcaaggccagagcatggcagcatccaggaaggcatggtgcaggaggagctgagagttcagcgtattcatctgaaggttgctagcagaagactggcttccaggcagttaggatgagggtcttaaagcccacactcacagtgacacacctactccaacaaggccacacctcctaatagtaccatgccctcggccaagcatatacaaatcatcagagtttggtttgtcaacttgacacaatctggagtcacctgagaagagggaacctcaactgagaaaatgcccccatcatattggcctataagcacacctttggagctgataatggaaggatccataacactgtgattggtgccacccctgagatggtggtcctagagtgtataacaacaacaagccccaaaacaaaaacaaaaaaagagaaagggcaagctagtcggcagcatatcttcaaggtctctgcttcagttcctgcctctggttcctgctttgagttctgtctttggcttcctgtgatgatgggctgtgatgtggaagagtaaatcttttcctcccctagttggttttggtcacggtgtttatgacagcaatagaaagcacactgagacagctagttttgtgactttgaattttccaaaatgttga

SEQ ID NO: 336 - DNA, 1000 bp, mus musculus
gcagttctttaaaatgtaaacatcttgggcctggaaagatgcatcagcattttagagcaacgattgctattccagaggacccaggcttaattctcagcacccacaaggcaactcataaccatttatacttctagttgcagacgctctgataccttctgtaggcaccaggcattccggtgatgcacaaacgtgcatgcagacaaacacccatacatgtaaaataaaacttttaagtaaacaactaaaaataaaattgttttacaatcaaacaacccaacttctggacagttgtcagaggagatggggttagcacagcaaagagatttgcagtcctgtgtccactgcagagttcttactatagctaacagcacagagcaaccatgtccttcaatggctgaatgtgtggaaatgtgcagtactcatgcagaataatattaaggcctcaacagaagcaaactctgctcatgttccccaacgtgggatggcgaggctagagacagaagtaggcaggacgttatgcttaatggaagaagccagaggcacatactgcactgtctcagttgtacctgaaaacaaaacagactgagaaacagtgagatagagggttcaggtggagaattcaattggtacagtgtttgcctagcataggtgaggtcttgggttctagccacaacaccatgtaatcagttatagaacattcctgtaatcccagtactgggaattggaagctagaggatcaggtcaggccaacccgagttacataagaccctgcctcatgaatggacaagaagagacagtcaaatgatggtgaccagaggctagagacagaagtaggcagccatatggagatgtggtcaggataaaatggcaccgacctacatgactggtacagcagcattgaggttcgataggaagagcaagattttgctacctactgaaatacttctttagatttacttattttcaattttatgagtatgatgtcttgcctgcacacatg

SEQ ID NO: 337 - DNA, 1000 bp, mus musculus
aagctaaattcaaaccgatctgtaagccctggctcgttccgtgccaccgtggcccctatctcagtgtagagcagacaccctgagctggtccgtcttccttttgctcacactgccagctagacagcttgagattgtctcaggatggttttgattctctcctaatttagtactttaagtcatctcattctcctcagtatgtttggcctgacttgtgctaggctagttgacatgaaactgattattccctgtcagtgctgctttagagtaccatttgttatagtgactcctggaacccaggtctaaagtctgcagctctgctttgatagcctgtaatctaaagcccacttacgttaagaaactacattataactgactgcttaccaacatactagggattgagcctcagacctcacacctcccggggaagggctccaccactcagctatcccccaaagcctcttactttttgagacagtgtctcagtaggttgtccaagctgacctaaaacttgcaattaccctaacagctgagactaaagcctataccagcaggcccttcttgtcttgatcagaaaaattatattagctactgctccatatattgaggaaatgactcatttagaaatctcccttgtaccctacaagaaggtacttaatctaaaagaatcttgtgcattctctattctaaaaattactgaaatgtattttaaaagtatcaacgtggagtaagaatggaattgtgtggctggagacagagttggagcagatggggactccagagttccttttaaggtctaaaagtctgacattcgagcttttgcttaaaagagtctttacaatattcatgttgggagctggggagacggctcagtggttagactgcgcttccagaggtcctgagttcaattcccaaaaaccacagggtggctcacaaccatctgtaattggatctgattccttctgctgtgcatgaagacagagcacttatgtacataaaatgc

SEQ ID NO: 338 - DNA, 1200 bp, mus musculus
gagcctcagaaggtcagagcggaatcggggaggggtgggcaggaggtcacgctcaaaagagagcttaccacctacctctcctggcttgtccagagtctgcactggtgggtgccttccttagggacacgtggatgctgaaagctgacctttcttaggccctaggccatccgagtaagcaaaacgaagcctgagtaaaatcccagctcgatcctctcccctgagcgctgccgttctaaacagcgaagacagcagccctaccagaggaggaaccgaagtcattcccgagtgcccctgctccccgccagctcccacttgtcacttccagccctgtgtcacataaacagggctttattatctcaagcccaccacgtcctgtgagagttctgtaaatggaacaccacacaataacttgtttattaataatggctcgtcccctccctcagcctggctcactcactcaccgcagtgtcccccgcccccctccatgcataatggaggaactgtgttgcctgtgacacaagccaggctgtgctcttcagactgaggggatagatggggagaggtaccagcctggaccaggctccctaaggtggggacagcggggagaagacccccattataactcaaagacgtaatgttgtgtgtggagtgggagtgctatgtggcagccttagagccagctctgccctatatgcatgtcccacgtgagcccatgccagggttatccaacaccaatcctgttctatccagggcagacaaggctctccacagcctccgcccactggcccacttctgtgtctgggggcagacttctttcttccattcaacactccatgacacttctgctgaccaaacacctccagtccctacagtggtcccttcaggaaccaacttccaattggccaccaccctgtttttccctctgatgggcaagcaggggtggaacatggtttctccaaaccctcctctggagagcggaaagtctagaacacctaaaggtcttaaaaatgtttatgtcctagctgggtgtggtggtgcacgcctttaatcccagcactcgggaggcagaggcaggtggatttttgagttcgagaccagcctggtctacaaagtgagttccaggacagccagggctatacagagaaaccctgtctcaaaaaaacaaaacaaaacaaaacaaatataataaaatgtttatgc

SEQ ID NO: 339 - DNA, 1200 bp, mus musculus; identical to SEQ ID NO: 338

SEQ ID NO: 340 - DNA, 1200 bp, mus musculus
gaaatccccaaccaaaccaaggctaagagagaaaaccagagcacaagcacagccgatggggcctatgagaagacaagagcccgtgggttgagaaagagggagtgtctggcttggttagggtgtgagagatcctattgccaggtcctgttgccaggatgactaaagggcttagtgagaaatagctctagctcaaactctgtctgaagttagccccaaggtagacaagagactttgagggaatgtagggtatggaaggggccaccacaaagacctatgaaaagtagctgttgacaggaacaggtacctaggggtaggaggcaggactgagaggctggacaggaggagtgtgtcttgttgaaagtatagttgggacccttgattttttaaaaaatcacacacattgcaattgtctcatgtctcacctgttttgtgccaagaacataagtagaggttggatataaaaaaaaaagaattgtcaccatgacttcagttctcctgaggagctctcaccctgctgttgattttggagggtgaccacctaatgtgagcaggggacagatggtagttggggaacacacagactcctagcacaggtctgaagaaggtgagacactgagaagtgaagtttgctcaaataaggcttcagccagccatggtgggtcacacctaaaatcgtagcacttgagaggtcggagacaggaggactgtcaggagttcaaggcaagtctggcttacatggtgagctccaggttaacatggacaataggctagaccctgtctcaagacaagcaaacaagcaagcaaaaaaactcccctacggtttcgtcacgctgggggccatggcccaaggtaacatgtcctgggcactgattggccctggtttgtattttgtttgtttgttcgtcctcaagtctcggtcatcccaagctaagtgaacaagagtaggtctccaggctatcaccgtattacatgtcccctgccttccctcttcagaggttcacacattcaaacggttgctgagaccaggcccagaacaaaccagagcaaagcagactgagcacccagcaacaggagaggaggagatgcagccaggagaagcttcacaccatcagaacaggccagtggttacttagctcctgctgaccgttgccatggagaaaaggtaggctgattccagctaagtttcccattttggggggg

SEQ ID NO: 341 - DNA, 1200 bp, mus musculus
acgcacctctaggtcatggggatccagccggtaagaccctcgttctgtgccctgagcccggggtcaccgcctcagctggttctgggcagtctgccccgcggggctgtgccatacccaccttggatgctggagtctcgctgcacgagctgcgggctgagttcactgctccgcttgcttctgaggttttggcatgctttctcgctggagctcaggatcgctactcctggtcctccacccacaccctggcacttcctcagcgtggcgatcacgcttcctcctctatccacagagcccggtcttgctagcctctctgggggtggggctgcttactctgctcggcctggctctgggtacctacttggttcgaagatcccgccggccgcaggttactctccaggacccggatgagaagtacctgctgcgattgctagacaagacggtaagttgtgaagaagtgggctagggcagagagtggatacttagtttgagggatagcatcgagagtggttggattgctccaaaagacttggcaggccagacctgcctgatgaaacatcttgtcatctatcctctagacagtgagccacaacaccaggaggttccgctttgccttgcccaccgcccaccacattctggggctgcctgtgggtaagaaaaaagggagtgggcttctctacttggcatcgtatgagggcgagtcacttcttaggtggttttcctgctaagaaaaaccattgcccttctgtcaatccttcagcccatgagggaccactcttttagggtgtggcttctgtgcccctacgcatctctaacctccaggcttctctctttccttaggacttattataacccgcctcctatcccagaaaacactaattttccattatgcaaatcctctgcttacctgctgctgctaaggccctggcagtagggagtttcaaaggtgggaggaggcaggagatactgcggaggggtcctctcagtgggactgcagcttatgtgtctctctccatggttcccaggtaagcacgtctacctctctgcccgaattgatggcagtctggtcatcaggccttacacccctgtcaccagtgatgaagaccaaggctatgtagatcttgtcatcaaggtaagtatatagaaaggaaatctccgagctggggggatggctgggttgttgagtaaagcacttgccatcca

SEQ ID NO: 342 - DNA, 1200 bp, mus musculus
ggtttggataggtttggccccatggatgcacacgtttgaatgctcgacccatggggagtggcacttttaggaggtgtggcctcggaggaaatgtatcactgtggagctgagctatgcttaagcttgaggaggtctcctatgcctaagctccacccactgtggaatttcagtctcctccaggctgtctcttggctcctccagcaccaagtctgcctgcccaaccccatgcttcctaccatgatgataacggactgaacctctgaatctgtaagccagccccaattaaatgttttcctttataagacttgccttggtcacggtgtctcttcacagcaatgaaaccctaagacaccttccatcagggctttgtcttccctgtctgtgagagctgccctgaccaatggggagtggggagtcagactccagcctcagacctagctctgggccacagcacccatgcaatcttgtgccaacttatttaccagttttccttcgaaagtgggcaaagaagcacctgccttgcagaagttctccaaggactgagtcctcattgtcccaggctctgaccttgtaaattttacaattttacccaaggacatcactctcaatttccactcctaactaaatacagagtggaagcacaatctccgtgatgttttagtgttcacttgagcgatatgttataaacttcctaaagcacttccatgtgtatcgcccgtttatctcccacagcacacctgaggggtttagactgcatgagaggaaaaatttaaggcagatactgtgtgtctttggtgcagctttctgtacgtgtatctgagtatggagacggatgcgagcagacagttgtatgtctgtgattgtgagtagcagttgtgcctttgtggattagtacatgtcaaatcacatctcttctgttcccacaaaaggatccttgtgtcacttctgtcctgctactcgatgggctttgacagtgctggcgggagagcagccaaactaccaggaagcctgctgagggttcagctaggggcttgcatgggatgtatttccagtggacatgacacaatatagcattaccacctctttctggaagcactttcagagacagacacactggcactgtggcccttggctctttgtctcccctcccctacccagctttgattgattacaggaaacttgttccccaagttctcaggc

SEQ ID NO: 343 - DNA, 1000 bp, mus musculus
aaattttctttctttttaagttttggtagcactgggatttgacatagggccgtgcacattctaggctcaatgactacgattccttagccctggcttttttttttttttctctaaacttcttattgagagatggtctcactaagttgcccaggtggtccttacgcttgttgttcctcctgcctctgcctcctgagcagctgggatgacttgcaggcaagcctgacttagaattttaatgctggaaaacctgctctgaaaagaagcctcaaaggcaactatatgaagcctgcatcttctgttccagctgcttcatggtaagagaagagagtttctactacaggggcatggctctgcttttccagagtaacaaatcagatgacagagcaacagttcctagagacgttaggcctaaagcaaccctgaccaaacagttcagatacaattttagatacaagacatgctgaattatgagagtagaaaggacctgttcaagagattacttcactagcccacagaaggctccataacgcagcatgtcccctctcagtgagggctgggatgtagggggataaagaggagcagagggacacttctgcctaatgaagagaaaggccgatgatccggttatttgttttggaggatacgaggttttacatgttggacgttggacttgaactcaattagctaaggctaagctcaagtttgtgatcttaacatttttgtcttcacctcctgagagctaggcctatgctatcaccacaccaggtaataagtatttttttttattattatatgtgtaagaatgctttgcctgcatgtatgtgtgcagatcacgtgcttgcctgggactctgggttctctggaattggagttatggatgattgagaggcggcatgcggtttgctggaaatcaatccttggtcctatataagaataagtgctcttaatcgggagccatctctccagcttttaagggagtgtttttttttaaaacaataag

SEQ ID NO: 344 - DNA, 1000 bp, mus musculus; identical to SEQ ID NO: 343

SEQ ID NO: 345 - DNA, 1200 bp, mus musculus
aagagtaagcctttggttcatagcttaggggagatgccaacattgtgcaataaaaaagcttttttttttttttttttttgtaacgggcacctacttttaagcaagcaacttttggaatctaaaaggctaaaagagctcacctcatgacatggctctccatgcctgcccctttctctctgagctacccgtatcaagttgtgtacacatgaacagaattgtcttttgcccagtccttgcctcccgcctcagaaaaaccaactactaaaataacaagaaaatcccaacagcctgccaaagagctcccacttgtccgggttcttatctaggcaagacgttggagggctcagcaaaatttttatgtaggggagcaggcccgaggaaaactcacacgccataaccaattgtagacagaggatcatctatcaggagacaaatgcaggaactccagagtgcctctcctcaaatgaaataatatatctttgaaagccaatgcccgttttgggcccgaggcccatatatcaagcctgagaggcttgtggaatcgctccagggccattaaccttccacctgtttccccttgtccttcaggatgagcccctgcccttgattttactcccgtcccctgttcatcttcgacagagtgtaaatgtacagccgtgggcctgtgaaataactcaaaggcaatggaccaggggcacggttacaaatctctgccagtggcaccgtgacttatggaggcagtttgtcacacatgagccaggtgacctctgtgacataacagagaaaaatatcgcccgggatcaaagatgggattcggagtattctaaggagctgcgtcccacacgctgggcaggttatctggtgtccaaggatttcccccggtgccaacaacattcactccagggaaaatggaaaggtgggccagggaatccttaattgaaatcatgtctgtcaatagaattgggcctttcctgccatgccaggattagaatttctgccctcttgatttctcctggaggttgctgcagaagctggccttacttagacaacaccaatccatccattcgcccttagagagaaactgagacgcagtgaaaaatgatatgttcttaaagacttccgtagcttgagtacttatatccacagttagactgtcaagggaaagttttagtatagcatctttttttttttttcgtcaaa

SEQ ID NO: 346 - DNA, 1200 bp, mus musculus; identical to SEQ ID NO: 345

SEQ ID NO: 347 - DNA, 1200 bp, mus musculus
aaaaaaaatgttgccactcaacagcaggcattctttgtaggatgaaaataaataaatacctcttggggatttaagcacaaatacatttggaggggtgaactaagagatcatgtttaagcatatgaaaatcactattggcattaatgtgttcccccatttttacattagaactgctggggaggggagttgaagcaaatagctttatcttggcactcctcagtgatgggtggacaggtgaaacagttctgacttccactggtgttgcatactttccatttgccctgctactcctctaccctgctccagggcccaggatactgctccagcccccacctggttcttggttgggtttggtcagtgggtggcacctgctggagagtgctgggaagagaggccttatctccatgcagggtggcctcaggctgattggccggacttcccaaagctgtagctcgctttggctggcatttctccacaatgctttatctctaggctgctgtacttcgttgaccaagtccataaacacaccttctttctgatacttcaggcactaaaccagtgagcagtttcttttccagttcttacatggcaggcaatttgagtagacttcagtgtgaccaggatactcctgaaatggtcccgacaagtgtgattagtcattggataacgacatgccgagtctgtgagttcctctgtattgatccatgcaggctgcaggggttgtgaaactgtgattctgtcagggagttttgctaacaagccctgataggaggagccccacattatgtcatcctctggttctggtaaagttgaaggctagataaaacacccactatctctctcaaccacaacagccatgtggccagcgagtattcccacttcacagttgtccacgcaacgaacttggcaggctcaccccatttctcagaagagatttaatagtggcaagctttgtacctcaaagacttcattactctgaccagttctctctgctccatacttactggtgtcctgagagagatgacctaatactctatacccattacaagatgaatgtgccccaactttaaatctactaattttttattcccccgagacagggtttctctgtatagtcctggctgtcctggaactcactttgtagaccaggttggcctcgaactcagaactcctcctgcctctgcctccccagtgctggga

SEQ ID NO: 348 - DNA, 1000 bp, mus musculus
aacaaggtaactaggtagtggataagagaaagggggagggatggagggaggatgggaaggaggggaagagggaagaaggaaggcagggatggagagagtgaaggaggaaggatggaccagactcgggatagaggaaatactagagaccagtaacacttctgtgctggagctatgaattaggaactggccacttgggaagtagattgtcccacattatcaggactgtctttgctagtaatgtcacttcatccttaaacccggttttctctaattcagatgcagttgtccccaaacaaacccaatgtacctatcttctaagaagagctaataaagaatagagatctcaatgtacaagcagcacattgcagcacgcacactggggccaggctcctaatgtttccgtgacgtgattttattctgtcaagttaaggaatggagagtgggaccaaacctaccgcacttcccttgacagccaggtcaacaccacttataaaccatctccccttccctgccccacagctgtaagtgtcccaggtggagacttcagagggaagctgaaaccatacgagacagagcacactttccaatcttcagcttgccacatgcctgctgggactgcttctgatcttagtttaagttccccaggaatattttcagtttagatgtgatctccacatctgtctggaattatcatagtgtgttccatcgttgctggactgctggaaacaaagaccctcacaaccaaagtggatgctctgtctgggcgtggttggggtggggtgggggttgggacttagtccagagccacagaggtctgagctttatggattatgagataccttatgagatacgtctgccaaaatctaaggaattctaaagagagctatatattttcagcgtgccattcactttggacaaaccaaaaaggaagtcagcaggcaccaagctgtcatgaattcatggaagcaacagcatctttttaggtttttcactacgaaat

SEQ ID NO: 349 - DNA, 1200 bp, mus musculus
atctttctacttcactcaattatatttttctagtaactctttcaatgattctttttgagtttttaggcaaatactcctaatcatctgcagcagaattggtattctgtctatctgtgtccactctgccactgtcatggcctctcagggaggcagagcctggagagttgactttgcttacacaacaccattgctagggcaggttctgggctgtagggaagcactgagacacctctctgggggtgggaaagcgcagtctgagatgtgggaaagccagagttggtcagggtatctgcagggcctgtgatgaggccagggatgagggtggttctctgattcttggacatccaggcaccactgggagtcacagaagagctgagaatggagttgaggggtaggttgctggctggggacagcatctagcctaggactgtgagaaaaaggggagctccagcttgtcccagttggtattgtccttagcttggcagagtcaggcttgggagcacagagaagcctccaaagaaaaaattaagctgctgttctgtagtcaaatgccttctccatggcgccccatgatggatctcgatgaaagagactggccatggttctaaatagtttattgattgttcatggcagaaaatggatgcataaaatacaatactcacttcttagggtggacttgagattaaatagcttctacagggaggaatgtctggtaaggaaagcttattggctaagccctccgggcctctacgtaactcattagcatggagaactctgttttgggcctatgtgaccataggacatgtttcttttaagtgaggagcatggcatgtgttccaggctgggagtctggcagggagctgggaattgcctaagccttagatgtgtgtccaccgagtctctctgggtctcaaactgctctaccttatcaaacttcctagtatggctttactgtccaacagtattcaactttgttttctagtctgttattaactactttaaatgtaattttactagctaatgcctctgttacaaagatagtggggattttagttctgcaacagtgttgtcttctatgatgaagaataagtaaatatatatctttcttaacagaattttactttaatgatatactgatattaacatttgttaattactctcctagaaatgatccagttcattataaatctaattgtgaaa

SEQ ID NO: 350 - DNA, 1000 bp, mus musculus
aagggccaactcatggcatctcgtcagaagtgataagtttttaccttcagagaatctgaagatcaatatctttctgaacatctctcaaaagaaagaaagaaaaaaaagccctgcttctgggaagaatgttgtttaagcccttcagtgttttctgactcagcagcatgacacagtttgtatattacatcagtgtgccttactgtcaacttccaagatttctgctctgtccttgagcactgttgtagatggaacgaagcccagcctggaagtgtggactgaggtgacgcactctgtatttggtgataaatgcaagggcactgaagacatgcctcgggttgacatgcaatacctaattcagggtttcattatcattaaaataaaacaggcaggaggtagtgaataggaaaaggaaaagtgattcgtgcacagatggtgtcctaggctttcataggccctgcttcatgcagcaaggccagcttcgactgcagcatccttcatggctgcacacactgactgacatttcactatgatggatgcgtggccagtgcgagagactgtacccttttccgtctatttggctgaagcaaatagtcggatttccatttttatgttccatactttattaagagtatctctgcagatgcccatttacagaggaaattagctgaataggaaagaaatcggttttcactcatgcgaagcaatgaaatcataatctcggaaatctaagacacatggcctacattgctctcatcaagaagctaacggccttctgaaatatgacgtggtgcatgcgctgttctcagagtcctccaattacatacctggaaatacttatgactgaaattatgctatgtattaaaggcagatgaagttccccctatcgtgtaatgcacattttaaaacatttgtattctaaaacatttaaaaagatttctttgtttttatcttatgattgtttgcctgcttgtaagtgcaccacatgtaagcagtaccctca

SEQ ID NO: 351 - DNA, 1000 bp, mus musculus
catcactgaatgacttatcagcatttgccttttgaggggagggttgttttgttttgttttttaatttttgagacagggtttctccgtgtaatagccctggctctgctggagttctttaggccaggttggccttcgactcacagagattcacctgtttctgctgcccagactgttgagattaaaggtatgtgccatcattgtctagcctatgttggccacaaactcatcatcctcctgtccccacctccttcagcaaatcctaccagtaagtgacaccacaactgatcttgtcaccattagtgacttaatgtttgtttgagtcttttaactttttccagcgtgatctacagggataagaatccataaaaatggaaaggattcccaggtaatacaactcttaagatttaaaacaaagagatccttcctcttcggcaaggacaccaagaccaaccattgacatgcaataatgtcattggatgcttcaagtagggtaaaaccgtaagcactcttccttccatcccagaagggtaacaggatgaagcacttaccagtcttagagacatcattaagaaggagaagtaccagcaggaaaaaaggaacatatcttctgtcacaaggaagctattgagctaagatcgtagctcagctagcacagtgctcacctagtgtgcctaaagcccaggttagaggcccagtgtcaccaaagcctgggtgtgctggtgtacaactgtaatctgaagcagaaggatcagaatttcaagttcccttagctacatagcaaattcagtatcagcatgaacaacatgagtccctgcctcaaaagagacaaagggtatgctgtaatatttgagaatacttagaaaatgattagacttgtggtgtacatatgataaaggcctaatattactcatatcacatgttatggggagggcaggaaggaatgcattaattacaacaagtactgagggggacaactttgatggaaagagaataaatataa

SEQ ID NO: 352 - DNA, 1000 bp, mus musculus
ttacttagtgggggaataggaggcagatggagggaactgggtgggagaggggatggagtaagaaatgggaagggttcaggatcagatgtgagaagggacaggagagattgccagttagtcttaagaatcaatagaaatctataactagtggggataggaaggaggagggcatcttgagaatgtgccagagacttgggatagaggaggcacccaagaatcaatgggagtgaccttagctgtgactcacagcattgggaatatagaacctgaagagggcaccctatatggccaggcaggaaattcattggagcaataggtacaccaacccacacacaaaactttgacccaaaatttatcctgtctacaagaaattcagggatgttagatggtgcagaaactgaaggaatggccaaggaataatcagcccaactaaagaccaaaccccacgggcaagcaccaatccctgacgctattaatgatactctgccatgcttgcagacagtagtctagcaggattgtcctccgagaggctctacccagcagctgattcagacagatgcagacaccatagccaaacagtggatggagcttggggactcttatggaagaatatgaagaaggatgacagaccctgaagtagattggaattccacaggaagaccaaaagagtcaactaacctgagcccttggggctctcagagactgaaccactgaccaaagaacatacctgagctggacctaccacccccaatcctacacacaaacatatgtaggaaatgtacagctaggtcttcatatgggtcccgaacaactggagcagggactatcctaaaaatctgttgcctgtctgtgggatatgttcttctagctgggttgccttgtctgtcctcagtgggtgaggatgggcctagccctgtagagaattgatgtgccagggtgggaggacacccagggggacctccaccctcttggaggagaaggagggaggatattgtgggag

SEQ ID NO: 353 - DNA, 1000 bp, mus musculus
aaatggaagtagaaacaataacgtaatcacaaagggattctgtagggatttcaatctgtagattgaaaacctaggaaagaagtcaggagccatagtggtagttgtactgtgggccagggaaacaaaggcctaaaacttttcacccactacctgtcctgtctgcaatatgtgctagggtgaaggaatctcagtgtttatgggagtgaccaatcaattactggtctaaattgaggcccaaacaatgaagggagtcctccacaatgggaggatggccaggaatggaaagctgtatgactaagagaaatgtagtgataccaaacattactgacaaacaaaaaatgtcaatatgctaataatattctgctacagtcatagattagtgactagactaatcatcttcagaaggctttgttgagcacctgaatggaaacagatgcagagacacacagacaaacaataggcaaagatagaacaacccagtaaaagatgaaagaaaggattttaggagacagaaggatggaggacaccaggagtatatggtaaacagaatcaactaagcagggctcatagaggatacagagatggaagctgtaatcctagatgctgagtgggtctgtatatacactgtgttttcttattttgggcattttgtgggactccaaacagtggtagagggactgtctcactcctttgcctgttcttgggacccttttctgcctactgggttgccttctccagctttgatatggtaatttcaaccaagtgttattgcattctgctatggtgtattcatttggtatccctaagatgcatgcacttttctgaagggaaatggagaacaacttatatggaggaaattggagtggaagggactgggaggaatggagagaagtgtggctgagatcaggaggtattgcatgagaaaagaataatgaaaacagagtaaaaggaaaattaaaattctagaatgaaaacaggcaagcaagcaaacaaacaaaaa

SEQ ID NO: 354 - DNA, 1200 bp, mus musculus
ggcctatatgcagaattcaaagggatgttcagtttataaattgacaatctctatcattaccctttcttcagtctatgttttttcatataaatctaatattttaatttataaaagaaaggtattaaggtagcaatctcgacattttcttcacaattcattcttaaacacaatctgatacagaattctttggttttaagtattatttgaatagtttttttcctttccatatatacctctaatgtgtaaacctagcccctgaaagggtggcagcaatatttccactggtcttaaatttgtgtcacagtgtacctgtatttttttgtaattcaatttacatcctgattgaagccctatcctcccctcctagtctctccacatatcatcccttgccatgtcccctctatcccttctcctctgaaaagggtgaaagcctcctgggtgccagcctacttgagcacataaagctacttcaggattaggcacatcctctctcaccgaggccagacaaggcagcccagttaagtgaaacaggatccacaagcaggcaaaacagtcaaggatagcccctatttaagtttttggggttcctcatgaagacagataatatacatgcatagtagtaaaaacctgatctaacataataataatatatgattactgtcatggtttgaatatacttggcccagggagtgggactattgggaggtatgtccttgttggaatagggcgaattggaagaaatgtgtcactgtttggatgggctttgcccatcttctcctgactgcctttgtaacaagatgtagacctctctgcgccttcaatgccgtgcttgcctgctgtatccccttgataataatagactgaacctctgaactcaaaagccagcccccaatggaatgatgtcccctataagagtttctttggtcatggtgtctcttcacagcaaaacaccctaaggtaactacttaaatcaagtgtgtctcctaatttttatgtcatttaacattaattttgaatcaggaacaagaagtgtgttcctcacttttttttcctcttaatcatactctgactgtcatattttcatacaaccattatagtttatgtttttctatttaggttttcttaataatatagcttaactcagtatctttttaaactaaagcgctaagataccaaacaacaaagatatggccaagtatt

SEQ ID NO: 355 - DNA, 1000 bp, mus musculus
caccagttgtaaatttgtgtcacagtttacttgtattttttttaattcaatatatatactgattgaaaccctctcctctcctccttgtccctccacatatagaccctagcctcatcccctctactccttctcttaaaagggggatggccgcctgggcaccagcctactcaggcacataaagtcactgcaagactaggcacaccctctctcattgaggccaaaaaaggcatcccaggtagggggaacaggatccagaggcaggcaacacagtcagggacagcccctgcttcagttgttgggttctatgtgatgagagataatataaatgtacagtagtaaaacacgatataaaatagtaataaatatatatgtctactgttaggtttgaatatgcttggcccgggaagtggtattattaggatgtgtatccttgttggaataggtgtggccttattgtacttaaaaggagaagcaaacattatggtaagaactttgtaaaactgattaagaacaaaactactttttcccttgtatatagattctcaaatgtacagttttcttatttcaaatgttttgtagaaatatttgtaatggaatacatcatgcttagtttctttacattgtaaatcaattttgcaaaatgtaatctctacaggatactgatgcatcaaaataagttgttcaggacattgtgttatttttctactgttcctgcctatcattagagaggggctattaaatgttagaaatccaaaagttctgagaagttgttttagacccctttggtctggctatgatcagctacaagaaagtctacttattttcatattttcttattttaattttggtttcttatggagtccaagatacgtgtaaagtcagctgcaacaaattgtatattcagcgatatagtgtcaaagagattaaggtgccttggtttaaagataattgtacatcaactcaggtaaactctttcttcttcaggaaaacaaagtagagt

SEQ ID NO: 356 - DNA, 1600 bp, mus musculus
aatactcaggtgacagcaggtgctggcaaggatgtggagaaagaggaacactcctccattgctggtggaattgcaagctggtacaaccactctggaaatcagtttggcagttcctcagaaaattggacatagtactacctcaggacccatcaataccactcctgggcacatacccagaagatgctccaacatataataaggacacatgctccactatgttcattacagccttatttataatagccagaagcttgaaagaacccagatgtctctcaacagaggagtagattcagaaaatattgtatatttacacaatggagtactactcagctattaaaatcaaagaacttatgaaattcttaggcaaattgatgtaactagaaaatatcatcctgagtgagataacccaatcacaaaagaacacacatgatatgcactcagtgataagtggatattagcccagaagtttggaatacccaaataatattcacaaactacatgaaactcaagaaggaagaccaaagtgtggatacatttatccttcttagaaggggaacaaaatacacatggaaggagttatagagacaaagtgtggagcagagactaaaggaatgaccagagactgtccctccagtggatccatcccacatacaatcaccaaacccatatgttattgtggatggcaacaagtgcttaatgacaggaacctgatatagctgtctcctgaggggctttgccagtgcctgacaaatacagaagtggatgctcaagctatccattggacagagcacagtgttcccagggttagacctagagaaaggacccagggggttgaagggatttacagtcccataggaagaaaaacgatatgaaataaccagtacccccagagctcccagggactaaatcaccaactaaagagtaaacatggtgggactcatggctccagctgcatatgtagcagaggatgggctagttggacataaacgggaggaagacccttggtcctgtgaaggctttatgccccagtgtaggggaatgccagggccaggatgcacgagtgggtgggttggggagcaaggggagaggggaggagatagggtgagtgggttttcagagggaataacatttgaaatgtaaataaagaaaaatatacaataaaaaagaaagaaatgtatattttcactagaataactaaaaccattcaaatatgaagcagacatatgtgtgtgtcttacccacacatcgtggcttttcattgctccaaaggccattttctgagcaatgaatttccttatgtccttcaatcttgaagcctgaattgcattcaaaccgcaccacctgtccaaaatagtattcctggtctgtttctgctgcaccactcacaattcttccattctcgagttctgtcacaggtaaacacttcacaactgaaaatacaggcattgcttttactaacagaacttgaaagcttcaacataaaacacattgtaggtgaattaaaaccccagcactctgcaggaaatgacttcaatgttggagaaatattcagtatcactgtttgcaatacataaaaattaactaatacaagtagttcgct

SEQ ID NO: 357 - DNA, 1000 bp, mus musculus
aaattttagccatctttattttccaacatgaaacacagaacattcagccattcagacgactagacacaaacacacatgaattgaacacatgaacagaccagtgcaccagacattagatgttagacaacacaaagagagcagagaacttctgatataagggctagagagaaaaaggcaggacatccccgaacatttctctctgcctctgggagagtttcaaaatccactttcctcccacctgatgaatttctcgactgcggccatccgcctgattatttaatccaaactcttttatttctctcgcctaaaaagcagcttctggaagctgcggccaactgccggctgcattcctaggtcctggtatcactgctgaacctgagcggatctagcgcgggtcagcgctgttacagctcagaccgtaccacacccttagcaacattttacccgttgcttctccatgtccctgtatgaattttctaattctttcctatctgtgtagctccataccagcagtgcttcttccagcttcttctgccattcccagacccctcgttgggcgccaaattgctgtggccagcctgcagctctcatgtctgagttcgagcctggtaggcaacctggagctgaaagagaagagggaatctaggcgggtcgagaaataatggaaccaagacattctagtctgctcaaggttcgaatgtttaataaaaaagtctgtgcttataaagagggaaacccatccccagtcatgccaagtttcttgatgtagagatgtgaagttgtccgaacagccttttagcagaaacttggcaaattcacagtttgcaattaactccagaaaatcttggagagtctatttggcctcatcacaggtggcaggcagtgtcatatcaaaggacagtgatgagaagcagcacagcaggtggccccacctcagtgcttatgggctgaaccagcatgcctagactgaaagagtttacatggaagtattttaatttct

SEQ ID NO: 358 - DNA, 1000 bp, mus musculus
aatctcgacattttcttcacaattcattctttgacacagtctggtacagaattctttggttttaagtattatttgaatagttttttttttcctttccatatatacctctaatgggtaaacctagcccctgaaggggtggcagcaatatttctattggtcttaaatttgtgtcacagtgtacctgtatttttttgtaattcaatttatatcctgattgaagccctatcctctcctcctagtctctccacataccatcccttgccatgtcccctctatcccttctcctctgaaaagggtgaaagcctcctggatgccagcctacttgagcacataaagttacttcaggactaggcacatcctctctcaccgaggccagacaaggcagcccagttaagtggatcaggatccacaagcaggcaacaaagtcaaggatagcccctatttaagtttttggggttcctcatgaagacagataatatacatgcatagtagtaaaaacctgatctaaaataataataataatatgcttactgtcatggtttgaatatgcttggcccagggagtgggactattgggaggtatttccttgttggaataggtgtgggtgaattggaggaaatgtgtcactgtttggatgggctttgcccatcttctcctgactgcctttgtaacaagatgtagacctctctgtgccttcaatgctgtgcttgcctgctgtatccccttgatgataatagactgaacctctgaactcataagccagcccccaatggaatgttgtcccttataagagtttctttggtcatggtgtctcttcacagcaaaacaccctaaggtaactacttaaatctagtgtgtctcctaatttttttgccatttaacattaattttgaatcaggaacaaaaagtgtgttcctcacttttttttctcttcatcatactctgactgtcatattttcatatgaccattatagtttatgtttttctatttaggttttct

SEQ ID NO: 359 - DNA, 1600 bp, mus musculus
aagatcaaatactcaggtgacagcaagtgctggcaaggatgcggagaaagaggaacactcctccattgctggtggaattgcaagctggtacaaccactctggaaatcagtttggcagttcctcagaaaattggacatagtactacctgaggacccatcaataccactcctgggcacatacccagaagatgctccaacatataataaggacacatgctccactatgttcattacagccttatttataatagccagaagctggaaagaatgcagatgtctctcaacagaggagtagattcagaaaatattgtatatttacacaatggagtaccactcagctattaaaatcaaagaacttatgaaattcttaggcaaatgaatgtaaccagaaaatatcatcctgagtgagataacccaatcacaaaagaacacacatgatatgcactcagtgataagtgaatattagcccagaagtttggaatacccaaataatattcacaaactacatgaatctcaagaagggagaccaaagtgtggatactttgatccttcttagaaggggaacaaaatacacatggaaggagttacagagacaaagtgtggagcagggactaaaggaatgaccagagactgtcccgccagtggatccatcccacatacaatcaccaaacccatatgttattgtggatggcaacaagtgcttaatgacaggaacctgatatagctgtctcctgagaggctttgccagtgcctgacaaatacagaagtggatgctcaagccatccattggacagagcacagtgttcccagggttagacctagagaaaggacccagggggttgaagggatttacagtcccataggaagaaaaacaatatgaaataaccagtacccccagagctcccagggactaaatcaccaactaaagagtaaacatggtgggactcatggctccagctgcatatgtagcagaggatgggctagttggacataaacgggaggaagacccttggtcctgtgaaggctttatgccccagtgtaggggaatgtcagggccaggatgcatgagtgggtgggttggggagtaaggggagaggggaggagatagggtgagtgggttttcagagggaataacatttgaaatgtaaataaagaaaaaatacaataaaaaaagaaagaaatgtatattttcactagaataactaaaaccattcaaatatgaagcagacatatgtgtgtgtcttacccacacatcgtggcttttcattgctccaaaggccattttctgagcaatgaatttccttatgtccttcaatcttgaagcctgaattgcattcaaaccgcaccacctgtccaaaatagtattcctggtctgtttctgctgcaccactcacaattcttccattctcgagttctgtcacaggtagacacttcacaactgaaaatacaggcattgcttttactaacagaacttgaaagcttcaacataaaacacattgtaggtgaattaaaaccccagcactctgcaggaaatgacttcaatgttggagacatattcagtatcactgtttgcaatacataaaagttaactaatacaagta

SEQ ID NO: 360 - DNA, 1000 bp, mus musculus
ttcctctgtgtagccctggctgtcctggaactcactttgtagaccaggctggcctcaaactcagaaatccacctacttctgcctcctgagtgctgggattaaaggcatgcgccaccacgcccggctcaatattatttttttaaatattaaatgtacaattattcaggtactgcaaatgttattttggcatactgtttgctgtaacggtatttaaaaatgtaagttcaagtgattttcacatcaccttccacaagctcttaattgtacgactaataaaaataatcattgatttactgatgggtatgatatagttattaatcaaagatagacaatttatggtagcaagcagaaaggataaataaattatggagctttgaccaatcggaaatcttcataattggaaagagtgatttattagcacctatcatctaatcattgaaggttaattactgtgagtctttctttcagttacttatgcaataatatgggcctgcattttgcctcaacactgcggtgtgggacaccaccttgctgatggggttcagggctcttgggactctgacacattgttcaggggagatgatatacagcctaatacaggagtccttgcccacatttctctaggtgataaatggcagggttagtgccaagagtgtggagggttctcctgcggaatacttgtgcagctctgtacagcaaagtcatcacccctgtggtggtccttgacaagggagaccgcctttgtttgtctaaactgtttattcatagtttatgaggattcatatggcttattgagggtgaaacttttcctaggaaggtatgcttaggaagggaagctcattggctagacacttggagtttatctagatacctcattagcgtggagaactctgcgttgttcataattgtcctggtcctcttagtggggtgtcatggtcacgtgctccaggacttgtaaccttgtagggaggggatttaaatgcctactgttcttagttat

SEQ ID NO: 361 - DNA, 1000 bp, mus musculus
tttcagtccttcttagaagggggaacaaaatactcaagggaggagacacagagacaaagtttggagcagaaggtgaaagaaaggccatccagtgactgtcccacctgccgatccattccatataaaattccggtaatctctgaggagagccgtgtgtgccgcgagcaatcgccattataagatggcgcgggcctccgctgtgcctaactagtaaacaagccttgtacgcaggtgcgagagtgaattcactcctagtcactcccattatcggggtgtaatagtggggtgatgggcaagcaacaaatcaggagctgtcacgccatatcaggtgctgaaacgtcacgctgcgggttataaaagcagcaccattttcccagtttgggatcttcctgagaaacaagcaataaagctcttgccgcggaagattctggtttgttgcgtctttcttgccggtcgagcgggacgcaataccaaacccagagactattgaggataccaacaagtgcttgctaataagagcctgttatagctgttttctgagaggctctgccagtgactgacaaatacagaagtggattctcacagctatccattggactgagcacaggggccccaatggaggaactagagaaaggaccaaagagctgaaattcggatttgaaatcccatgggtggaacaacaatatgaactaaccagtacccccagatctcccagggactaaactacaaaccaaaaagtgcacatgaagggatccatggttccagctgcatatgtagcagaggatggcctgcgagatatcaatgagaggagcgtcccttggtcttatgaaggctcgatgtcccagtgtaggggaatgccaggacaaggaagcaagagtgggtgggttagtgagcaggaggagaggggagaggataggagtattttcagaggtgaaatgaggaaaggcgatacaatttgaaatgtaaataaagaaaatatctgattaaaaaagacttgtaa

SEQ ID NO: 362 - DNA, 1000 bp, mus musculus
caaatccaaccaatcatgagaatccaccttacactattcagaatggcaaagatcaaaaactcaggtgacagcagatgctggtgagaatgtggtgaaagaggaacactctttcattgttggtgggattacaagttggtacaaccactctggaaatcagtttagtggttcctcagaaaattagagtacatgaggatccagctataccactcctgggcatatacccagaagattctacaatttgtaataagttcacagtctatactaaattcatagcagccttttccacaagctgtaagaacccagatgtctctcaacagagtaaaggatacagaaaatgtggtacatttacacaatggagtaccactattaaaaacaatgaattcatgaaactcttaggcaaatggatagaattagagaatataatcctgagtgagttaacccaatcacaaaagaacatatatgttatacatggtattcacattgataagtggttattagcccaaaggcttggaatacccaagatacaattcacagaccacctgaagctcaggaagaaggaagaccaaagtgtggatactttggtccttcttaaagtggggagcaaaatacccatgggaggagacacagagacaaaatgtggaggagaacctgaaggaaaggctatccagagacttccccacctgggaattcatcccatatacaattagcaaacccagacactattgtagatgccaacaagtgattgcttacaggagcctgacttagctgtgtccagagaagctctaccagtgcctgacaaatacagaagtggatgctctcagccaaccattggactgagcacaggcttcccaatggaggaggtagagaaaggactcaaagagctgaaggggtttgcaaccccataggaggaacaagactatgaaccaaccataaccccagagctcccagggactaaaccaccaaccaaagagtacacattgatgaacctacggctccagct

SEQ ID NO: 363 - DNA, 1400 bp, mus musculus
tactttgacataggtcatcttttatctccaataccaatccattattttggaattgattcaccattgttttgaacaactactctgaacaactctgaacaactactgccattgtcaagtgtttctcaactttcaagaatacaaacagcccccaaaacattgatacattcagtaattttaaattgctaagatgttgaaaaagttattttttttcaaatactaaaaatcttgttttctgaaattttgtgcccaaatgaatcatgattttttgagttaataataagttgaaagagaaaatcatagaacataaacaacacatataatactggaagtcattatgaggcagtattcctgactttttgaggtgagttttgtaaaaataagttaaactcaaaaattacctatctctgagctgaaatgattttaaagtctggttcttaaaagttggcataagattaaaaagactttggagaaagaaaagttgagagagaaagtgggtggaaaaaaggagaaaatatgttaattgaatttggcaaaacaaacccagaatttccctaatcttttcctcttgaacaattctgtcattataatacatttagcccttctggtccaagcagcaccggggtagctagggcccacagtcggctgactatcgccagctacccacaacaccagccacacgatcctaagaattctgaggattgggatctgcccagcgcaggagcgctttgcccgagcataggcagcagacatctcgtttccgggaccccgccgagtgtatcctgcacagacagctggccattttcccggccagaggataggaatctgcccagcttgggagcattttgcctgagcatcagcagcaaacatcttggttccggaatcccgcctagtgtattctgtaaaggcaagtgaccattttcccggccagaggatagggaactgcctggctcgggagctcattacctgagcattggcagcagacatcttagttctgggaccctgctgagtgtaccctgcacagacatcttggttccaggaccccactgagtgtatcctgcacagctccagagaataccagatggcgaaaggcaaacataagaatcctactaacagaaatcaagaccactcatcatcatcagaacgcagcactcccacgccacctagtcctgggcaacccaaaagaaccgaaaagctagacccggatttaaaagcatatctcatgatgatggtagaggacatcaagaagaacattaataactcacttaaaggaatacaggagaacactgctaaagagttacaagtccttaaagaaaagcaggaaaacacaaccaaacaggtagaagtccttatagaaaaacaggaaaacacatccaaacaggtgatggaaatgaacaaaacca

SEQ ID NO: 364 - DNA, 1000 bp, mus musculus
catgctaccaggggtaggggagggggggagataagcagaaacctagcttaaatccttaaacttactgtggagtcctgattacattatatactgctccaataatggcacaaaagttgttggagtaaccacacactatcttctcggggatattccatatctgacgttgctcatgtgcctaaaagccttggactagataggccatggggctagaagaaaaccaaatattgcccctagccaaaggaatataacaatatgacgagtcataaaaacattctgctatatccatagatcactgctttgttttgttttgttttgttttcagccatctttagagatgtttccaattgcagtagatgggaacaaactcagagacccacaattgaacaatgtgcagaaagtgagagactgtggaactcctgtctccatcaaaccacttccctgaggacacagggatctttgtgtgtgtgtgtgggggggggggggattgttcaagtgcaatttttttgtttttatttttattagatatttactttatttacatttcaaatgttatccactttcctattttcccctcagaaaatcccctatcctctcccctctccccctgcttcccaacctacccactcccacttcctggctcaggcattctatactgggacatagaactttcacaggaccaagggcctctcctcccactgatgaccaactaggtcatcctctgctacatatgcaactagagccacaagtccccccctgtgtgttttctttgattggtggtttagtgcctgggagctctgggattgctggttagttcatattgttcctcctcctagggggctgcaaaccccttcagctccttgggtactttctctagctccttcattgggggaacctatgctctgtctaattgatggctgtgagcatccacttatgtattagtcaggcactagcagagcctctcaggaaacagctatatcaggctactgtcagcaagttcttg

SEQ ID NO: 365 - DNA, 1400 bp, mus musculus
ctctatttaataagcatatccaaactcagacaaagtaacagttaaaaaaagagtatcagagagaaggttagaaaagatggacaggagtaagcgttaggtctgtgtagtttatatgtaatagcaaagtctaatgttactcatgttaaactaagtaatttgaaacattcatttatctacacattgagtcactctaagttaccttcaagaatcaaatacttctaattaaatacattagtttttctcatttatattgtctagaattagtatctaaatcatgcaggttatatgttgaagtagaaatttcaaattatatattaaactagaaaatgatgttactgcctcattggcattcaaaaacactttgaagttaataacgcatttttcagtaagtttctttgagttctcattccctctatgctcattaagcttcacctttcaggtatggtcatatctttatgaatccacacatgtcaagacttgccatacttgaccttttgaactaggtacttgaaatctcacattccatgcattttcatgccattgagtcagtccttttacttatttaaatacagaaacaatctatccactttgtataagatatcaatatagagtgtcagttaaaataggtagaagttttctgatattgatggaattttaatctaatttcccaattgcagtgatttgaatagtttgggctctaaaaactcaagggtttgaatgcttgacctactgggagttacactatcaggaattatttccttttttagaatatgtgtggccttgttggaggaaatttgtcacaattggggtgggatttgaagtcttatgctttagctctgcctagggcaaaagagtttttcctctccttgctgcagttggatcagcatgcagaactctcagcttcttccccagaaccatgtctgtctagaccctgccatgcttcctgccatgataatggactatgtcactgtaagccatttccagttaattgttatcctaatgtaagagtcaaaagggttgatgcattgtcacagcactggaaatcctaactaaggcaaagttggcacaagaagtagggtattactgaggtagacctgacaaggtgtttgtttggacagatgtggacaaggtgattttggattcggaaagccatgtcatgctttaagtgggacataatgagtcatcctaacaggaatatggaaagcattggtgctgaggttgacttgacctctagacatcttccttataataatttggtgaagactgttgctgctttttgaactggtccaaaaagactacctgagaataacgtaaagagatttatattaattgtactgacaaagaaatctcaaaaaaaagcctaacatatgcttgattctctagtttactctcatgtagaa

SEQ ID NO: 366 - DNA, 1800 bp, mus musculus
ccagtgaaggctcaatgcaccagtgtagagaaattcaaggacagggagacaggaatgggtaggtggttgggggaacaccctaatagaagcaggaggaggggggtgggatggggtgtttctgggaggatcaggaaagggaataacacttgatatgtaaataaataaaatatccaatttataaaaaaagaaagaaaatgtcagtattttatggggggaagaaaatgtctaaaagagaaaggaaagcagagtgtttaactagaatttgcttcatcctatataaatggtaatattgagtgaggaaagaacacatagaaactctgctacaaatctggagttaagactctggaaatgaatatcaaggaaaactggtagaatatgtgatgttagcctatttgtgtaggtttggcctgtgggtttacaggaattgcctgctgtggttagttattctaataacaatgcatgtgtgtgtgtgtgtgtgtgtgtgtagcatagacattggaagagaagatcaattgatttgccagtgatgagggcatgacaggaagaaaaatccatagaaattggttagttaaaaagatagagtgaaactgaggtactgaatttggagagaaattagagagggggagagagagagaaaggggaggggtctgtatttaaactaccatttaactgttgagagtgacctgttcccagggactacttgcttccttgggaagctgagatgacagcatgagtggaaaggtttgaggggggaaaatgttgaataattgattagagatgggaacagagcggatggaaaggccacagcaggttgtctgcacaaagttttgggcaagtcaaggagactgtatgtagacaagagggaaaaatgaagacctgtagttcaccaaccactttctctgcacagagtgacatgtactcccaaggaatgcctgatgaagtacaggataggataaaacaaatgaatatggagaaggaaggttgagggggtgatctgcgtgatctactgaagatgggttcttggaaaggaggaggctccaggagacggtgctcccttggaaggaaggggctacagcattgtagagaagactagaggatctgatttgaagaagagaagggtttgtcaagtgtgcaactgaggcacttgttttcatggtctgtgattttttaaataaccgaggaatcattcccttttgtgcgttgggataattttatgattttttaaaacatttttgctataacgttttacaatctgcattgcaacaactaagtgtgacataaataagaaaataaactgtcataatatagaaaatctttatttgcatactatttgatggtatatataatatgttaataattcaaagtaaggtcaaaatcagggtgataaaagtattgctcaaaaataatgaaatagttttaaaatatttcagacgattcaaagagttaaccctatacctaagacctgtaaaatcacaaaaccaaagtgtctatactgtcttacatatagatttatgtttaaggctattatctttcttcttgaagaaaatatgtaaatacaattgaaattaaagcaactaattaactatatgtattacatgaactgagtaatgtaaaatgtaacatagcattctaagtgactgccaagatatatgaaaactctctgtgcatcttaacgttaatactctttttttccaaaataagtatggggcttttttttttatttgtggacaaagccatcatagaatcccttgtctgatttgtccagatcccatctatgataataaaaactggaacaattag

SEQ ID NO: 367 - DNA, 1000 bp, mus musculus
ataggcacacacacacacacacacacacacacacacacacacacacagaggcacacacacacacaaacatattcacacatgatcatgtttgctttgtgttgcttttgctattaaatattaataggcaaatttaatacctagtgagttgttatctcacacttgggaatttatattgtactactatagaaattattgaaagaaacaaatcctatcagagaccctcatgctgtctggaggcctgatcatctggaatcatttttctctcaaaactgcaaagctctggctgctgtctattctcatccgactactcccatgccatgtccacagtacagactctatttctttgcaactacagaccaatggcaggcctacatgtctctttctctctgcaaatgatggacatgacaggaacacataacttggcaacttgtgatgcagactttggtatgtagcagatcagatgataacagaacactttctaaaattcatggtaaaatgttaaaatcaaagcaaatatttgtaactctcttttatctgtggtcatagataatgctatatataaatggtaatagttcaagtgcactaagagagcatttgcttgtttctgacaccctgtacctttgaaaatcaagggataggaactccacagcaagacaaacagaatcaactaacctggagccttggggctctcagagtctgaaccaccaaccaaagaacacacaggggctggaactaggcctccccactcatatgtagcagatgtacaccctgaccttcatgtgggtcccagacatctggtacagaggccagcccaaaagctgttgcctgtatgtaggatatgttctactagctggtctgacttgtttggccttagtggaagaggaagtacctagccacacacagaaatcaaataccaggttagtggggagtacctgagagtccctacccacttagaggagaaagggagggggaaaagcttgtggaagggagtgatgggagg

SEQ ID NO: 368 - DNA, 1000 bp, mus musculus
tcattatagtatcaaccggctaagaaaggtatgtcaaaatcggagctattttaatattattaaaattatacaagcattttatcatgtaagtttctttcgtaggtttattatttggagtatttgcttattctttttttaaattttcatttaatctttttttttaaacagtccagattttatttccctctagtccaccctctgactgccccatatgccatacctcctccctgtctgctaccctactgtctccacatccccctttagcatccttcaccccacctcaccccaccagacctcccaaatccccagggactccttaaggctcttgagggttaggtgcatcttctcttactgaatcaagaaccaacaatcctctggtgtttaggtgttggggagtctcatatcagctgatgtatacagcctgattgctggctcggtttctgagagatcccagggttccaagttagttgagactgttggtcttcctatagcgtcaccctcctcctcaacttcttccaacttttccctaattcaaccacaggggttgcctgttactgtccattggttaggtgtaaatctctgcatctgactctttcagctgcttgttgggcctgtcactgagcctccttttcctcaggctcttctccatttttattcctgcagttccttcagataggaacaattctgggtcagagtttttgattgtaggatggcaacaaccctgtttgtccacttgttgctctgtctttccactagaggtggattctacaagtttcttcttcctactgtagggcatttcatctaatgtccctccctttgagtcctgaaagtctcctagctccaaggtctctgctacattctggatgcccccccccacctcctacttctggaggttgcctatttccattctttttgctggccctcaggggttcagtcctgttttcccattcaatacctgatcatattctccttttctcctccctgtccttttccccaccta

SEQ ID NO: 369 - DNA, 1000 bp, mus musculus
tatttccacaagaacaaatactgagagctaaactttttttttttttttttatgtctagtggtgtgttgatatcataggtttctgcacagattgctgagcaacattagtaggtttagaaaagtcagaacttgtccagactgaagcccaggaccagatagcctaaagaacgtcgaagtgtaggtcaagaagtcatgaaagtagtagagctgcccctgccccttacctgctgcagcactaaggagacatggccctcacctcacatgggcagtacagtagagctggctcttgggggcatgggcatgggagaactgtccctgagaacatgagagcaagagagcagatcctgccacttgcaggctacagcactgggtataccagatgaggcagtgctggacagctcaggcaggtgtggcctgtgcaggagagctggtgggctgaccacctcagctatctgaggctttgaattggaccacgtcaacatctaccctatccatgaactcctgaaacacatgaaaaaactggtcccacagatcagaagctttatgagctccatgatgcagagtaaccacaactgaggatctattgttgatagtgtagcagaagctagaggacttgaaagagactgtattagttagggttctctagagtcacagaacttatgaataatatctatatagtaaagaaatttattgatgactaacagtctgcagtccaattcccaacaatgtttcagtagtagctatgaatgggagtccaaggatctagcagttactcagtcccacaaggcaagcaggctaaggagcaaaagcaaggctcccttcttccaatgtccttatatggtctctagcagaaggtgtagcccagattagaggtgtggtccaccacacctttaatcccagatgaccttgaacttggagatctcccctgtcttaaccttctggattgtagctcattccaaatatagtgaagttgacaaccaggaatagccactacagagacc

SEQ ID NO: 370 - DNA, 1800 bp, mus musculus
acggttgaataagacactgatgtatgaatatagcagaatatcatcagtgatcactttttgtcattttggttttgctcagtagtatttggctttatgttcaacactcataaccattaaggaaatgaaaatcagaattattttgaaattctatcttcttactgtaagaatggctaaggtcagtcataaaagtgacatctcgtgctagcaaggatatggattaatacggacacttctccattgctggtgggattggaaacttctatagccactataaatatcagtatggtgtttccttagaaggattagaatcaaaatacctcaagatccagtgatacccctcatggatacataaaaccgttgtgtcctactacaaggcagttgctcaatcatgtttcatgctgctccatttataatagtcattaattggaaacaaccttgatatccctcaacaggatgctatgtttacacaatggagtattacttaccttttaaaatatggtgttatttccaacttacagtcaaatgaattgaactagaagaaagtcatcctgagaaagttagcccacaacaggaaagataaatatggtgttcattcacttgtatatggatattagctgctaaataaatgataacaaagataaagtccatagatccagagagggtaggtgtagaggacgggaccagagggaaacatggatctctctggggcagggaagaaataaaatatattttattgcttgacaagaaccagttgtgggagaaaaatgagagaaatgtgagaagggtgaagggggactgaattaagaggagagagtagagagatggaggagtaaggaaagaaggtagaggcaggtagaagtgaaaggcgtctgagggacattgttttgaataagtagagaataattcaattaattctgaaatcatgtaatgctgttttgaaactaagatttagaaatgtatcatgtaaataatttgaaaatcctctctaaaatacaaaggatgtaatgcaaaattcacagtataagctgtgctgtatttttagcatttattaactatttataattacttataatagtaaatataggttacattttatataatatatctgaagtttgttttatgataaatattttcacattattgttggagaataacatgtagagtttcaatagcattagacatagccagtattttgacttaatatgtaaagccatcattacaatctgatatgatgaatctataaatggggatgcatgctttgaaatactaattataaaaacataatatttgatatttttaaaatgacaagttgctctgcaatggtggcacacaactttaatcccagcacttgggaagcagaggaagaaggacttctgtgttcaagatcagccgggtttattgagtgagttccaggacagccagaactacaagagaaaccctgtcctgaaagaccaaaaaaaaaaaaaacctgattgttttactggagaaatataaaattcattatttttcatatgttagtaaagatctaaaatgatcgaagatataaattcaatcagtgagaaattttctcttacaccatggaaaatgactcataagataaaatcacttgctttctacaacagatgacattagatcagatccatagaatacacatgaaaagctgaatataataatatgctgtgtaatctcttcattccgcgagaaagttgttgctaagataaaagaatcagttgaagaacattgagttaccaagaccactaaagtgtggggtacaaagacagaaacaacacaatacacttt

SEQ ID NO: 371 - DNA, 1200 bp, mus musculus
gtcatgcctccatgcaggaccagaggttttactcagatcctattttttgaccaaaagtcacaaagcagtacagaaaacaaagaatttaagacaaattaaaaaaatgagttcctacaataaccaccttttattacaaggaaaacagtttgccttcagtggactccacctatcctgccaacccatcttcattcagataatagctcaaagcatcagtacacatgtgaggttttctttcttctgtaacatagcatttaagtcttcctaaaatgtaagtgtgcctgtgtccttgtcttcaatttagtgtgttgccagagaaaatgagataaggtccattgcgcatcaggatagaagtgtacctcaatattctctaagccagataatgtctggctatctctctagctgaatgatttactgcagtgaaaatcttgttggaaaataggaaaacaataataacaacaaacaaacaaacaaatgaaagcaaacatgaaggaaaagatccaggaatctttgtgagaggagaaaaaaatagaaatactaattcccattaacatgatctttttaaaaagtgggtttttttctgcaccgttatgtatttctatttttttttcttgttctgacaaagtaggtaatgctctgacgaaaacacaaaggaacttagaagtgtcgagtatctttcaagtgccaattcattttatctgcaattctactgcatcaatctgatagtgaagagacagtgtagaaaagcataacagaaaggatgaaatgataactgctatagtaaatgatggagccatttcagtgcacactgcagtgtgaagctgtttgatatgcaaatctccgtttctcggctctgcatgcttccatcatgtttctctacttgtgttttattttgaatgtttattaactcatctctactttactaaatctttcctcctctgcactccatatgctatgtgtgcagtaaaaaactcattgtattaaagcatgctttcagcattttgctttattttaaatacttttaagttattcagaagaatcaagatggtaatgaacactttatttttgttgtctcgataatgaaattaatagttattctgtgaaataaactcactacttcaagttgaacagatctctattaatttggatgacaaactgagctaatttgatgaccaagatagcattactactttgttgattcaa

SEQ ID NO: 372 - DNA, 1200 bp, mus musculus
aataaagtgctatttttgataattataatataatttggttatataatttcaaattttacttcttttgaacacatcatatgaattaagctagaaataacattattcaaaatcaccaaaatgtctcacttcacattatctccatataatcattaagtcaaaagttgatactctattagaagtgtcacatatattaaatgaaaattttaagttgcatgcatattgtaaaccttgactcaaaatacacagttctctcaacagtatttaaataagaaaaaaaatctaacataaaaatagatttctaggtttctggaatgctgtcattgaacaacaatcacaattttactaaacttaataatttatggataataactgccaagcagtggtggcacatgccttgaatcccagcacttgggaggcagaggcaggcagatttctgatttcaacgtcagtctggtctacagagtgagttccaggacagccagcgctacacagagaaaccctgtctcgaaccctcccaccccaacataataataataatttgtgaagaatacttggtagctatatgcactaaattttggacatgatttatctaagatatttaatattttcaaaacaattattaagtagatttatatgcattatatgcatgtataaaatttaaaacgtatttgcaaccacagccaaaagaaagcagaaaaagatatacgctatgtattattcaacatggtactgtgtgattaaaatcacatgctaactatgaaattagagaaaacctgagatggtggtgaattaaacctgacatgagtttcctggtgtactttaatgtctcattgggatcatctacacacacacacacccacacccacacacacacacacacacacacacacacacacactcacacacactcacaccacacttgagatatccactctaaatagagagaatacattcaatgtacaaatcctaatgctaaaaatgacaaaaagatattttcttaatttggtatttagcaaattttctcaacactcaccattcttgacttgcatgagtacagctggatctagtacagagaattgtggcaatttgtgtacttatgctaaagaagcctaattctgaggtaaaagatcttgtgttaaagcagaataaattagaggcactaactcctttctccacagactaacttcataagtgaatact

SEQ ID NO: 373 - DNA, 1000 bp, mus musculus
gaaaaggactgaagccctgagcgccagcagtaagaatggaaacaggcaaacttgggagataggttcgggaccctccagaatgcaccagagacctaggaagtgaggaattgtcaggactcaaagggagggaccttagatgaaatgccctatagtagggagagggaacttatagagctcacctccagcaggaagacaggacatcaagtgaaggatggggttgccatgctacagtcacaattctgatccataattggttctgtctgaaagaattacagggatagaaatggagagaagcctgaggaaaagaatgtcaatcaactgtctcaaggggaggttccaaggcctgacattataactgagactacaggtgctcacaaaaaggggcctatcatgactgccctcctaaagacccaacaaacagctaaaagaattagatgtagatattggcacccagacaatggacagaagctgctgacccctgttgttgaattagagaaggctgaaagaagctgaggagaagggcaacccagtaggaagaccagcagtctcaattaatctggacctctgagatctgtcaaatattgtaccaccaaacaggcagcatataccagctgatatgaggcttccaacacacatacagtagaggactgccagtcctgtgttcattcaaagatgatgcacctaatcctcaagagaatggaggccccaggtgtttagaggtcagaaggggtggaggggttgtcatccatgtgcagacaggtaggtggggaggaggtatggaatgtggaacagttggagggtgggtggatggggaataaaatttggagtgtaaaaattatttaattaataaaaaagaaacatctgaatagtaaactgtagaagaggtgaagttttacaaacaactcatctaataatataaagaaaatctaaaaaaactttaaaaaatattaataatctatccaacttaaaataagtcaaagatagaatagagacttccaaa

SEQ ID NO: 374 - DNA, 1000 bp, mus musculus
acaggaaactcatagcttgccatgagttagccactttaaccattccatgttggaaaccttcactcttcctactacaccatagggccagtggcagacagagtgtgtggggcacgaccctcactacccagtgttgcagctctgagccactctccagcagcttgtcctttgtctctgtagctttctggggctcttccattagtttcagatttcactcctctgcagcctcagctcttggcagtagttcaccacaccagtatctactcttcacagctcttcagttcccccactactaccacgccacccacccccgtggatctgctctctattatcccttgccttctttgcacttcacaagactcagaattctgcagactttgtgaaccaagccctgtcactcttctgttgttataggctatgcttggagcccagtaacctgggaaatacctacattttatgccaccagctcagcccactctaccaatggaaatagaccatatctaggaagtaaaaccactctaaaaaggttttattgagaggaggactggaaagaatgaaggtttccatgaatgatgcctcatgagtgagaataactctggttagatgccactgtcacatgcttatgctaccatgggttggatggaggctccttaatatcccatttaagggctgctatgatgaggtccaggttggatgtgaagagaggaaattatctctagttattgcagggaaggtccatttggtagtcatccgaaggagtcactactgtctcccaagtgatgaatggcatttttggtgattcctactataaaggagtctcttatgattacattattattgagtaatgaaaccttggtctaactacttggataaatgtatcaaatgaagcagtcaggagaattttaaaatggtagggactgtccaaatatgtgtttatggtgtcaacaagggcagctacttaaatgacatcttccagcacccctaaatgcgcaattgctaccat

SEQ ID NO: 375 - DNA, 1200 bp, mus musculus
attgttactacttccattttcagatcctggatcattttgctcaattccttcccctgtttgtgttttcctttaattctttaagggatttttgtgtttcctctttaagggcttctacctgtgttctcctgtatttctttaagggagttatttatgtccttcttaaaatcctttatcagcatcatgatatgtgattttaaatccaaatcttgcttttctggtttgttggggtatccaggacgtgctgtggtaggaaaactgggttctgatgatgccaagtagccttgggttttgttggtaaggtttttgagcttgccttttaccatctggttatctctgatgttagttagtcttgctgtctctgtctggagcttgtccctcctgtgggcctgtaatcctgtgtaagcactcctgggagaccaactctctccttgcagaacctttaaacagaaggctgtggaacagccttagctcagtacagatggcaaccttagggatcttgtcccagatggtccactgttcctgttccctgtgtgcttacttgagagaaagtggctatctcacctcttaacctgggagtgagagcactcctggaagaccatctctctcctggcaagacctgtgtacagagacctgtgctacatgaaacctccttgaatcatgagagaatatagaatatttggcttcaaatgaagaaggattttatttttatgctggaccagttatgacattatgtgaattttcaatagaaataaaaatagtcaaagaatatgttacactaataaaaaatcatgttatactattttatttattgtttgtttgattatgcatgtttcttcttaatgacacttacaagtcttgcagatccttgatgtacacttttgtgatggagcatttgtggtcatttctgcctcaagtgagatgcctattcactggtactacatcctgctttatctgtagctcttcaatgtcctggtttatcaatctcaagatgttatagctactactcagaaaagcagcaggcaaaatatgtcatccaaattatcggtgttacagattcttcttatctaaatagtgattggcagagtctagattacattgaagaagaaggaagacaggaagaaaagaatactctgctctataactttaacaaaagtttaataaaaatagaatttatgagttttgtgctagctttttgtttta

SEQ ID NO: 376 - DNA, 1600 bp, mus musculus
cattcagaggagtataggtgtagtggaagtttaaatgtaatgtaatgctttgtggatttgccacatcaagaattttcaaattattcactgcaaatctattcactccgtcgcatttcacttaaacctcaatatgtctcgatcagcctcctcctcctccttcctccccctcctgctcctgtcttcccttctcctcttcctctccctaaccctcccacctcacacaagccagcctcaaattgtcctcatccttctgcctccatgtcatacttgctaagattatgcacattaatgccctcccactaccaccacctaatgagtatctgctaaagaagtaataatatcagatgattattcatggcagcctgtcagtgccggaaaccactccacttctttcagggttaagaacaagtaggattgccctggcaacaggcaaagagaaacctccttgatagcagtgttcttacatcagtcaggggcagatgggtttggtggccaaagttgtattatgcctaggacttctagaaatcaaatcaagtcaaatctaggtagacagtgcaacaggaggaaggcagagagaaatctgtagagtaccatgccacctacacacctgccctctggcgcatggcacaggtgggccacagacatcagcttgcagccatgctacgccccagtgatagacgatgtcacccaggagcctgccagccaaatggtcagcctgcagcaggagccactacaatgtgtgagtatgtagttgacaggtgggagagaaagagaagtggaacagcttgaacctcatgaagagagatagaactggagagtctagggttgagagaaatagcctgttgcgagtggccagtcccacagcctgttgctgaggaccatgtctgagtccagggctatggagctgcaggggtcagtgtcgacatccttggctcatattaccattagagaacatggggacatccctggtcaaggcaactgctagagaccacatggatgtccagggactgtgcagacctgaccctgccctgtctgcagagccctggagagctggttccatctcacaactgagacagcactcaacaaggaaggcactgtttctctcccaggcagcacagcgaagctggccctggtgccagggttgtgggtggtccagccccaagggtctaagtgtaagagaactgaccttaccactcatctgccatggagggggcatgggcagagaggtgattccgtgctccccacccctgccccttgccacctcaggaagtcaggaaagctgcccacagattcagggtcatgagcttgtaagagttctgccccctcacccaatgcagcacacaggaatgtggcccctaacctcacctggacagcatagcagagctgaccctagtggtgcagacacaggcaaggcaatcccaacaagtgagagggagaatagagcccaccactcttctgccttgaagtggtgtgacatgggtgcaggagtagtgccttccccatcacccctcactacctgaggcagtcaggagaactagccccggggtcctgacagcaggaaagctggctttgtccctctccagctgcagtataggcactg

SEQ ID NO: 377 - DNA, 1000 bp, mus musculus
gtagtttttacaactatatagtccaacatccaacatggtggtttgaataaaaatgatccccataggctcatagggaatgagtggtactattaggaggtatgaccttgttggagtaggtatgacattgttgtaggaagagtgacagagttatctttctgctgcctgcagatcaagatgtacaactctcagctccttcttcagcaccatgtctgcctgcataccaccatgtttcccactatgatgacaatggactaaactcctgaactctaatcctgcactaattagatgttttcctttagaagagttgctgtggccatggtgtctcttcagagataaggataccaatccacccacaaaacgtttggcccaaaacttatcctgtctaaaataaatgcaggaacaaagatggggaagagaccgaaggaatgcccaaacactaaccagcccaactttagacccatcccttgggcaagcaccaatccctgatactattaatgatactctgttatgcttgcaaacaggagcctagcatgactgtcttctgagaggctctacccagtagctgactgaaacagatgcagatacccacaactgaacactggatggaagtcataggtccttttggaaaggttggagaaaaaattgaatgtcctgaaggggataggaaccccacaggaaggtttacaaagtcaactaacctggatcctaaatgttcttaaagacaaagccaccaaccaaagagcatacacaggctggactgaggtccctagcacatatgtagcagatgtgcagctcagtctccatgtgggtcctaaaataaacagagtagaggcttttcctaaagctgcagcctatctatggtatctgttctccaacagggctgccttgtctggcctcagcaggagaggatgcacctaatcctacagaaactcaatgcaccaaggtgagaggaaatggggagggaggaggtgcaccctctcagagaaggggagaggaatgg

SEQ ID NO: 378 - DNA, 1200 bp, mus musculus
ttatccctaccactcaccagctgcagcactcaggagagcaagccctgcatcttgtctggacagcaccatggagctggccccgatggcgatggcaggggtgtgggtgagcctcctctgagggcgagagcttgggagagcttacccctttactcccctacccccctcttgcctgccgtgaagtggcttgggttatggtataatgccccttgccatctttggtagtctggagaactggcccggagcacatgagagtggaagagatagtcccatcccttcattggctgtagcacttggtagagtgggccctggaatgtgtgggccacatgtcgagctggccatggtgacaaaggcacacttgtgccagtcctgagagtgtgaaaactgtctgagacccttgcaggcagcaggacttgggaaaatgcacccccccccaaaaaaaagaaccctttgggccacaaatttgaactggctctggaagcctgaatataggtaaggatgagccggctctagggcatgaaagcaggagagctgatcctgtctcctgttaatggtggcattgggttccttgctgaagctgtgctggagagctcaccctggtggtacagacatgggagaggtggtgagccttctgccacccaggtccagttctagggctctgaattggcctacccacaaatctgtatcatctcttaactgttggacacattaaagggccagtcctgttgatccaaagctgcaaggtctctacgacacaaggcagctaatgaagattcaatattgatagtgtctcagaaggcagagagcttgatgcagaccaatgactcattacaataaacatttgctccatttcctgcccctctactcttcctacattcctggaggcctgcaggcaccacagacaagcaagtgtgaccctgttccaagcccttgcctgacatatttccctgaaacaaacccatcagttttaacttgcactctgcccaccagcaagagaagcccctggctacactggtactagggaccctagaggcaagggtagaacccaaaaccttgcaggcagcacaggccataaaaaaatcccaggggagacaccatactgtatctgaagactggttagtcaccagaattccaggccacttaggccagtagacatcgaggaaacagatactaagggaaaaaaatccaaaacacccatccaag

SEQ ID NO: 379 - DNA, 1000 bp, mus musculus
atacgagtaaggataattcatcaaccatttatcagattaagataaaatattttttcaggatactgtgatctgcatgatcctcaaaatgtaggtatctaagcatgatgcctactgtagaagtactgtaatatagtgtcataaagcagtgaaggctgcatctctatgaatgcatcattacctccttaaaggaccagcactggtggggaaacctgcactgcttcctgctcggtgagatttcctggaccacacagtttgtggaaactgggctctcaccagacactggtgtacaggtgtccaaacagtctcagggactgtgagaagcaaattctttatggaatactccattttggcttttgttataacagcataaatagatgaaggtagatagctcctgtggtcttattctctgattcattttgagtccacatagacttaatggtcaaagaggaataagcccataaccttttctatacttgactatgaggtcttcatactaataaaactgtagctagttagagtttctactttatttcaaagtcataatttatgttctaactttatttttcctttaaggatttttccccaaggatgactaaatccattcacaaattacttgtagttgtgtaagaatctgaattctccaaagctattttgttcactccccaaagagaatcctggctgtgatgatcaatttaaagactaagtgattctgaaatagccccttttgagactttgtgtcagagtactctgcaccatcaacctccatatctagtgggattgccaacttgtacaaccactctggaaagcattctggtgattcctcagaaaattgaaaatagttctacctgaaaacctagcaattccacttctgggcttatacccaaaacatgttccattatattacaaggccatatgctctactatttcatagcagacttatttataatagccagaaattgaaagcagctctgctgcacctcaattgaagagtaatacagaa

SEQ ID NO: 380 - DNA, 1000 bp, mus musculus
ttaattaatgaacactccagattttattccccgcccccgttcaccctccgaccattctacatcccacatcttctccccaccccgttgtctccataaggatgtccccatcccctaccccaccagacctctaaacaccctggggcctccagtgtcttgaaggttaggggcatcatctctgattgaacacagaactggcaatcttcttatatatatgtgttgggggcctcatatcagctggggtatgctgtctgtttggtggtccaatgattgagagatctcagggtccagattatttgagactgctggtcctcctacacggtcatccttctcctcagcttctatcagccttccctaattcaacaacagtggtcagctgcttctgtccattggctgggtgcaaatatctacctctgatcctttcagcttgggtttttcggagggcagtcatgataggtccatttctgtgagcgctccataggctcagtaatagtgtcaggccatgggacctccccttgagcaggatcccactttgggccaatcgctggaccttcttttcctcaggctcctctccatttccatccctgcaattctttcagacaggaacaattatgggtcaaaattttgactgtgggatggcaaccccctccctcatttgatgccctgtcttcctgctggaggtgagctctataagttcccttttcctactgtctgggcattttatctaaggtccctctctttgagtccggagagtttcttgcctcccaggtctctggtgcattctggatagtccccccaacctcctacctccagaggttgcctgtttccattcttcaagcactattttatacagcaagaaacatgggcaatattttaatcaaacaacaaagaaaattcttcctatcatctcagatattcattgatgaattctaaagatcaatatttaaggttttagggagtcatttgtgtgaatgcttctttattgttattgtcattgtattta

SEQ ID NO: 381 - DNA, 1000 bp, mus musculus
tattcaaaaggaaaagataatcctaattataagacttctcaacgagtcaagattttacagggctgtagctacaacaaaatcagagggtgtcaaattattacagaaattgtctcatgtgattacagagatcaagtaattaagctacagagactgttcagtgtttaatagcacttatttctcttgcagaaagccaagctttgctttccagtgcacacatgatggatcacagcagcatggattcctatttcagggactcccataccctgtataaatttccttcagctcctccacatttgtgatatatatacttttatatatatataaaagtatatatatatatatatttactcagcaaaacacacacacacacacacacacacagacacacacacacgtacacacagtcacataaaataaatatttttaaaagaaaggtgcacgcctttaattccagcacttgggaggcagaaacaggtgaatttcttagtttgaggccagcctggtctactgagtaagttccaggacaaccagggctatacagaaaaactgtatcttgaaaaaaaccaaaccaaccaaccaaccaaacaaacaaacagaaaaacgaaaccaatcaaccaaacaaacaaagaaaaccaaataaaatgtcatgaacacctcttcagaagctgaacaacactcataaagggaactaatgctaaaactcagtcttgagtgaagacctaaaacatgggagagggtcatgtaagtgtccaagtgtccaagaaccaatatttcaaattgaaagcaagccgagcaagccagggtggaaacaagccagtaaggaacatccctccatggcctctggatcagttcctgcttcctgacctgcttgagttccagtcctgacttcctttgatgatgaacagcaatgtggaagtgtaagacgaataaaccctttcctccccaacttgcttcttagtcatgttttcacaggaatagaaaccctgactaagacagaagt

SEQ ID NO: 382 - DNA, 1200 bp, mus musculus
ctcaaaacattcccatttcatttctgttttaggaagtccatacagctgttaactgtcaaaaagaaatagaaagagcaaactggcttaaattgtgaaaacataaatcaatagaccaaagctatcctatcagattttttatgaggttggcttaaattgacttaatcaaattaaatgttctcaatacttcactataaaaattgctgtatgaagtttttttattggttattttatttatttacatttcaaatgtttttccccttcccagttttccttccacaagccacctaaccactcctcctgctccttgcctctatgagggtgctcccccacctgcccacccactcccatctcagcagcctagagttcaactgtcttggatcaccaggcttccacaggaccaagggacttccctgccatctttttcacagcatttcagttcactatatcaaagcatacttaagaaattactctatatttcaactcttttgtgcattaaaacataatgaattttttgtcctatgtaatattctataaaaggcaactttcacatttttctattcagtatagtagcttccctattctctactcgcttcttacagagtttgtgtcccatcacattttcagttttagcataagattcacccccccacacacacacacacacttgggtattttctttacttacatttcaaatattttcacctttccaggcttccactttggaaagccccatcccatcccccctccccctgcctctatgagggctcacccacccacctacttccatcccccagacctggcattcccctacactggagcctctaacaccctcaggccctagggtctctccttccactggtgtccaacaatgtcatcttctgccacatatgtggtcagcgccatggattgctccatgtgtactctttggctggttatccagtccccaggagttccaggggtgtctggtctgttgtttctcaagtttctgtcatatgccaaggttattttcaatgtttatgttcagacccttgtcctacacagatatgattagaattattcttttattaatgtgatagataatgtttgactccagaggctgtctctaattgatagccacttgtaaataaaaatgttgttttctccaaggactctcacaaaggaaacgaatcatcctttccttttttttttttttcttggata

SEQ ID NO: 383 - DNA, 1000 bp, mus musculus
aggtgggtcagggtctttcctgcctccatctgcacccaggaggtgggggaacaccaaagagtattccacagccctctgtgcactatcttgcaaggagagaactggtttcccaggaatgctgacacaggattacagactcacaggaggaagaagctccacccagagacaaaaagaacatctaacaccagaaattaccagatggcaaaaggcaaatgcaacaatcgtaccaacagaaagtaagattacttggcatcctcagaacccagtactcccacctctgccagtcctggataccacaacatactggaaaagcaagatttggatataaaatcatatctcatgatgctggtagaggattttaagaacagtaatagctcccttaaagaaaaacaggagaacacagctaaacaggtagaagcccttaaaaaggaaacaaacagacaaaaaaatcccttaaagaataacaggaaaatgacagttcccagaggactctccacaccacaggctccctagcacacccaggatcttgggatcactggcgagtggaatgcaacatcttttccaaaaacaacccagagggccttgggccagcaggaacagggactctggaaacacacccagccagcagctagggtacattctggtcattgccagctccgcaccaccttgggcatgaattcaggggacagtcccaaggtccccagaggactctccatgctgcagacactctattacacccaggatcttaggaaaactaaggatagtcagcctccagagagggctctaaccctgagactcagatgacagcaccctcttgtatcctgggtcttgcagagaccagtccacacataagagctcgtgggcctcagaagtaaaagagcttattggacaggaagccttgaggccttcatcttcagccaaaacgtggatctcagctccagacctctgtgcactttccctgcaagaggagagcttgcctgcagggagtgctctgagcact

SEQ ID NO: 384 - DNA, 1200 bp, mus musculus
caacattcttacagaatttcaagcccatggtcttgctcaaggacgttctaggactgttagaacactggcggaaggctttagctatgtcagaattcaatcttaaaaggcacttataataggaaaatactgaaagagagcacgtggatccatacaatagactaacacgggaatggaaaattaatgtatgggttagagggaacgccagactccaggaggagagcttccttgaagctctttgcctcatgagtgactttcaagcctctcggcttaagctgacttgaccaaggcaggatccgggaaccaagatggctcacccaggtgctgtggcaaagccctcctatgtggggtggacacctctcttcaggcagggaaggtgtctggatgtctcaagcctgaaattcaatctgcctcagaagttctgtggctcctgcctgtcccagaagctgttagcttctgtagtccacactctcatctgtgcagactagtctcggtgggaatccaggaaccaagatggctcccctagatgttgtggcaaagccctcctgggcaggggcggacacctctcctctggcagggaaggtgcctggatgtctggagcccgaaatgtggtctgctcagaagttctgtggcttctgcctgtcccagaagctgttagcttctgtagtccacattctcacctgtgcagactagtcttggcagaatccgggaaccaagatggctcccccagatgctgtggccttaacttattatttgttgaaccaacgttatatcatgcttcattacctattatagtaaaaaataaaaatagttagcactcaaactccttttaaaattattttacagtctttaaatactggcgtgctttaaatattttgtaataatgttacatgaaaggatctggtatctttaatatcatttacaaaattatattgaagcttgcatattccatcttataaatgcccacaactaataaaattatattcttagtattgatttttagtatctcaataatcaatagtttttactgactttacaattaacatttgtagtaatgcactgtatatggcaaaaaatagaagagttcttcatatgcttaaacttatcatttaaacttccctaaataatatgcataggctgagcagtctccttttcaataaactgcattaaattctacattaagtatggcctttcacactgctc

SEQ ID NO: 385 - DNA, 1200 bp, mus musculus
cctcctcctcctcctcctcctcctcctcctcctcctcctcctcttcttcttcttcttcttcttcttcttcttcttcttcttcttcttcttcttcttctaattattttatttacatgtcaaatgttgttctcctttttggtcccccctcaatgagttccccagtccatttctcctccccttcacctctaagagggtgctcacccacccacccatttccacctcaccccctagcatcctccttctccagggcatcaagcctccagaggaccaagcatattccctaccactgaaaccagacaagacagtcctctgttacatatttaaaaggggccatagaccaggccacatatttttttttttggaggtttagaccctgggagctctgagatgcttggtaagttgacactgttattcttcctttggggttgcagtccccttcagctccttcagtccatcccctaactcttctacaggggaccccagactcagctcaatggttttctgtaagtttctgcttctatttcaggtagatattggcagagcctctcaaaggacagtcatgccaggttcctgtctgcaagcatattgtgacttcagcaatagtgttcaggtttaatgtctgttcatgagatggatcccaagttgacgtggtctctggatggcctttccttcagtctctgttccatttttccccctacattttctttagacaggaacaattctgggttaaatattttgagatgggtaggtggccccattcctcagctggaggtggctattttcctgttattgggcttttcagctaatatcatctccacttgttcctaggacctcccacatccctggtgtctgggactttctcgtggttcccactgttccacccccacactgctgcatatttctattcattctccaggtccccggggcttctttcctgtcttcactcatacctgatcctggcccctcatttttttctctcccctcccctcttccacccaggtcccttgctacctctgcttcctgtgattattctgttttctgtctgttctaagtggaatggatgcatccatacttggttcttccttctactgtgagttttatcgtgagtattctgaactttttggctaatatccacttatcaatgagtatctatcatttatgtccttttgggtcactcaggatgatattgtctagttctat

SEQ ID NO: 386 - DNA, 1400 bp, mus musculus
catatatattctattttattatattttttctgtcaacaattacttcaaggttttttttattactttttattaattattttatttgttgcctttcaaatgttgccccctcctggtccccctcaacaattcctttaccacatccccttccccttttcttctaagagggtgctccccaacccatctacccactccctcctcaacccacttgcatcccacttccccagggcaacgagtttctacaggattaagcacactttcctttatcactgaagccagacaagggcagtccctagctatgtatgtagcatgggccatggaacagcccataattgttctttggttgatggcttagcctgtgggagttctgaaaggttcacattagttgatactattgtccttcctatggagttgccattccttttacttccttgtatccttcccctaactcttccataagggtccctgacctcagtctaaagtttgtctctaagtgtcttcatctgtctcagtcagctgctggtagagcttctcagcggacagctatgccaacctcttgtctgcaagcacaacacggcataagtaatattgtcagggtttgatgccagcacatggaatgaatgaatcccaagttggacccgtctctggatagccttcccttcagactctgctccacttttgtccctgtatttcctttagacaggaacaactctggttcaagaatgtttaagatgggtaggtggccccatgcttcaaatggggatcttgtctatctactgaagatattctatttaggcttcatctccccactgttgagcattttgggtaaggtcatcccccttgtgttatggaattctctcacatccctggtgtctgagactctctagataccccacttcacacatacacatacactgctacttattcctattcattctcttggccctctggggtttctctcctgactcccaccatacttgatcctgccccccttttctgtaaactcacataattgtgcaagtgatactaaattcaatttttataattttgtattatggaaactgagatatttgattttagcagaagaaacaacatgttaaatccttatgaaaagatttaaaatcaattttgtgggatgaataatgatcaaacatatcagggataatgttaagaactcataaaattatattataaagaatgactattttagccataaaaatgttctaaagattaactctaggagtatatatattctctataggactatatcattttgctaaattcccagcccaggaacaagatagtgttcaaggtttgtttaaattatagttcttgaaaactatccatatttggacactaaataaaagcaatactgtcctcataagataaatgccaggaaaaaa

SEQ ID NO: 387 - DNA, 1000 bp, mus musculus
agtgatacatagtaggccatttaaaaagatgataattttattttgtattctctaatttttttttacactcctgtcattatccccctgctggtccactctctgactgttccttatcccatatctctcccctccccagtctccaagaggacctcctcactccaccgaccccacaacactagacctccccattccctggggtctcaagtgtcttcagggttaggtgcatcttctatcactggtgtcagaccaggcagtcctctgctctatatgtgttgggagcctctgctgtctggttggtagctcatgtatgtgagatctcgggggtccagattagttgagaatgctggtcttcttatggggtcacaaacatcctcaacttcttctagcattattatcctaattccatcacaggggtccccagcttctgtccattggttgggtgtaagtatctgcatctgactctttcagctacttgtgtgcctcttggagggcagccatgctgggctcctgtctgtaagtacattatagcatcagtaatagtgtcaggacttggagcctccttttgagctggatcccattttgggtctttcactgaacctcctttccacgggctcttcatttttgcaacagcagttcttttagacagtaaacaattctatgtcagaatttttgattgtggaagggcaaccctaccactcaaaagatgataaatttataaatatttgtaatagtagattttaaagtactaactggaatgagtgttttaaaaactgtttctcagtatcagtgaacaaatatttcctgccccatccaaatacaaatatagccatatattttccttgttagagaaaaagacagtatcagcaaatttgtacataagaacataaataactgaaataatacaggttagaattcttagtttctgctgagagtagaagagactttccatcataaataatgtaattaatgtacttgtatactgagttttaatgtattagaa

SEQ ID NO: 388 - DNA, 1200 bp, mus musculus
caatatagataatttttttattcagcagggaaattaggtacatcaccaaaatatacgtaatttgaggaagagtatagtaaattctataacacacaaaatttctggtttaaaacaacaaaacatatctaagcctgatggagaacatcagcattcccagaacttcaaactcaaaggcaggaggatcatatattcaaggtcagcctgaactgtctaacaagtctgtatattaggaatcgaactattagagattgaaaaaataattatttggaatgctttttaaagaggtcaggcaaagtagcatcgagtgaaaataaggttgttgttatttgacttgcaatgatggcttagcaggtaagccctttgtccacaaacccgatgatccaaggacagggcccacataaaaaccctggatcaggtagtgtgccctggaatagcagcactcacacagaaagatgtggactggagatgagagtcccttagaagctcttagacaagctgtcacaattaagcaacatagtggcagaaaaagcaaggctctgtctcaaggaggttcctgggtgggagtggggatggaagtggcagcagagggtgggaggagtggagaggcatcaacaaagttgtcctattatccccacacatgggccatgccacaagcacatgcgcttgcacacacatagagaataaataaataaatgcaaaatattgatattaaaagatgctaaaaggcagcaattctttctcctaactctaggggaaaattcactcccgtgatttccagtttctaaagagagtgtgtgttctttgactagcagctccctttttctctctaaaagagcaacaatttaagtctctggccggtctttaataatcacatgtctctggaatcaccttactccccttttaaacagtgtgatcagtataaacactatgtccccacagacatttcctgattatttttccctattcaggttacctattcttaatgtttttaaagtttattttgcaaaataaagtaatatgttctgaggaggctttgaagatggccacttttggacttcctttctctacctactatggacctgaactttgggtaagttctatactattgtactaatttgactctatttacatatgacatcctagagctttgcattgtcctgtctggcttaacatttgtaaggtagttttattcttgttgca

SEQ ID NO: 389 - DNA, 1200 bp, mus musculus
tatttgtcttattgactatgtcctttgccttacagaagtcttccagtttcatgaggtcccatttatcaattcttgatcttagagtatgagccattggagttctgtttaggaaatttccccctgttccaatgagttaaaggctctttcccactttcacttctattagattcagtgtatctgtttttgtgttgaggtccttaactctttgttttaattaattaattgatttattttattagatgttttcttttttattatttttattgcgtatttattttatttacattttcaatgctattccaaaagtcccccacacgctctgccacctgctcccccacccacccactcccacttcttggccctgtacttcccctgtactgaggcatataaagtttgcatgaccaatgggcctctctttccactgatggccgactaggtcatgttctgattcatttgcagctagagacacgagctccggggggtactgtttagttcatattgttgttcttcctataggattggggatccctttagctccttgggtactttctctagctccaccattgggggccctgtgatccatccaatagctgactgtgagcatccacttctgtgtttgataggccctggcatagtctcacaggagacagctatatctgggtcctttatatacatttcaaataatatcctgaaagttcccaataccttccctctgccctgctcccctacccacccactcccacttcttggccctggaattcccctgtactggggcatataaagtttgcaataccaagcagcctctcttcccaatgatggccaactaggccatcttctgctacatatgcagcaagagacatgagctctgggggtattggttagttcatattgttgttgcacctatagagttgcggactccccttcagctccttgggtgctttctctagcttctccgttgtgggccctatgatccaacttatagatgactgtgagcatccacttcggttgggcataatactaccggaagatccagcactacctctcctggacatatatccagaagatgttccaactggtaataagaacacatgatccactgtgttcatagcacccttatttataatagccagaagctggaaagaacccagatgtccctcaacagaggaatggatacagaaattgttgtacattttcacaatg

SEQ ID NO: 390 - DNA, 1200 bp, mus musculus
tatctctgtgtctgtctatctgtctgtctctctctctctcttgctactttatttccatttattactgaaaatattaaaatatgttctatatgcagctcttttacattttggcatgtgtaaggatgtttaagttgtttatgattttaagcaattattgataaatctgttatacatatctgtaggattttttgttgttttgttttgtttggtttggtttggtttggtttggtttgtgacaaggtgtcactctgtattcagtcttaccgagaactcaccaggccaggctgccctgtgaattcaggcttctcttgcctcaaccttgatgctggaattacaggtaaaagccaccattctaggctacttcttggttttcttaaaaggtaaggatcaggtatgagaggagacagggatgatttacagggtcaggaatttgaacagatatgtgtagaaatggggggtggggaactggggtagccaacagaaagtcacagatgccaggaaagcaggaggctcccaggaccaaactgggatgagattagctgaaatggccaacaaaagagtgggaggacctgtagagaccatatctagcagtgaagcaaggtccccaggtggagcatggagccaccatgctcctgtctaaaggaaatacagagacaaaatgtgaagcattcactgaaggaaaggccatccagagactgccccacctgggaatccatcccatacacagacaccaaacccagacactactgtggatgccaaggagtacttgctgacaagagcctgatatagctgtctcctgagaagctctgccagagcctgacatatatagaagtggatattcatagccaaccattggactgatcactgggtcctcattagaggagttagagaaaagactgaaggagttgaaggccttttcatccccataggaagacaacaatatcaactaaccagaacccccagaccttccagggactaaaccaccaaacaaagagtacacattgaggggcccgtgacccaaggtgtaaatgtagcagaggatggacttgttgggcatcagtgggaggagaggcccttggtcctgtggagacttgatgccccaacgtagggaaacaccaggggtgggggtcaggagtgagtggttgcgtataggagtaccctcgtagaagcaggttaagggggcatggtatagggggtttc

SEQ ID NO: 391 - DNA, 1200 bp, mus musculus
gtgaaaaattatactgctattgaaagtattttaagggcttatgacttagtcaataaagtgcctatagagtaagtacaaataccttgatttgaccgcaagaatactcacataaaaccccaggcatcatggttaatagtaaacaaattttcagtgaagtgaaataagcaaaatcacagaactccacaaacatccaacctagacttctcaggagtctctagttcaatatcagactcagtttcaacaaaacaagggaatgagggtctctggtgaacaggctaatggtaacattttgtgtccatgtgccttcacataaatgtacacaacattcactagagtgaacacacacaaacacacacacacacacacacacacacacacatgcacaaacactacatgcataaaaattttagtacatgataaattagcacgaagtcatttactctgatttataatatgtcaagtattttcaaagttcagagagcatcataatatcctaatgatattcttgtttttaattagatactttctttatttacatttcaaatgctatcccaaaagtcccctatagcctctcccagccctgctaccaaacccacccactcccacttcttggccctggtattcccctgtactggggggcatataaagtttgcaagacctaggggcctctcttcccaaagatgaccaacaaggccatcttctgctacttatgcagctagaggtatgagctcagggggtactggttagttcatattgttgttccacctagagggttgcagaccccttcaattccttggttactttctctagtaccttgggggccctgtgttctatcttatatatgactgtaagcatccacttctgaatttgccaggcactggcatagcctcacatgagacgactatatctgggacttttcagcaaaatcttgctggcatatgcaatagtgtctgggtttggtggctgattatgggatggatccccgggtggggtagtctctggatggtccattcgtttgtcttagctccaaactttgtctctgtaactccttccaagggtattttgttccctattctaaggaagaatgaagtatccacacattggtcttccttcttcttgattttctcatgttttgcaaattgtatcttggttattctaagtttcttaaagataattgtcagttcttaccatcacaaattt

SEQ ID NO: 392 - DNA, 1000 bp, mus musculus
atgtctttctgtgagctgtgtctcgctgtatttttatacaggttgctgagtctctctgccctgatacatctcttcctggaataccgttcaatattagttcattacagaaaatgcctaaagtagatagataataccccccccgtgcatctatgttcatatatatgtcttatatgaatgagagagaatatctgatcatttacatgtctgataaatatatctctgttcatttgtctacatttctccttgtctggaggtctttttgagttaaactcttttcatttattagtaaagttataccttatctcagttcaaaatgattggagacagctgtacttttctaattctttctctgtagcctcaatgcatacatctctgtctcatttttgctctttcctgcatttcaggataccagtaaccccatatttagtctttagtacttctttgtattctcttcattataaaactttgtctcattattcgtcacagatgagtttccacataaacttagcatcagttctgccatctgtttcccaaaatgtgactatcttttcaatgactgcagggtactttagcacccccggtgtgtttcagatatatcacaaccgagctaagcagagttataattcttaaactttagaccacacactcttgttcccaagctatctaaagacttattgctgaagtcacaaaataagtctattcctaaatcaaagctgtcagaggtggtggtaccttctgagtcatggccacacgtatagctctttaatgagcacaggagagaaaaaccaggccctcattccagggtctgcctagtgatggttggtttgcttcagttctgctttaaactgacacctgcagctaacgctaatcaagatggcaaagcatcccaggagcctcccattgactggaaggtcgaatccaaccagaaaaatccaaacattctataaatattgaaatataagtcaaattaatgttctaatgaaaggttatttaaaaaaag

SEQ ID NO: 393 - DNA, 1200 bp, mus musculus
tggacatagtagtactggaagatccagcaatatatctcctgggcatatacccagaagatgttccaactggtaataaggacacatgctccactatgttcatagcagccttatttataatagccagaagctggaaagaacccagatgtccctcaatagaggaatggatacagaaaatatggtacatttacacaatggagtactactcagctattaaaaacaatgaatttatgaaattcgtaggccaatggatatatctggatgatatcatcctgagtgaggtaactcaatcacaaaagaagtcacttgatatgcactcactgataagtggatattacccagaaacttagaatacccaagatacaatttgcaaaacacaagaaaatcaagaaggaagaccaacatgtgtgtacttcattcctccttagaatagggaacaaaatacccatggacggagtttcagagacaaagtttggagctaagacgaaaggatggaccatccagagattactccacctggggattcaacccataatcagcactgaacccagacactattgcatatgtcagcaatattttgctgaaaggaccctgatatagctgtctcaagtgaggctatgcctggcaaatacagaagtggatgctcacagtcagctaatggatggaacacaagtcccctaatggaggagctagagaaagtacccaaggagctgaagggttctgcaatcctataggtggaacaacaaatgaactaactagtacccccagagctcatgtctctagctgcatatgtagcaaaagatggcctaatgggccatcattgggaagagaggcccctaggtcttgcacactttatatgccccagtacaggggaacgccagggccaagaagtgggagtgggtgtgtaggggagcagggtgggtggagggtatagagaacttttgggatagcatgtgatatgtaaataaagaaaatatctaattaaaaaaagaaaaaagaaaaataaagaagattaataaaatcatgatatttgcagaaaatagatattcctagaattattatgtccagtgaattagtcagattctgagagacaaacacaattactttctcccatctgcaaaccttaatttcaattatgtgcatgagattatttatacatttgtggttttggatcatgaatgagcatagaaggaatcacaagag

SEQ ID NO: 394 - DNA, 1000 bp, mus musculus
tgaccagtcaggtcccagagctaatttacaccggtgttgcttttttctatgtagtgtgttctaagatgagagactgtaaccttcattccttaacattggctgcgaattctcctgttcagggccaggagtgaaagataacgaggttctctgtcctcggattgagagacgttgtttctggagctctttctgaagaggtgggaagggggaattgtttgagacagggtcttacagtatagctctgggtagcatagaactcagtcagtagactaggctagactcaaactggtggcagccctgcctgagcctcccagtgcccataatgggtttgtgttgcgggaaatattaaaaaaggaactggcacattcccacacatgtgcctgcaactcttgtaccctctgtgggcccaccggctctgtctacctgccaactctccggtgctcccaaattcctctcgctgctacgcaacaaccatccaccccacaatcatatcaccacacccatgtacctgttagaatctcttaaagcttatagctggccaatcagatttatgtatcaataaattttcagcttacaagatgccaatacagtaatttcagaaccagttgataatgataaaagctttatcccaatctttctaaccttatgatatcataactacctgtggctggttaaagccatgctggttcatgtctgcctccatcttggccttccccttctctccctgagatgctctgtcattccagctccatccacctttgccctgtccaatcacaggcctcctgctgccctaatgtaattggacagggaaaatcttgcaacaggtttgtatctctcactgtatacccgcgggtagcctgataagcagtagacaggtctagcctcaaacttatggcaattctgcctcagcaatgctagtattgtgagtgtgtggtgccatggctatcatttctggagcctttccttcatgtgcttgttagtttagatacttaaattacattgt

SEQ ID NO: 395 - DNA, 1400 bp, mus musculus
atgaaaaattacttaattccacatcctcttttagattattgtcacagttagctttttatagtccatttttcctaggccttgatcaattaatgtcatatagtacaaagaactatcatgtctgtttcttccatttttatgttttactttataaagatattatgtctgttgacttgagttaactttgcatatattatacactgcattggctctacaggtacaatttatgagttttaacaaaccctgatatttgaatacttgtgataattacactgaagccatgaaaatattattctaaaaaactttaaccatcttttccatcaaccaaccatgtaataattaaaatatttaaaactaagtctttataattgctaatgaaatgtaatcaaattaattgataaatcaaataataactatttgcaaacatacagttggatttaaattaatgatgcatagaaaccaaactaaggacatcaatacagaaaaagaggcaagaagaagtccaagaacttgcataagttgattaaaccatggaatagatttagaaagtgagctaaaaggttctttgtcaaggtatgctcatccacatatggaagacgtggccattcagcaacccaaacttgagttaaatgacagtgaactgacctaataaatgagaagagacacacttggcagagatttgtgcttttatgtggcagtgtttacctggtaaaatcaatactcggtcactggaggtcagaggtcggccatctttgtaccatgtcagagttggtggaggagcagcatttgtctcacagtgcagagaaagggggttgttgatgatcacgtctttagcttcaccgctcctgccggtatctaacatgtttcctatttcccagagtttctgaaaacttggaggaactgcggagggaaagcatggcctcagttcagtgtgacagtcatgatttacccatccaagatttcaactgagtctcaacagacaaactgtagatttggtaagtaagatgatgctttccaacagcagcaaagactagccatcagttagtcatgtggaggaataaaggctatggtgctgagtctgcatttgtctttactatttgtatagaaaggctctgctgattaaccagcattggagcccatattggaggagagatgtggtaagaaatgtgattgctacaggaaaagctactttggaggcacacataaaagaatgtctgggttcatttgataacagtatcaatgatgtgtcttatgaagaaagttcaataagatgaacaatcaggactaagctatgaaaaatagaatattctcattattttctgacagtggatgtgagctttattagcagtaaactagcaattcattaaagacatttcaaaagtatgtgacctgaactttcaagg

SEQ ID NO: 396 - DNA, 1200 bp, mus musculus
ttaaatttaggaagaaaagtctaaactttaaaacattatgtaacgcagggaagttttccaactaaaacatttgaagttgacttttgcttgttttacttgacttttttttcttttgttttgttttctgtttgttctgttttagttgactttcacagtaactatttggaatttgtgccttgtgctggccagtttcatgtctacctgacacaagctagaatcagtttgaaagagggaaccccagttaagaaaatgccctctccagactggcccgtgagcaagcctgtggtacattttcttgattgataattgatgggggagggttcaactccatgtgggcggtaccacccctaagctggtggtaaagcaggctgtgtcctttccagcttctagctattataaataaggctgctatgaacatagtggagcatgtgtccttattacatattggagcatcttctgggtatatgcccaggagtggtgtagttgggtcttcctccagtagcactatgtccaattttctgaggaaccaccaaactgatttccagagtggttttaccagcttgcaatcccaccagcagtggaggagtgttccactttctccacatcctcatcagcatctgctgtcacctgagtttttgatcttagctattctgactggtgtgaggtggaatctcagagttattttgatttgcatttccctgatgactaaggtggatgctctcagccaaccattgcactgagcacaaggtcccccatggatgagctagagaaaggaccaaaggagctgaaggagcttgcagccccataggagaaacgacaatacgaaccaaccagcaccccccagagctcccagggactaaatcaccaaccaaagagtacacatgaaagggcctatagctccagctgcatatgtagcagaggatggccttgttggacatcaatgggaggagaggcccttggccctgtgtaggcttgatgacccagtgtaggagaatgccaggacagggaagtgggagtgggtgggttggtaagcagggggaaggggggatgggatagggggttttaggggggggggaaccaggaaaggggatgaaagaaagaaagaaagaaagaaagaaagaaagaaagaaagaaagaaagcaagcaagcaagctgagcaagccatggagaccaagccagtgagcagcacccctccatggc

SEQ ID NO: 397 - DNA, 1200 bp, mus musculus
tcctaggttctctatctccagagttgtctccctttgtgatttctttattgtttctattcccatttttagatcctgaatggttttgttcaattctttcacctgtttggatgtgttttcctataattctttaagggatattgctgtttcctctttaagggcttctacccattctatctgtgttctcctgtatttctttaaggtagttatttaaatccttcttatagtccaccatcatcatcatgagaagtgactttggatctatatcttgcttttctagtgtgatgatatatctaggacttgctatggtgggagagttgggttctgatgatgccaagtaaccttggtttctgttgcttctgttcttaagcttgcctcctgccatctgattatctcaagtgctccctgccctcgacatatttgattggagcctgtccttcctatagtcccagttgagtcagaacttctcagagtccagcattctctgtgatcctgtgattccaggatcctgtgatcctgagattctgggtgtgtcagagttcttggcagtcaaacttcctctgataccctgagatcctggtgtgaccaacctcttgggatcctgggatcctaagttcctgggcatgttagagcgcctgaaagtggtacctcctctaggggccatgggattctctgctgaattcaaaaccaaggtagaccagcgccgactggaaggaactggagccactggttgggtggggttcctgtgtccctgctcctgctggtcccaggcacttctggtggtgttgcaacagatgttgtgttccattcacctgtgatcttaagatcctgagcatgcaagggtgcctggggaatggagagttctctgggaccttgagttcacacccaaggtccactaataatttacttaatctttctaatcatcttagggcagacattattatctttattataaacaaagcacccaatgcttacaaagtttggcatctttctgatcattacagtgaaggttagtgacactgtcctgatctgaaacacatctgtctgactcaattccaccattgaatatatgtaatcagaggatccaggtacaaaaagctaaagagagcataaacagcatgtataaatagtctaattataagaaaataactaaatgtagaaagtagagtaacagtatgtgctaaaagttcaaaacatccacca

SEQ ID NO: 398 - DNA, 1200 bp, mus musculus
aagctgccttgaaggacaaggtgggaaagtgatctaacaaaattcctatcatcaaccttgggcctccacacaaagccacataccagtgtctcacacacacacacacacacacacacacacacacacacacacacacacacacacacgaaaagcagtgtctatgccatcccctccctgccagtaagtacctgaagctccatctccacacacttcccgcttgtcctgtaaagcgctgagctcttgtttttgccccatggggttccaggcctcgcctcccttcaaccctcagtttagactcggttcaggggaagaactcttccttatgctagacgcaaaaccctttgcctgtgttctgaatctcactcagggctgctctcgctcatctctttaaatggggcctttcaggagcccccccccccccatgaagcccccccggcctcttctagcagggttgtttctccgcagcagcagccctcaatgctccggaatcttgaggtgctctcctccgccaatggcgactgctaggttgtctgatcatctgtcactagcttgagacatgctcaagtgacaccatggtgttgcgtttcagacccagaagcagcagatgaggtgcatatttaaacatgccaaagtggacctggcctccgggttctcccagcatccctcagtccctacctgttaaaaggcatggttggcatacctggccctctagctgaatttctgagcccaggggctgggcctcctctcacctaagggctcttcactatataatccagacattgtggctctccccttctctcttgcctcccttcccccatcacccccctatgaccccccatcctcaccctttatctggtagatgatttccccgacccctcccttgaggtgaggtcggtgaacttgaaagcttcccccaataaacctgcttttatactttaattcagcctgaattggctcatttcctcagcagagaaaacctgtcacatggtacctcagcctgcagcaggtgaatggatgtctatggatagtcgctgggtttgtttgtttgttttaaatgtggacatgggaagaagcaaccatttaaaaaaattcaaaaataaaagaagaatttcctgcacttctcctaaaggcacagtggatttttttccccaatagttaagagtatttgaaggcaactgtgttttttatttcagttttgac

SEQ ID NO: 399 - DNA, 1000 bp, mus musculus
tttttatatattcttaaggttttcttttttaagcatttccattgtgttaaatacgtgtcgtagacgtttaacaatgacatttccttcccctacccaccagtgtacttatttccttggcaagcactgacttgagacttccacggtttacagtaggaatgaaatcaatccacaccaaactcaggggtcaaaatgaacactcagggctggggatgttagctcggtggggcgagtactttccaaacacgcatggtggtacacaggccatgctgtaacctcagcactcagaggggtgggcaggaggaacacatgctgtaaccccagcaatcagaggggtgggcaggaggaacacatactgtaatcccagcactcagaggggtgggcaggaggaacacatgctgtaaccccagaaatcagaggatgtaggtaggaagaccagaagttcaaggttatccttggctatgtagtaagttaggggccagcctgagctttaggagcccctatgttgaaagggacagagacataggtcatgggagagcacacacacttaagagctcctgtcaatattaggcaacattgtaactctatcttggcgaggaagctcccatggtaagtacctaacaacaggctcagttcagaagacttacaaaggaattttgtggcttctgccgcctttaatcccagcactcaggaggcagaggcagacagatttcagagttcgaggccagcctggtctacaaagtgagttccaggacagccagagctacacagagaaaccctgtctcgaaaaacaaaaacaaaaacaaacaaacaacaacaacaacaacaacaaccaagaggttctctgaatgacagggaaactgagcaacctttccatccctggggatagtgacaacacaggcattggcctggccaggatgatggagatgatggagtttctagagtacagatgccgagcacagctgggacccgctacttcagctgggttgcaccccacaggaga

SEQ ID NO: 400 - DNA, 1200 bp, mus musculus
ctctaccttgtcatctgctttcagtataattcttgatgccacactgactcccagccttctctggggtctgtgtccccgacctccacgtttctacacgcttctaaaccttcaggatcccctttgtatcccaggactctatatgtgcaatgaggttggatttctccattcagtatgtgcatctgataggccttgcatggtgatttatttacacttcagaatgatattttctgctttatctctttgataatgtctgctactcttttttttttcttatcctaccccctagaattcccattagaaaggagacttctttttacaaaaaattcatttatcagctttattgtgtgtgctcaggatgtgtttgtgagtgtgagcagtgcttttggcgtgtgtgcgggagtcacgcaacagtttcttcgagtcagttctgtccttccacactgggtttcaactcaggctgtcaggcttgagtgacaagtccctttaaccccagagccattgctggcccttgaaataagacttcttaagttttgtctacttttcttctccctcgctgtcaagttctacagagaagcatggcagcgggacttcaggtgagccgtcctttagtagcgcaggccgcccgcatcgggagaagctggggtaggagagtcaatagcccacagaggagatttcttacttcctatactttgaacagagaggggtctctggctagcggataagacgctgctatgaggtgactatgctgtgggactgtctctcctaggagcaaagtgagatcacaagccagcctggctgggcgtgtgggcggtggcagtgagggcatccagtcaccctttccaaccaggtggcatctgtgttctaaaggtcacagtgaggagcctgtctgcggtggagagaggtgacagagaggctaagcccccctctacagtcacagcatctgcgatctgtctgtatcttcttgcaacttctgtgggatttccccagtattgcccagtactgactacttccggtgggggttggggtgggtgcgtggtaactttttgtttttaagactttgtaatttggtgcacggagcccttgccacgcccagctgagtttgatggcatcaattggcttctggtgaaggatgctgggggagcggggtttggggggacgaggaggtggcagggatgtagcagcgctgtcagctgtcacgta

SEQ ID NO: 401 - DNA, 1200 bp, mus musculus
ccatttagttgcttccctttctgtttaccagactttacttaaaataccaaactattttaagtctggtgtagttccatttatttatttttgcttttatggctccaagttttgacatgatatccaaagatatcattgccaagcccagtctcaagaaaatttctcccaatactcttaattcttatagtcagctctgtgatccattttgtgttggttttgtgtgtggtaaagagtctaattttgttggttttttttccatatagaaatatagtttttccaacaccatgaataaaagaaactgtcctttctaccttggctcttcttagtgcctttgctggcatgcttggggttaccttctgctccatgggcctctggacctactatcaagccagtaccaagccattttatcaccacattcacaaaatactatcctaaatcaggaagtgtggtgcttccaattatgtgtcccccttaacttggctgtttctttggaaagctgttctcatcttcctcttcctgtggcaactgtcattggtataaagaccgactgattattgcctggagtgagatgagttttataacagtgtgatctgtccacactgtggtccattcatgtgtgccttcttcagctcctgaagtgacacgtgacaacgcacatgtgtgatcatgtacagggttgatttcttgtttctgtttttgcccctccccccaaagaaaggtttatgtatagaaatgtatagaactgttctttatcttgcagctttattaagtccacttactggtgtttgatagagtttggatcgagtcctttgaacgtccatgtagaggacagtgcttctgtggtccctgcttggatgtctgtggtactttcactgttctgcccatggtggtgaagacgtttgaatgaatgggatgaggatgcttgccttgtcactgaccacggggaaacagttttcctttttaagcgtctactatactattggctacaggcttttcatagctgctttttattttggtatttcgattcaagtgagtcgagggtagtaaataataagaaaaaaactttaaaagtgttaatttttccttccactgaaaagcacagatctcagttgactaactcgaaagattcaaataagtttaggatccagtgtaaacaacatctgcgttatgatagagggaacttccatgatcagaaagtccccc

SEQ ID NO: 402 - DNA, 1000 bp, mus musculus
ttttattcatttcctttgcctgtttgattgtgttttcctgtaattctttaagtgatttttgtgtttcctttttaagggtttctacccgtttacctgtattctcctgtatttctttaagggagttatttatgtccttcttaaagtcctctattatcatcatcatcatcatgaaaagtgactttagatgcaagctttgcttttctggtgtgatggtgtatccaggacttgctgtggtgggagtctgatgatgccaggcaaccttggtttctattgcttatgttcttatgcttgcttcctgccatctgattatctctagtgctccctactctctatatatctgactggagcctgtccttcctataatcctagcctgtccttcctataatcctggttgagtcagaattcctcagagtccagctgtctctgtgatccagtgattccgaaatcctaagattctaggtgtgtgagagttcctggtattcaagctgcctctgagaccctgagatcctggtgtgaccaagtttctgggatctttgaatcctgtaatcctgggtatgctagagggcctgagagtagggcctcctctgggggctgtggggctggtttcagaatttgcacccaagatacactggcacagaccagcttcccactgttaaaatccaaagttcttactacagtttataaaacatttgatggatcatgtctttatctttctcccaccttgactttaggggttctttcataaatacaaaatcaaaattttcttttggagggaggtattggctcataatacttaggatgtcaataaaacatcacatatctgggaaagcttaaacttgaaaaattctccaagggctttccttggtgttacagacagaggggggaggagcggggatagggaacaatgctaggtaggctcaagactagctgagctgtgagaacagattctcagagagctttcatgagtaccaattctatgttagactgggtttttccatat

SEQ ID NO: 403 - DNA, 1000 bp, mus musculus
acacgtttattgggagagcttgattgtagaggcgaagagaccccgagcccagaactggtgctgcttttataggcctaggagaggcatgtcttacacccggattggttatgcactacgcctcatttgcatgttcctcatctgattggcaactctctctcagtacctcacagagcctcattatcatacctcatttgcatgtctcacatctgattggttatactctcagtaccttacagaacctcattatcatgcccgggccaggcagtgtcttgcaaaaaactttactgcatatgtacacattggttgtttgtccaaacttatgtgtggtggccagcagtagtcagtgccactctgcaatggcacatgtggcttcccacagcccaggctactatacccggccaaactctcaattaccatagatggagaaaccaaagtattccacgacaaaaccaaattcacacattatctttccacaaatccagcccttcaaaggataataacagaaaaaaaccaatacaaggacagaaatcacaccctagaacaagcaaaaaaagtaatccctcaacaaaccaaaaagaagacagccacaagaacagaatgccaactctaacaacaaaaataaaaggaagcaacaattacttttccttaatatctcttaatatcaatggactcaattccccaataaaaagacatagactgacagactggctacacaaacaggactcaacactctgctgcttacaggaaacccatctcagggaaaaagacagacactacctcagagtaaaaggctggaaaacaattttccaagcaaacggtctgaggaaacaagctggagtagccattctaatatcaaataaaattgacttccaacccaaagttatcaaaaaagacaaggagggacacttcatactcatcagaggtaaaatcctccaagaggaactctcaattctgaatatctatgctccaaatgcaagggcagccacattcattaaagaca

SEQ ID NO: 404 - DNA, 1000 bp, mus musculus
gagatgctgtgttccagagatagccaaggttgttccttgtgctgcagctgtaagaaccacccatgtggtaaaggtttagaaggcagaaaagcgtcatgaagagcagctgaggcttggtactttgagaggccaggggaggccactggtaaaggtgcagcctcagttgtagctgatggcccaggactgaaggggtcatgcaaaagatttaaggcttggcaccatgaagagagcctatgagaggctattagtgaagcctagttgcagcagaagaccccagtgtactggagatgccagtaccaagggatgatcagcaagaacagcagaatcagtggagtggatcaacctgagcttagagtgctacagaaggcaaagctggaaaaatgacaccagccctttggaggagcccagaagatcgtgtgtggatcccagacactgaaacaatagactataacattgaagttgccttggagaccccaagatgtttgagatgccagacctgtgggctatccactggggaaagctgctaacaagggagtggaaacagcccaggaaaaagaagtttgttacagtcaacaaagatgaaaaaaggagttggagatctgaagactgctttgacatcagacatggagatgcaaagtttagagtttgcccagctggttttctgtcttgctttgggaattacagttaagtgactggatgaatcttcagaagagactttgaactttggacttttaacattgttgagactgttttagactatgggggctttagaagttgtattctgcattatgctagctttaggtatgacccccatagactcatatgtttgaacaagtcaatgagggccagagagtggaaggtgatggtttgtgtatgcttgccgaaaggagaggcaatattagaaggtgtggccttgttggagtaggtgtgtcactgtgggtgggcttaagaccctcaccctagctgcctggaagccagtcttccactagcagccttcaga

SEQ ID NO: 405 - DNA, 1000 bp, mus musculus
catcaatgtgattgatgtaagagggcaaatgacatgttatctctcatgaagaacaaggttagagacaaacagttgaacacaaggtctagaggctaaaagtattctttagtcctgtaggtctacaggagatgctcagtgggagaatcttgcctaacatgtgagacttttggttcaatttctagcaccacctacacaataacagcacatgtgcacaggcacacaacatatataacactcacacacaaacatacagacacacatgctcacaatcacacaacacacatgcatacacacacatacatacacgcatacacataatgcttacgacaaccatcgatagctccacttttcgaagaccagatacacttgtgtggcctctatgagcaccagacacatatgtagtatgcaaatatattcaggcaaaacacccatatacacaaatagtaacttaaaaaaataacactaaagtattaagtatttgattactactggaatcaaattccaaatcaaagttccaaaataagccactacctgatcaaaggtttgtatatgtagagtcatgaaatatatattggacaagctttccttaagaaaagtatatatttcagcttaaaatcctggggcaaaggaagaagctacccgttgttgacaaactgcaagcaacgaagactgtaactatgtagatatgaaaagctgcttcccgtgtgccattaaagtgtgcggagtgccactgtatgtgcgtttgctgctttaggtgtgtggtctttgtgctaaacattacagactccactgtaattgatatgcaatcaaataataccaatacaatatgatacgcataaaaaagaagaagcagcatggtaaacaagagagaaggatggataatctttacagccacaggtgttgggaggtgaggaaaaggtagtatacattactggtgaaaagggacaagatgaacatttggctagaaacttgtttctagtggcacattaggaaattagat

SEQ ID NO: 406 - DNA, 1000 bp, mus musculus
tgtaacacaatttcacttataatgagtaaaactcataattgaatttcttcaactattaacacaagacaaaagagaaaaataaaatgtattcataagataaaaaaatgctaggtgcgcatatgtgcgtgtgtgtgtgtgtgtgtgtgtgtgtgtgcgcgcgcgcgcgcataggatatatgtgcatgcacttttatctttctctacaactctgtaccttagtatctgagataggatctcactaaccctggaacctgccattctggctagatggcaagctactgaacccaggagatctgtctgtctcccccacctggattaaaggtgcacggtgctatgctcccttatgttggtgctgggaagtaaaacgtaggtaatcttgatgcagatcaaacatttttacccactgagccatctttctagctccaaagaaggctattttcaggagagcaaaatttatacctaatatgaaggcaaaattgttttcacattttaggtaattcttaagataaaagtcagtgattctaattgctagtaatccacaagccatggtttcaggtcttagggaatctttatttaactctgctcatgactgtttcttcattctcagttgtaggattttcttcctacgagtcctaggtgtcttcctggtactgtcaccatctccatctagggatgtttttgcttgttcttttttgtttcacgtcaacatttttctgttgcagaccagacatcttctttcctggagcagcccctcttctcttgccccctgcctattgttcctgattggccttttcaagttctcactgtttctgcaaagtggtgtccatgtatttcaatgctttgctttctggatccctgaattttcatttcacccactctaatagatgaagtatttcatttgtcctttatggcaatctacacattctgcttcatagagcagagacccatgaaagcaaagcactccctcacccttctggaatttaggtccaggtccttcttg

SEQ ID NO: 407 - DNA, 1000 bp, mus musculus
ttcctctcaattggcaccattactatagtacaggttgtaatttttgaaaaaaaaaaccttaatgcccattttttcatattgctattttaatgtggggatgtgtacaactggagctagtttgttggttaagttttgagtattaatttctggccaatctccatgaagtggactttgggatttatgtttgtggttattttggcttatctggttttatattggttaagagatgtttgaagtccagttgtggggacactcagtactgattcatgggtagggtagatgcaaagattctagcttatctaagtatgtatgcaagttggcatggggagtggtagggttgtgacattggcagagtgtggtctttgacatgagtagtggatgtatatttcacaaggtcctgtagcagcagagactgaggtcctggggatctgttgggtgttttctgtgacatggaaagtaggaagatattgttagattcaatggtggtggaggttggaatcctgaacatggcatctgagttgtagcttctgatctggggagcagacagggctttgttggagttctgtggacatagaagtggtcagtgggcatgttggctttgacctagggagtaagcaggtattctgaaccgtcttacctttggttggaggttttgctgggtttagagattcagtggaggtatggcttttaaccagggtatctaaccagagagtgggaaggtgctctgtagtttctgtacatgctggtaggtgttgggattccaggaattggctgggtgtggtctttgacctgggaatgtgagggcctctctgcagtgtctttgagtgtgatgaagactgggggttccagtgcttagccttgatgttttgagaaagtgtctcacactgtagacaaggttggccactactcctggtgatttttctgctttagctttttaagtgctgggtttattggtgggtaatattatgcctggctgtattttattttgtttaattaattt

SEQ ID NO: 408 - DNA, 1000 bp, mus musculus
ttttctctagacttaggattcttggctgaagtacctttctcaacactaatttccaagttcgttttctttctttctttttcacattttttattagatattttctttatatacatttcaaatgctatcccaaaagtttcctataccctctccctgccctgcttccctacccacccactcccgcttcttggccatggcattcccctgcattggggcatataaagtttgcaataccaaggggtcttttcccagtgatggctgattaggccatcttctgctacatatgcagctagagacaggagctctgggggtactggttagttcatattgttccacctatagggttgcagaccccttcagctccttgggtgctttctctagtttcttcatttggggccctgtgttctatcttatagatgactgtgagcatccacttctgtatttgccatgcactggcatagcctcatacgagactgctgctataacagggtcccatcagcaaaatctttctggcatttgcaatagtgtctgagtttggtggatacttcattcctccaagttcattttctacccacttaaagaagttgttttgaccccaccaaccacatggtagctcaaaaccatctgtgataggatctgatgccctcttctcatgtgtctgaagacagcaacaatgtactcaccataaaattcttttttatttttaaagtatttgttttgaaaacctaagttcaaaatattgggcagaatattttcaaacatactatttaatctcagatttttttcaatcatcatactaacgaaaacaagacaatttcataaagccacccatcatgttttttcctcatatgtgtaacctagcaggggaatggggtcgtgaaagtataagatgtgtataagggagaatgaaagggtagtaacagggagtaaatagtgtttaagtacatcctatgtgtgtatagaaataaattctcttacgttggatgcttgcttcacatactct

SEQ ID NO: 409 - DNA, 1200 bp, mus musculus
aaaaggaaagatccacccagagctgaggtcacagactgaattaaaagggggaaaggagaaagcaagctaagcataaacatctctttctgcttcctgactgcagactcactgtcgacatgttgttttcttttcctctctctctctgctatgatggaacgatcctacataaactcttccttaagttgtttccatcttttgtcatagcaataagagaagtaactaatacaccaggcaagaagtatgcttgttgataatccagtagtatatcttgcaataacagagaaaactttcaggtccttggagtagagaagagatttgaacacacagaaatgtacaactaagattatatctagcttaaagcttctataaaacaaaaaacacacctgccatcttccttctgagcccagcggaggcctctaagggctccagagtgctctcgatgccacaggaccttggaatcacctcgggatcactagtgagtagaacccaacttcagcttcaagaatcggggagggtcttgtgcccgcaggaacagggacaaaggaaccatgcccgaccagaggctgggatccattcaggtctaggccagccaccccatcttctgcgtgaacctggccgagggcatctagggcaccagagaactctccatgccgcaggacccctaacacacccaggacctcctgatcacctgagagcatgtgggcaatagaagcaacagaccttcttggtcagggtcccatcgtgccttcatcctcagccaggaggcagagctgagacccaaacccctgggcacattccttgccagaggagagtcagcctacaagggagggtcctgaccccagaactcagaaggtggataagagctccagattgctggacacctgctctgcaagaagagagcttgcctgcagagagtgctctgaccactggaactcaggtgagagttggactcccaggagtgctgacagaggctaacagaatcacaggacgatcaagctccagccagagacaacttgaacattaacactagagatttccagatggtgaaagtcaaatgtaagaatcttactaacagaaaccaagaacacttggcatcatcagaacccagtacgcccaccacaacgagtcctggataccccaacacattcaaaaagcaagacacagatttaaaatcatatgtcatgatggtggtagaagatt

SEQ ID NO: 410 - DNA, 1200 bp, mus musculus
aaagacccaggcagcaacagcaatctgagcaataaagaacagtgcttgaaggatcaccattgcagattcacagagctagtaatgctgcagtaatgcaaacagtgtggttctcacccagacagatgtgcacagagccaacatgagtatatattacagcaaagaggaaggcagcgtcttcaacaactgctgctaccaagactggttgcatgtgtgtaggatgaaattagacccatctctatcaccatgcaaaaaattaaccccaaatggatcagtgtgctcaatatgatacattgaaattgcttgaataaaacatagataatatcctataagaaacagttgtgggaaaggactttctaaataggactctgttatccaagaatttgtgtcataaaactaaaaatctgctgaacagctaaggaagagtaagctcaccaagtgagaaagttataacacttgacagaaaattaacatccagaatatgtaaaaactcaaaacaacagagtcaagaagccaagtgacccaattcagaggtaggctatgggtttagtggagcgttttcaacagaagaaataaaaatgactacataaggcagccctggggtggctggaaagagatacccaagcctctactctggccctgatgtggccacctctacaataaaggaatatgtgatagcgagatgggaaagaggaagtgagtagtggcaagctaggagggaagacaaaacctagcaattcaagccactgcgcagagaggtagaacaatgagtaatgagccactggggattgtgctgatgtcggttcccaggctgttgccaaggaccatgtctaggtccatggctctgtcatgagcctgtgctggtggctgtggcctgtgttgcttcctaagtctcaggaataatgtaaaagaagaggtagatttaatgagtgctacttacagatactgaaatgtacataatggaaaaatacattttctatttgaataaaaatgcacttagtaaatacttaacatagatctggccaagctcccccacctccccaaaattgcttacaatatgtgtaacaagaagaatttcctgctcatttaaacctatactctatttgggggaaataatggaattttcctttaacaatctcaaggtaacccctgtactcctgccactgctgctatattgatgtcaacgtgagaagctatgcgtaa

SEQ ID NO: 411 - DNA, 1000 bp, mus musculus
tataaagtgtatattttaatattacaaaataaccatctttgacagtaatcttctctctacatgtaaacctcactttttaaagatcagcaagtaacttccctccctgcagtctacaactctctccaaatcttcgactgtttactcacatggatcacctagcaatttgtgcataaaatgctagatattatcaacctctcattataacccaagtacagcactttaacaacacctaacatagcgaatcagtaacagaaaataaagttttgcaaaaagcaaacgataaagccttttttagcttttcatactcttgtcaaaacatgtcaaacttctgtaaaccaaggatatatttcaatttcctcctttgagagaaagatgaaaataataacaggaggtttaatgcagacaacttagtaaacttgggaagccatgcactaaatgatttttatcatgtactttttagaaccaaatcagtaaattgtaactattcccaaagagttccatgagtcttttcctaaagaacaatagattactactagaaatcactgaccctgataacatctaacaccaaacaaactagtactttaatggagcaccacagtctatgctaacagacctgggtaagtgaatgcatagcgagaagcccaggagcctcagggaacctggtaggggagcacagagggattgcaaccccattggaagaactacataggctgacctgaccacccagttcttccagagactaaaccaccaaccagggagtgtacctggagggatccaggtacacatgcagcagaggatggccttccaaccctgacagcaaccggaaaggaggcccttggtcccagggaggtttgagggcccagtgtaggggggatgctggaatagtagggtgggagaaggtgggtaggtgggggagcaccctcatataggcaagggggagggagaagggaggatgtgggatgaggggttggtagaggggtaatcgggaaatggggttcat

SEQ ID NO: 412 - DNA, 1000 bp, mus musculus
aatgttgccctcttcctggtcctccttcccagagctcttcatcccatccccctatcccttagcctctgagaaggtgctcccccacccatctactcacccagccccatctcactcccctcccagcatcccccttccctgggacatcaagtctctacaagattagattcatcctctcccactgaggccagacaaggcagtcctctgctccatatgtgctgggagccatggatcctctcagaggacaggcatgctaggctcctgcctgcaagcacagcatggcattagtaatagtgtcagggtttggtgcctgtccatgggatggatcccaagttgagccagtcactagatggcctttccttcagtctctgcttcatttttgtccccacatttcttttagacaggaacaattctgggtcaaaaattttaaaggaaggttggtgaccctatccctctactggggggctctgtctatccagtagcaggtggtttccttaagttccatctccccactgttgggcattttgactaaggtcatgaccattgagtcttgggagcctctcacatcccaggtctctagaactttctagagttccccctaccccttctttccacccaccacagcagcataagagaagcccagagggtcaggagaaaagaatcatttctaaataataaaaggaaagacactaaagagatgactcagcagcaaaacgctcactcttctctcagaacttactttcaaatcctagcgcctgcttcaggtggttcactccagctcctgggaatctgatgccctcttctggcctatgtgaatacctgcttcatgtgctcacatacatacatagatatacacgtatacacataacttcttaaataatgttttgagactataatatagtcataataatatgatataacttcctctatcctgccctgtatccaaatccttctatgtgctccctccttattttctttctaattcatggccgccttttgttta

SEQ ID NO: 413 - DNA, 1200 bp, mus musculus
cattcccagttcccagtcctacctgtctttacacaaattcctcatcactagtccatacttgggggggtggggggaggagggagggagggagggaggacccaatcacaactggtccagggaaggaacaggttttaggatgggtacccaagctacagatctgatgagagtaaccccataatacgcctttaagctcacggagaactgaactcctaacccttaatatcagtggcctggaaccatcctcccaagacagaagagcctgcctcaggagtctgctgtccttggttggcatggttgagccaggactttgctttaccctgcccttggcaaatggccacgtgcagggctagcgattgagagtagcttataagcattggccagctgccatgaggcctgagcccaaaacatgctgaagaagttattatggatgcaggcacagtgatgagctgtggcagtcccaggtctgtaggctgaagcaggagagtggcttaagcccacaaatatgaggccaacctgggcaacaggtgagaccttatctaaggagtggtgcttatatgtgttccaagagaggtaaagaaccaggctgtctgcctcccccaaggcctgccccagaatccacagtgcagtcttcgttgtccatcaaacagcaagaggagggtgcccaccaagtagtggctgaaaccggtctcacaccacaaacttgtttgctaagttgttgctcttggcagcagtgtctgcatgggcctggtacccaaggatggtcttcgtagggatgcccaggcgctctttgtatatttgcccgatctgcatcactccggctttgtcctctgcttcattcgtccacagggcaatcttgtccctcttcgtgcagatgttcacgacagcaccgctgtattcctcaaaacagttcccgaccagacacaccaacgtctccagccacagacggtccagttcgaagtggcgcagttgtttgtcaatgctgagcagccagcggctaccccacttgtttctgttgtcttcccacatgggcaggatgccttccttgaatagggcatagtcacagcaggaagagagcttgctggctagcttgatatggctgtacatcacccagaagtcctccacagtgttaaacttggagactagctgcaggttgtcctgccaggcccggcttcggtcattcttgaagaaccacagaaccca

SEQ ID NO: 414 - DNA, 1000 bp, mus musculus
gtaggctacgagataacctcaggggtcattttactcaggataccatccaccttttcatttgagacagggtctctcactggcctagacttcaccaagggtagctgtctaggaagccccagtgatccacctgtcttcacgtctttacttcaggaatttcaagcccacgccaccaagcctagatttttttttcttttgactagcgtctcgggattcagcttgctcatcatgttgtgaggtccctggctgtgctgtctcccagccctcctggtgatttcatagatgcctaaactgggtgtgtaaatcataaactccacaccaagccttaaaaggttccctatcagacaaggattttctccaagttcctttgtgtgccagcgctattggtgtagttctagacggtcataacggttcagcacatgggatcaatggagccaggaggccagtgcttgccaccatctcaagctctaagcccctgtgtagacttaagcttcttgggaacacaccccttccctgtccctcggcactgtgcaccttgcaaagcaagtgctctagaaggcatttctcacctaggaaggttttctccccatttctcaaaatagctctggggagttagcaatagcttctacttcattcattcaacaaagtctcactctgtacccctggttagcctggaaatcacaaaataaaccaggctggccttaaactcacagggatatgccgaccttttctttctgggtctttgttttctttttttattattattaaagatttatttatatttaaattgtgtgaggggtgtgtgtgtgtgtgtgtgtgtgtgtgtgtgtgtgtgtgagtgagtgcaggtgcccatgaaagtcagaggtatctctcctgaacctggaattgtaacagtcagttgtgagctacccaatctgggaattgaacttgggtcctctagaagggcaggatccttaagcctgaactgtcttaccagctcatctccctctgcatttcttcc

SEQ ID NO: 415 - DNA, 1200 bp, mus musculus
cacccctgtgtcactctgccatgcagcacagatggagaatctcacccataggcctgccatttgtcgagtctatagcaggagccaacacaatgtactggtgtgtcgtggtcagatgtgaaggaaagagaagtggagcaacttaagcattatgaagagagatggaactggagactcgacaatagaggagtagcctgttgtgagtaaccagccctgccaccttgggcaatggtgaaatcccaacctgagctggcactgaaggccacgtctggatctgtagctatgcaatggcaggggtcagtattgatgtccatggctcatcttaccactagagatcatgggtactctttagtgggggaatccatagatggccccacctctcactggacctggtgctccggagagctggcctcatctctcaccactggcagcactacagagagagagagccctgcaatttgaccaggcagtatagtggagcttgaccttgtggtgtgggtatgggtacacaggccccaagggtgtgactgtgggagagagaacactgacattatctgccattgggtagcattagcacagaggtgatgctccctaccctgccacctccagtcatgagctggaaagagctaccctgcccctcaccagctataacactcagaagagtgagccttggagttcacctgaacagcacagcaagctgaccttgatggtcagagcacaggtcagccagccctgagggtgagatagagggagagctggtcctgccatccatccatctatcttgaggtggagtgagtatggagattatgccctcctcctctcccctcctgaccacaggcagtagtcaggagagctggccctggagtcatatgagcaggagagctagccctgctccctccctggctggagcactctggagagagagctctgcacctgacctgagcaatacagtggagctgaccctgatggtgaaggcacaagtaagccagtgagatcagaagagctcgcctagcccctcagagcctgcaacagttgagagagtgccctctgcctcgacccccttgtcttgactgtgaagcacaatggagctagctggctctggggttgtgggtagggtgagatagctccaaagaaatgagagagagcaagagagttgaccttgcctcctgcagatggtagtaatggttggtctagccagaacta

SEQ ID NO: 416 - DNA, 1200 bp, mus musculus
ggttttgcaactgaatataagcatgtattcatttcctattatattcgatttgtattttagagactttataaatcattctgaaattccctgaggcacgcatgaattctcagcagtctgctgtcagctgtttgcctctgagctgctgaaggagatgtttctgtaatcctcaaacagtaatgtctgcacttctagctcaccttcccccaagcacacaagattagctgctactacagcggtacagtgccaagtgcataagcccagggtttgctgaactccatctctctgaacatcctaaaacaggctttccggctgaccactcagctgggttacatggctttaacaacacaggatcatgtgagctcagactttaccaggtcttggccctctactccagcatcagtcagaaaactcaccccaacaaatttcctaagaaattcacgagaggcttggatatctgggttggataattcaataaaatttcccatcatgccttcttctgtggctggtacttcttggtagaaaagtttggctctggcatagaactgcatctcaccatcaatgacttggcttgttaaagcatacaattttactacaaagaaaatattatcaaaggttattaatatgtatatggcatagcaggcttgtttttttaacaatgtaatgaatttcttaaaacttcatgaacttatgttgtagaagaaaaggcatagatttgatttgatttgatttgatttttagacaaggcctccctgtgcaggtctggctgccctgaaacttgctatatagaccaggcttggctcaaactcacatagatctgcctgcctctgcctcccaagtgttggaattaaagacctgcactgccatgcccagcatagacaatggtattaaatcagaaatatctgcatttgagttctagcctagagattggcatgcaacataacatggagaaaactatttaaaccctatgatcttcagaaatcatatctataaatcactttgactttaaattttcacaattgaatggctagttcaataagcatgacttaccatcttatcaaaatagtcttacagtattttgcacaatggaaaaataacctcaccacatggtgctaagtgtgatctcttagttctgagtgctttatggaaattttctcatttattcttcctgcttagccctgtgtttcacttcttcaaaagcag

SEQ ID NO: 417 - DNA, 1000 bp, mus musculus
cctgagctacacatatcaagcctcagacaggtgacttaacatacaaatcagacaacaggagaaagaaaaaaatacacacttgtttcctttcctttgcttgccatgttttttgtttgtttgtttgtttttcaagacagggtttctctggctgtcctggaactcactctgtagaccaggctggcttcgaactcagaaatccacctgcctctgcctcccaagtgctcggattaaagacgtgcgcaaccactgcccagccaccatgttgtttttttaaagctgggatagttgtaccacaggtgtaccttattcaaagaatgttttcctaaggaatcaacttaatgtactgtcagcatttactccactcttatgggaaaagaactgtgaaagaatgaaccctacctaggtcttcaaagacagcaataaagaatcaataagaaatggattcagaatgcgcttcagactaatcacctcacatagagccatttcagcctatgtattaacggtgttcacttgatgtgctgtttccacaggcctatatttctgcttttgaaaaagatttattagcctataaagaatctggtttccttatatgttttccaacaaactgtgctatttctcttctctcccatctcctcttctgccccctccacctccagtagcctccttcccacttgcctcctgtcacttctgtcttttgtcctatcccctttgctcagcacttcttcccaccttgtagcctctgtaatggtttgaatatgcttggtccagggagtggcactattaggaagtatggccttgttagagtaagtgtgtcattgtgggcatgggcatggggttcctcctgtaccatgcctgcctggatgctgccatgctcctgccttgataatagcggactgaacctctgaacctataagactgtcccaattatatgttgtacttctaagagttgccttggtcatggtgtctgctcacagcagtaaagccctacctgagactgccg

SEQ ID NO: 418 - DNA, 1000 bp, mus musculus
cacacatacacacacactgaactgcctattgaagattaaagatagcttctgaaatttctaaagactgcaacaggtccctcttgataacttggagcgtgtccttgtgacagattgtgaaacctggtggcacaaggttctgatgaggctggcgctgtagttaggggatgtgggtttcttctcttgaaatagcagtgatgatggagcatctctgagaacaggacatacacatgggctgtcatgggttcagccactgctgaaggactggatggaggaagagtttaaactgacacgtccctcaactcacaaacattctcccatagcgtatccataccatacaccacacacatcacatatgtacatttcctgttctgtatataggacaagtttcagcccaggaccaccaagaccaaattttcagcacaaaggagatttatctgccccagagggacaaagggcagggataaggggccagaacaggagatagaggaagagggagaaggggaaggaggagggagggagggagaggagaaagtggtatttgtcctgcaagggaacaatgactgtctctggatagaaaggagacagatgtggccaataggcaaatggctgtttataaaggtaaatggggaacctgtgttaggatgcagtgcttaattttaactggcagtgaacccaaaagggcttttgattgctggactttagtactttgagagctggcccttggaaataagccttaggaggaggtagcagccaaagaaaaggatagaccctgtggctagctttgggaagaactggggagaagggcaaggcctgccagagtcatgttcgccatgcttgagctgacaagagtccctgtgtgtgtgtgtgtgtgtgtgtgtgtgtgtgtgcgcgcgcgcgtgcgtgtttcccaagtacttactgcaatcaggcattctactggacacttatatttattattgatatctcatcttagactcacaagttccttgtcatacaggta

SEQ ID NO: 419 - DNA, 1000 bp, mus musculus
ggatcccgtgggggttcctgtgtgggtccttgcaggtgtccagagactccgcaggcaaggcaccttggtgctgcagtggactggaaggctctcttgtatttctttaagtgagttattaaagtccttcttgatgtcctctaacatcaccattagatatgcttttaaatccaggtctagcttttctggtatattgggttgcccaggactgggtgaggtgggagtgctgtatcctgatgatggtgagtggtcttggtttctgttagtaagattcttacctttgcatttcgccatctggtaatctctatagttagttgttaaagttgtttctggttagagcttgttccttttgtgattctgttaacctctattagcagacctgggtgactagctctctcctctaaatttcagtggtcagagcactctctgcaggcaagctctcctcttacagggaagtgcacagatatctggtgtttggacctgcctcctggcagaagatgagggcctaaaacaggatctgtcccagaagctgtgtcccttcggcctgtcatagaagctgttagcttctgtagtccacattctcacctgcgcagagtagtctcagagggatctgggaaccaagatgactcccccaggtgctctgtcaaagctgtcccaggcagggcagacacttctcctctggcagggaagttgcccggatgtctggagcccaaaatgggatgtgcctcagaagctgtcctttagggaccttgggagtgtccactgactctgtgccaaggtgaccttgtgctagcgctgactggaaaggatttggacctggtcaggctgggttttctgtttccctagtgttgcctcaggtcctgcgtaattggattggaacagaagttgtgttccactcacccgtggtcctaagatctcatggagagtcctctaggggaccttgggggtgtccgccaactccgtgcccaaggtgacacggtgctggagccgaatgaaagggtag

SEQ ID NO: 420 - DNA, 1000 bp, mus musculus
cttcattggctaaacttaggtcacgtgcccacccaggaaccaaccactgggattccatttgtccaaatccagccctggagcaacagaaatgggattgagccacagggaataataagagaggaagtctgagagatgagtgaaatcccagaagaaaatcaggtgctactaccagcaagggtaccagatgctcgggagaggctagtaggcagatgttatcatctccagctatctaaattgagagtgagtaaagccccatctgatagactgtcaggaagcaattaagccttttgtcactgctgatgctgcgcatgcatttaatgataacagatgtgctgcggcaccagtgagcagctgcagagagggagccagcagggctggaaggaaaagccaagccatccatcttccagccggagttccccccaccccttcccccgcgtcgacggaactactcaggatgcctaaactgactcgggtaccttccgagttgcaaaaactctgctctgggattcagcagatatatctgaaactgctttatgaccaacagttaaagtgaggtaaattaagggagagaaaccaaggatatggtttcgtgcataaaacccagccatataattaacagagcccacatcaatcacacatcagttaggcctcactggtttcataggtattcgatggtagaaataaaccagtcctgataggcaaagaggattgaagccagtaaaactgaaatacttaaatgtgaggctcctgtcgttaattagtcaagttccgactctgtttgtggtatttgtgggatatttagtaattaggttttttaatgttcctgtcctcatttagcttcagcgtctgtcattcccaacatttctttgtctaggcaatgccacgaggtgtatttttaataatagtaaacccttgtgctgcagatcactctgtcctttataaaatcactcactggagttgcccagcaacctcggagacaagcaagacgaactatcctccc

SEQ ID NO: 421 - DNA, 1800 bp, mus musculus
tagctgagggctggcttacagtgtcaggtgcttagttccctgtcatcctggcatggaacacagcagcagatgggtgtggtgctggagaagtagctaagagctacatcctgattggcgggggggggggggggggggtgtcacggggtggggggagtgacagagaggcagagagagacttggcataggcttttgaaacctcaaagcctcagagtggcacacttcctctgacaaggccggtcctcccaatccctctcatagactaccactctccgagcctgtggaggtcactcttattcaaacgccacacatataaaataaaaatgtatgttgcagctaaagttggcagtccttattgtatatgttttctttgtatttgcttgtctttattcctatttctttacaaaggtttccctgcaagaagagtaagagaaactcacatgcccttggacagaagaatttccagtcagatacatttttttgttatccagcaaagatgaaaccagacccagtcattctcttagttaggatggctattgttgaaataaaacactgtgaccaaagccacttgcggagggaagggtttatttggcttacatttccatattgctgttcatcaccaaaggaagtcaggactggaactcaaacagggcaggaacctggaggcaggagctgatgtgagggccatggaggggtgctgcttacaggcttatcatcatggctggaccggcaggcttgctccccaccccatttcgggctgactttcaatagatggcagcgagggagctgctctgctacatacaaaaccccgacccagaagcaggtcgtctacgaatggtttagcgccaggttccacacgaacgtgcgttcaacgtgacgggcgagagggcggccccctttccggccgcaccccgtttcccaagacaacggctctccgcaccggatcccggtcccgacgcccggcggggggagaccccgcgccgctgcggggaggacgcggggaccccgccgagcggggacggacggggacccggctatccggggccaacggaggctccttcggcgctgccgtatcgtatctaccccccaccccccgaaagtaaaaataaaaacaagaattaaaaaaaaagtcaaatttgtgctatctatatactcactggagcatggctaaactctcagtggcctgccccttaaatagaactgagtccttcacctcccacacctctgccagaagccattggctgtggagttaactcagcgtccccatcggactttttttaagagttctgtttggcacctggagagatggctcagcggttaagagcactgactattctttcagaggttctgagttgaattcccagaaaccacatggtggctcacaaccatctgtaaagggatctgatgcccacttctgatgtgtttgaagacagatacagtgtcagatatacattatatatatatatatatatatatatattttttttttttttttttttttaaagagttctctttggtagttttctgtctaggcagttactttttaggggatgggctattggtggtaggggttgtcacggaagccttccctgtcccttcctctccactgtgcatcttcagccatggatgacacagcaaaatagcctccttgctcttcacagccagcaggagcatgggccatggatcttcacagggtttctggagccaacactattcatggacacagctccctgatgcagtaggaccacagacccagacaaggtcctcagaggctgcccggaccatggacatcaacatgacctc

SEQ ID NO: 422 - DNA, 1200 bp, mus musculus
ttaggaatgtgacctatgcccccacccggcaccacccaggaaatggtttacctcctactctaagcggtcagtgtgtgtgtgtgtgtgtgtgtgtgtgtgtgtgtatgtgtatgtgtgtgttatactcatgtattcaatttcttcaaggtgagggagactctggctgcggagacagggctgagtgtccgtgtggttcaggtgtggttccagaaccagcgagccaaggtaacctgcttctcatctttatctgtctttgtcttactggtttcttccaacaacagccgatggacatcggacttgctgtcagcctttctaagctaacttatggggtagagtcgttctcttgattaaaaacgcctatcatcagcaattatttcagccacagcgcctggaggaagggagaagcgaagtgtctgtgttagtggttagtcaaacagtgaaacagttgtttttgttgtggcaggcagaatgcatgtgtccactcccagccttcagtgtctggcctctctaactccagccttagtgtcctaggtaacagacaagtcctgggttacttattttcttccagactctaaaaatatacatgccctggccattttcccataatcttggttttatttatccttctttctttcatgtatgttcatggacatggagtgtacatggagttatgtgcatggaagtgtgtgcatttacacgaaggccagaggtcttcaggatagtaactcaccttggtttttgttcttttgaacagaatgtctctctaggacctagagttcctcaattagtcagatcctggggtccaggcagccctaggcatcctctttgtccccattcctcagcactgggtaacagtgcgtaccaatactttttgctctagttcttaaacattgaactcaggtctgtgcttactcagcatcactttgcaaactgagctatcttcccagtccttagatggtgataaattacccttctcattaagtcgcaattctgcaacagaattcctcagatcagggctgttgttggtgtgttgctattccatcaatagaagaattcatggtgcagttactgttcgggagctcatggggtgtgcgttcaacaaagcaggagcacactgaaaactctggggaattgtatggccaaggaattcatttttctagtatctcactgtagtggctattcctggttgtcaacttgaca

SEQ ID NO: 423 - DNA, 1400 bp, mus musculus
cctaaatgatgatgaaatatttttattaaattttccaaattttctaaaacagatacatgatttcataaggagacaaaacccttcatggtcccaatcatatatctatcaacatagtcctgatgctttataagtgctaaggatttccatacttttggctttatactttctgataacttttattttgtatattgcaaaattatagggaggctctattcaagatggtggtggctggcagcacccacagggctgaggggcctctcaagacccaaggagggtttgcagagtgacatttcagtgaaggataagactgcatatcacgcactatctccaggacaacttcaacaaccttgtcaaagtcacgtctttttgttgttgttgttgtttgtttttattgattctttgtgaatttcacatcacgcgccccaatcccgctcatgttcttgccccaccatgtctaccctctacccttgcaacctcctcccaaaagaaaacaaaagaaaatagaaaataattatagcaaaaagaaaagtattacataaaaattaaaaaaacaaagaaacaaacaagggcaagaggagagaattagaactagagatgcagaagcagtggcagggtgtgctgaaatctgggatccatgctgctgccagaggctacgttggttcctgtgcttaggtttcctcagggggaggtcacgttgaggtccatgatctgtacccatctcaggacaccgtgtgaatctctgtggcccatgctgccgctgagggctgtgtggatgtctgtgtgctccagacatctatgctaatgtccaggatctgtgctgcgattgaggtccaggttgatgagcaggatgtgtgtcgttactggaaaccatgtggaagtacaggatccatgtggctgcaggatgctatgggcacaaaagctacttttgcgtggaattgatgactgcagattcatagctgagaatgagagaccttgaaggcttctgtgacagccgcttccccctccctcccctgcaccctcccctctgccccacaaaaaagagaaaccgtccagagaggaagctattggaaaaaaagaaaagaaaagaagagaagagaaaagaaaagaaaaaggagaggagaagaaaagtgttcttaaaacctgtgataaagatgctagctaactcctcagagtggatggtttctagcaaggattatggaggactgggactctgttttctttagatgtccagtccctgggagtttgaccatactctaatgcatatataggcaacacaaactagacttggtgttttgttgttttttgtttatttgtttgttttcttttaatgggaggatgtaagggagtcaggataatcctgggaggattaagaagcaagtgcaattagggtgcatggtaca

SEQ ID NO: 424 - DNA, 1000 bp, mus musculus
agggaaaagaagaaagatcaattagcagaggtctctaggaaaaggagcctgtgctcatcgctggatgggctcggggagccagctcttggtagctctgaatcagatgatgaattctcctctgaagaaacagactgggaggaagaagcagctcattatgagaaaaaagggtaccagccaggtaaagtgctagctaatcagttaaggaagccaaaagcggctggcgaaggccagtttgctgattggcctcagggcagtcggcttcaaggtccgccctatgcggagtccccgccctgcgtagtgcgtcagccctgcgcagagagacaatgcgcagagagacaatgcgcagagaggcaatgcgcagactcattcatagccccaagaaagaacaaaggcttacaagactggctcagggtctgtcgagagcttgggggacctctcaccaatgcaggcttagcggccgccatcctccaatctcagaaccgctccatgagcagaaatgatcagaggacatgttttaactgcggaaagcctgggcattttaagaaagattgcagagctccagataaacagggagggactctcactctttgctctaagtgtggcaagggttatcatagagctgaccagtgtcgctctgtgagggatataaagggcagagtccttcccccacctgatagtcaatcaactgatgtgccaaaaaacgggtcatcgggccctcggtcccagggccctcaaagatatgggaaccggtttgtcaggacccaggaagcagtcagagaggcgacccaggaagacccacaagggtggacctgcgtgccgcctccgacttcctattaatgcctcaaatgagtattcagccggtgccggtggagcctataccatccttgcccccgggaaccatgggccttattctcggccggggttcactcaccttgcagggcttagtagtccaccctggagttatggattgtcaacattcccctgaaatacaggtcctgtg

SEQ ID NO: 425 - DNA, 1000 bp, mus musculus
gttaaaactaagattccggtgccctctttacatgaccctgtcctcaaagacaccctgagaagccaagagcaccttctatctcacggtgagagaaccagctgcttcaaagaaggaagcccacaaggccaggagggagagcccacgaatccactgaagggcgtggaccccagcaaggatgtctctgtcccatgtcatgaccaagagctgtccaccaacaagacagaagacagtggcgtgtccagccaagatggtgagagagggtcagcacctgctaatgagaccagatctgaaaatgccagtcaaaagccacgtggagatgctgatgtacaaaattcccccagctccgtggactatgcaggaagcttcaaagatgaacgcacaaagccatccttcctagagctgttcgaaaaggccaagaatgctcactatgtccgccacagggtgccccccgagtctgagagattacttagcatcggagagatatttggacacaaacactactcactccccagaacaggggaaacactgtgaaaatggtgccaagtcccttcctctctgcctgtgtaatgtcgcctgaccagaagatattctgtaatcactatggaaacgagacccttcaaatagctgccgtagcaacgcacagaaacaagcagaaatgcaaaataagctttcttttgcaacctcggggaccctgcccttttgtttggtcttcctcctaataaacaaggccactatgaagaggaaggagagggaaaatactatgaaaatattttaagttgcgaacctgggcttattttgaagaagaaagtcttgtttgtccgaagctctgcgatgcttagagtgccacctgctggtcaaatggcatagctatttgcctagttttctttgaggtgggggggtgggaggggtggggagggtgttgcatgggaactcaactgaaatcacgtacggtgacctggtctccagataaaagctgttctagccacagctctggtctcct

SEQ ID NO: 426 - DNA, 1000 bp, mus musculus
atatgactggttgacagacagatgagtgatcagtgtaattacatagctaaacagaacgctatggaatgtaatagctgagagcgctggggctccacagaggatcatgaggtaatccgaactggcaagcggaagttaccaagcatggaggatgaggatgaggagaggcatcccatgcaaatgcaacagttatctgagcgaggcacaccggctccagacagcatgatttaaggaaggggtgagagtgctcgtggacacgggcagcacacagtgggaagagggtcatcttagaaagagacagcagcaataatgcaaggctagcctgcacacggccttgttggccacgctcagcacgtctaacaatttatacaacagaaacaagccatgttgtccttgtgttaattgatactcttccgggcatcaactgtaatgttccccgtggctaatggactttcctggtctggtggcacaatcagccatcttcttttcaggctttaatttacttgtttactatgcctcaccactgccaggacagcagaccatgagaacaattctttggcgttaccagctatcagctgggggtttaaccccattaggggtctccctaatgtaactctcaggctttaaactgagaagtcaacttggctgctccaccttctaaaaatgacttaaaatagttcttattctcctctgtatcagaatcctctagagcagcggccctctgactgagacatcgggcccagaagtgttgctatgacctgataactggctggaagtgcaaattcttgaatgaagcaactctgggctgcttgtctaaacgtcagtgtgtcaacaagctgtccaaacgactgccagtgactgagaacctccactcgtgcttctcacagcctcttccctaggagagccacttcttcacagtggatgcagctgaagcagacagtcagaggcctgggcagttaggcccgaagacagaaggacatggcccaacgtggcaaagttgtag

SEQ ID NO: 427 - DNA, 1400 bp, mus musculus
agcctgctagggtaggctgccccccccccgcctccccccacccccaccctccgccccacgcgcacaccccggtgtctgtttcgcacagccttctctccttacacggctgccccgaggccggccgcacagtcccttctggatgccctttcggactggtgccccctggcgcccaggaatcgcctttggtggcagggatggggtggagtcgggtcggaataagcactgtgtgtgccgcccgcaggatctgctggcacctctccccatgttacccattgaggtggagcacagtcctctgctcagcactcaggatccggcactgtgctggcagggtcaggacggaggcgaccgggcagggcacgcatccgctgggcaaaggtttctttcccgactcacatccgccacagtggctttacaactccccgaatatcctctgctcgcccaaaccgctccgggggcttgcgtgggaaatcgtggctcgcctcgcccacaatggcggtccctgtgaagtcgaggcgcgggaaccacaccatgagcttgtggctctgcagcggacatctgctccgcaataacaattgcccactggaaccccttccgaccctgcaaccgtccctctctccgtgccaccaccaccaccaccaccaagaccaccaccagcaccgtattccattctccgacatctcctattcatagtccaaaaaccaaaaaaacaaaacaaacaaatatacataatacacagagttgtgtgtgtgtgtgtgcgtgtgttgtctgtatgtgtgtgtattgatagatagatatagatagatacctatacctttcatatatggttatatgttcatatatatgggtatatataaaagattaatgcgtgtgcgtgtgcgtgtgcgtgtgtgtgtgaagtgaaagaaatcgctacaggggcttgaagtggacgctcatttgtgactattcgggaaagctgactgggcccatgggatgcgtgcgaaggatgctatgcacgcgacgcagttgctccatctgaggcaggtgaggcaggtggggcgggctagctagagggtttgttccagacctaagagcaggcgatgaggaggagatggagtcctgttgaggctccatgagtggcatgggtggacgagtgtttgtgatgcgggcggcgtgtgaggaaggtccgcttgtgatgggggcgggtgcgtagtcttggttccagggtaagcagggagtctgtagtggagaggtgcaaatttgttgtgtgggggcagagaggctgggccggagtggtagtgtgggaaaggaatgggcagcgtgcagacagggagagcatgaagcgggaagacgtctatggggtatcgggtcccggagagtgtggtggtgggagggcgcgagtgtgtgtgcatgtgtccacg

SEQ ID NO: 428 - DNA, 1000 bp, mus musculus
tggaggcgtgggttcgaatcccactcctgacagcctcgccttttgccaccgcaccccaccccacacaccgcatctcttgcctccatcctcaacctctccagcgcctccacactcctcgcctcccaaacttggtgccacagatctggatctgtcggggctcaccccaggacctcagctcggggcccggactctcctaccctctggcgcggcctcccctgactggttcatccatctatccatgcatccatgcatccatgcatccatgcatccatgcatccatgcatccatccatccatccatccatccatccatccctccatccctccaaccatgtatccatgtatccatgcatccttccatgcacgcatccttccatccacccacccaccaacccaaccaaccgtccgtgaatccatccatgtttgcctccatccatccatgcacctctgcatccatgaatccacgcatgcatgcacgcatgcctccatgaatccatacctccatgcatgcctgcatgcctgcatcatttccggcccaggcactgtcgggggggaaacatgttctaataatgggtcttgggccctggcaggaagcacaggctgagagttcatcaggtgatggcaggagacagggcatgggtggttcagtggtagaattctcgcctgccacgcgggaggcccgggttcgattcccggcccatgcagagtccagtcccttttggtcttcacgcccacattgcccttggacagcctgcgctgtacaccacacctcctccacatacacagacacactccactgggccactgcacacacactctggcctgtaagccttgcctctcctcattctgacaactacctagagcctccttcaaatcacttgacacactcagcctacccactcgcctccaccaacaagaaactacacactcagcctacccactcgcctccaccaccctcttatgctttcccttctccatcttcttctccaaggagttatata

SEQ ID NO: 429 - DNA, 1400 bp, mus musculus
cagccccacccgcccgtttgggagcctgctagggtaggctacccccccccgcctccccctacccccaccctccgccccacgcgcacaccccggtgtctgtttcgcacagccttctctccttacacggctgccccgaggccggccgcacagtcccttctggatgccctttcggactggtgccccctggcgcccaggaatcgcctttggtggcagggatggggtggagtcgggtcggaataagcactgtgtgtgccgcccgcaggatctgctggcacctctccccatgttacccattgaggtggagcacagtcctccgctcagcactcaggatccggcactgtgctggcagggtcaggacggaggcgaccgggcagggcacgcatccgctgggcaaaggtttctttcccgactcacatccgccacagtggctttacaactccccgaatatcctctgctcgcccaaaccgctccgggggcttgcgtgggaaatcgtggctcgcctcgcccacaatggcggtccctgtgaagtcgaggcgcgggaaccacaccatgagcttgtggctctgcagcggacatctgctccgcaataacaattgcccactggaaccccttccgaccctgcaaccgtccctctctccgtgccaccaccaccaacaccaccaagaccaccaccagcaccgtattccattctccgacatctcctattcatagtccaaaaaacaaaaaaaacaaaacaaacaaatatacataatacacagagttgtgtgtgtgtgtgcgtgtgttgtctgtatgtgtgtgtattgatagatagatatagatagatacctatacctttcatatatggttatatgttcatatatatgggtatatataaaagatgaatgcgtgtgcctgtgcgtgtgtgtgtgaagtgaaagaaatcgctacaggggcttgaagtggacgctcatttgtgactattcgggaaagctgactgggcccatgggatgcgtgcgaaggatgctatgcacgcgacgcagttgctccatctgaggcaggtgaggcaggtggggcgggctagctagagggtttgttccagacctaagagcaggcgatgaggaggagatggagtcctgttgaggctccatgagtggcatgggtggacgagtgtttgtgatgcgggcggcgtgtgaggaaggtccgcttgtgatgggggcgggtgcgtagtcttggttccagggtaagcagggagtctgtagtggagaggtgcaaatttgttgtgtgggggcagagaggctgggccggagtggtagtgtgggaaaggaatgggcagcgtgcagacagggagagcgtgaagcgggaagacgtctatggggtatcgggtcccggagagtgtggtcgtgggagggcgcgcgtgtgtg

SEQ ID NO: 430 - DNA, 1000 bp, mus musculus
gcatgtattggtttgccttagatagcattgttgagctccatttgtggtaatgccaccattgagagaaactcaccaaagaactgctaatgtggggttgggggctggagagatggctgagcagttaagagcactgactgctctttcaaaggtcctgagttcaaattccagcaaccacgtggtggctcacaaccatcagtaacaagatctggctccctcttctggagtgtctaaagacagctacagtgtacttacatataattaataaataagtcttcaagacaaaacaaaacaaaaaaaacctgctaatgtggttcctgaggcagcttgctgctgctaaggccttacctcaggctggttggtgagccttgcaatttctttaagattgatctacagctgctggttcatgtgtggtgtctgccttccaagaggactgcactgcagctgctgagtcatatttggtgtttgctacaggactgaactgcagaagaagatggagctcgtccccaaaaaactattgctaaacacgtccagttcccccatatcctaataacttttctcttctattgtagttggtgggtggtgggcaagaggagaggttgaacttttaataggttgcaaaaaaatttatgcttacactaatccctctagggaacagctctaaggagatatgaaaatgtctccagccaggacttcagctaagcatagccagtaaatcttgttggctacagattcctcaggacttatcatgtcattctttcaaatggcatgaataatcatttatattagtttggctatacagtccaaaccaacttgttaaaaaaaaaaaaaaaaaaaaaaagaatggccgggcgtggtggctcacgcctttaatcccagcactcgggaggcagaggcaggcggatttctgagttcaaggatagcctggtctacagagtgagttccaggacagccagggctatacagagaaaccctgtctcaaaaaaaccaaagaaaaaaaaga

SEQ ID NO: 431 - DNA, 1000 bp, mus musculus
aggttttcttgaggtgtccttgacccctttgtctccaacaatccttcctccacctcttctgcaagattccccaagctccacaggatgtttgactctggatctctgcatctgtttccatcagttgctgggtgaagcctctctgatgacaactgggctaggctcctgcctcaagtatagcagatttgttttgctatggttggtttgtttgtttgtttgtttgtttgtttgtttgttgtgtctctgggctatccagcctctgcttcatggctctccacacagtatcaggagtgggctccccgtcctggcataggtcttaagatggaccagtcactgattggccactcccacaatttctgtgtcacctttaccccagcacatcttgctggcaagacaaatcataagtagaaggtttttgtggctgggttggtgtcccagtccctccaccagaagtcttgcctggttacagaagatggcccgttcaagttccacgttccctactgctaagagtcttagcttacaaaagatattcttgtaagccaagtgtgaagttaatcacgacaaccaaaggtttgctaacatagaggaagagctctcatcaataggggaacagaaagtctcagcgacaagcttatgaaagaatggctgtctcaagggctccagcacccgactccgcctgtcagaggatggtctggctctttccacttgtcttctgcctcggctcaggtaaaaaacgtctgtggaaactgattgagtcactgagtgagttccttctttggaatgccttgctcctcttggtcaggttgactgcccagttctctattcagagacttagaaagctcaccgtggtcctagcgaactgcttcccgcagactgccacgggactgattcagagcaaacacttcggctgggggccaaggggaagggaagtgttttctgagatatggaaaatgagtctttgtaagtcaggactgttcgtgaccagcgtattgtggtacaaaaa

SEQ ID NO: 432 - DNA, 1200 bp, mus musculus
gagggagacagtaatctgaatacaggagactgtcattgggagtcatgttaaagctacattccttcagcagagcagtggtaatttgttttaacccagctataggcctatctagtcttctgacattattgcaccagcatatcctttctttttacttttctcttttattagatattttctttatttacatttcaaatgttaacccctttcctggtttgccctccgaaaacccctatcccatccactctacctctgctcaccaacccactcacttctgcttctctgttctggtattcccctatactgggacatcaaacgcactcaagccaaagggcctttcgtcccactgatgtccaacaagtccatcctctgccacatatgcggctggagccatgggttcctccatgtgtactctttggtggagatgcagagacaaagtgtggagcagagactgaaggaaaggccatccagagactgccccacctagggatccatcccatatacaattaccaaacccagacactattgtggagtctaacaagtgcttgatgacaggagcctgatacagctgtctcctgagaggctctgccagtgcctgacaaatacagaggtggatgcttgtagtcaaccactggactgagcacagggtccccaatggaggatctagagaaaggaccaaagaagctgaaggggtttgcagccccataggaggaacaacaatatgagtcaaccagtacgcccagagctcccagggactaaagcaccagagtatcttgcagctaggtcacctttgtcgatcaaagtgtttgcaactgggttggtgtttgcttttctcctctggaagtgtgcagagtaccttccagtaccatgagcactagacaggaggagttaagtatctagataggcaccagttcgacctctgtgttcagtgtgttttatatatatgttgtcttcagccgtagtgctagagagcacccgttagccttgaggacagcatggattgtttgggggtttccatggggccccttttgttaacaacttggttatatgcagccattcccagccctggaggtttcatttggtggctagaaatgtctagttagagctttgcctttccctctatttgttggctctattaagattcttttcacatatgcatgcatttaaagaagcttctattgtattctgtttccacatgactct

SEQ ID NO: 433 - DNA, 1000 bp, mus musculus
taaaactgcaagtcgacaataggaacaacagcaaatatacaaacctgttggggccggcctgcagctctcatgtccgggttcgagcctgggggcatcttggagctgaaagaaaaggaatctaggcagaagagggagagaaatggaaccaagacaggcttctgatcaaggctcaactttaatggcagcagacacgcttgataaaggagggggaggcccattcccagtcatgccaagtttcttgtgaagttatcagaacagccttttagcaggaactggagaaattcacagttctcagctaactccagtagatcttggagaaccagtttggcctcaggcaggtagcaggcagtgtagcatcaaaggagagtgatgagaagcaacacagcaggtggctccgcctcagtggtggacagtctcaaccagcctagttaggatgaaggaggttacacaaacccttgtttgggggttggttttgtacattttgtattcagatgctgatttctatgcctaaacatctgtctacagtccagatgatggcataatcaagtatctctgatctcgttgttaggtaaaatttgttcttcctcatctctgatgggataacaaagagctgattcagcttatgattgggcagaggagagaggaagaacgaacttgagatcccagccagggtcccaggtggagagagaggaaacaaagaagaccacagagagagagaaatgagtggagagaacatgtggtaggaccaggaggatttgccatgaagtcgtgatgagcaagtcaatatgtgatcacacatggaccagagcgaggcagacaagaccagattggcaagtaatgaggcatttgtctggctattagcattagagggctagaataatttagaacctaccaacaacttattaaaaacatataggttcctgtgtcatttactcaggagctaaaattggctagacagggcaaaaaaaaatgtgctgtagttatttggaagcaaaggagg

SEQ ID NO: 434 - DNA, 1000 bp, mus musculus
aaagggaactgcaaccctataggtggaacaacaatatgaactaaccagtacccgggagctcttgtctttagctgcatatgtatcaaaagatggcctagtcagtcatcactgcaaagataggcccattggacttgcaaactttatatgccccattacaggggaccaccagggccaaaaaggggcagtgggtgggtaggggattggggggggtggttatgggggaactttaggatagcattgaaaatgtaaatgaggaaaatacctaataaaaaataaattaaaaaaaaagaaaattataactttaaaaaaaagaaatgtcagtagaaaaatatttaaataaatctctaatgtacaaaggaaaaaaaaagaagaaatctagattagtcattctgatatctaacgaagtaaatttccaattaaaattagccaaaagagatggtgaaggacgttccatactcatcaagagaaaatacttccaagatcatgtctcagttcagaacaactatgccccaaatgcaaagatactcacatttgttaaagaaacattactaaagcttaaatcacacatcaaaacttgcacattgctcaggagcagagggtgccaccttggttcctggaatccgctgaacttaggaaattagtctgaacaggtgagagggtgcaccacagaagctgacagcttcagggacctgccaaagcaacacagcttctgggaaaggtcctgttttgggccttcttcttcggccaggaggaggtccaaacacaagatatctgcacaccttccctgtaagaggagagcttaccagctgaaagtgctctgagcactgaaactcagaggagagagtctgtctcccaggtctgctgatagacggtaacagaatcaccagaagaacaatctctaaacagagtcaactataacaactaactccagagattaccagatggcgaaaggtaaacgtaggaatcttactaacaggaaccaagaccactcaccatcatc

SEQ ID NO: 435 - DNA, 2400 bp, mus musculus
gcttgttatcccaatgttggattggggttcaaagccagctggcgcttcataatagaatccaggccagtctgggctgtacaatgagaaaggaagggagagagggaaggggaaagagagatggtatagactaaagaatggatggctttgcggactgtgagaaagtggagaacaagtggagtttttttgtttgtgtttagtgagaagcacaacaccggatttaaagtgacaaagttcccagttccaattcaatgcctagagaaccaagaactcaagtactctgtagagatacaagagcacacaaggcaattggtataatctagatgacaaagcagtggctttggggacttgggtgatagtgatggagaagagaaggaaatggctgtaagatacatttcaaggacaggaaaacagggcagagcagcatgcttatagattctggagataaaagaactgagaatttccccctcccccaggatcagcgagtcatgttgagaaggaatcagagaaaaaaagaccgcaaaggaatagccagaggtaagtcatgcaaaactggagaaactgtgccatgtagaccaagacacgaggagggggattcagccattcacaaatctattgaaatcaaacaggcagagaaacataaatgccactattgatctggcaggagagggatcacagtcaaccttcagaagagcagaagagcagcagcagaagaaagctgcatccagcagatctgataagaagctatcaagcaacactcaaagaaagcagtttagaactgctgttggatatgtgcatggagctgaggcagtgcttggcacaaggagaggacgtactatgaggatatgaaagatctatgggtaatttcagctctggttaggcacctatatctcttctcaagcataccacaaatgatccctgtgggtcccataccttacaatgttcacgcctttaaatgtctaatcaactgaggaatgtcctctactcttacctttggttatctattaaatgtttctcatcacatggtcatattagcccagtttcttttcactagacaatccttctagatagtacaaaatagtattggcttgtcacctaccatgagttggctcatatctcagaagcactttgattatcttggagggtctatcaccaaccctcttgatattttccctcatttgctcatttcctttctctctctgggagggcactttggagattacatgaggttgggatatatgagttaaacaacacaaactcttaacacaagtaccagcatttaaagtaaaagggactggggtcattgcaaaagattgtaaacgttgggactaacaaatttggttttgtgggttttcttcctgaggctgtgttccagagagggcaataaagggtaaaactcattagagcatcattatcttttgtctaaaggaaacaatgtgtggtttctgggtagcccacttggtgtttgcattggccctggaagcctttcaaaccaactatattgtttgaacaattcccgtcttgaacatgaaaagaaccaccagcaaaccacagagctgatgctaaattactaggtgatgactcctttggctcctaaaggtttctagatctcagtcattgaaattatggatcttccttctaaaaagaatgatcatcggtgcctctggggagacctcccatgcagtcttctctccactactatgttctgggacttctgagaagtttggtttagaatcatagtcactggattctctccaacacctatttgtgcttgtgtgtgtgtgtgtgtgtgtgtgtgtgtgtgtgtgtgtgtgtgtgtatggtgtggacatgtacacatggtccagtatggaggccacaggtcatcacatggtgtctttctcaatccctctctaccatatttttgacacaaggtctcccactaggcctggagctcactattttggctaagctgacacttagaaagacaggtgtcactgcacatggcttgttgtgtgaacaatggggactccaagttttatccttaagttgcaagcatcctgtaccatctgagctatctccccagtccctcagaccctgattgagaaatttcagttctttggaaactgcaaataattttcagatagaatttacaaacttaaatttgagcagtggtgtgacttaacttttttttctcctgagggaaacacactcagttcctgttgatccagaggatataaaatggctgttgagggcatactcctatgttgcttacctcttttggaagctttatcgaactttgtaataatgagaccttgggaggaaatcatagactatatctatggctttatggaaaaaaaaacttcatttataaggacttctactaatgaaacaatcagtatctttctagaaaaattccatcta

SEQ ID NO: 436 - DNA, 1200 bp, mus musculus
gagcatgtgtccttcttaccagttggggcatcttctggatatatgcccaggagaggtattgctggatcctccggtagtactatatccagttttctgaggaactggatcttacgttttaaaggcatactaacaatctttgctttttttttggaatatttatttatttatttatttatttacatcttaagcaattttcaacagttatattatttctggagctttagtcaaagagccttgtcactgagagttctgaattcttggcttgatcaggcaatataatgtaccaatcaatataccaatacaccaacaatatacaaatcaaagaaatgcatggtagaaatatgaggtaagatttagtcagcatgatcacattaagaagaagaatggtgccgggtgtggtggtgcacgccttgaatcccagcactctggaagcagaggtaggcgtatttctgagtttgaggccagcctggtctacaaaatgagttccaggacagccagggctacacagagaaaccctgtcttgaaccccccctccaaaaaaaaaaaaagaatggatgactatgtttagtaaccctcaaatccaagtccatgttttggcccttgataagaactttaaggcaaaataaagacttggagtaggacacatacatctacacacatacataaacgatatgcctgttcaaacaaccagcctgtgtctcattttctacgcctcagttcatgattttgaaggtgactctatgaagtccttaatgtttggatacccaggctatcccatagacacttgcttctgcttgagcgtgaccacatgactgggcaacattcctacacagtcctgttgctcctgggctctaggtggctggaggactagagtgatgactggactccttcaggcacttttggaggcctggaacagagcactgtaaaaacttaaagtagagtttcctcaattcctttgctctctttgcctttagcgtcaacagaggatgagatgggtttgataggctcaggttgcaaatagacactccttgagtgaattaccttcctatgtatagagtgagcagcgattgactcaaaatatttctagagagacccaaaatgaagacagagatgccaaacatcttcacactttccgttatggtgtaggactggcatagcatcaatactttttagcacgatcagcttctaagggcctcttac

SEQ ID NO: 437 - DNA, 1000 bp, mus musculus
aagaccttgactttgtgacttgctgcctcagtttccaagttgctatgattacagacctgtgtccctaagcccagttggtgtgacttttctggctttcccaaatgaactatttacttataggtatgaattttaactcattcaaaaacgttattcttgatcttaaagcagagagatgagacagaaatgtgaagtctgtgagagtggacaggaaggccaggcccttagccacagcatggagttggaaacaatgggacacaggaactgctgtccactttgctcttctgcagacctagcaagcacaagaagctacatttgcctgagcagttgactctgtaagttttatggttgtcccagaggtaaactgcccagcaagtagactgaagagaaataagtgggcggagttgcaccagatgacctctgaccttagcattaagagtacaagactatttccattttcaccgtcctatttaactcagcctcacaattcttgttatttcatgacagtttctatttgctggtgtcctggaaatacttgtgttacttttacatgtttctgaagatttacaagcatattacaaaataatgataccccagtgataatattccctgcccactgctttctatgacctgccaaatgcctagtctctaggcataaaatcagccgagctggccatgtgagcaaactcatataagaagatgagctacagatagaatctctttaactctcatattgaaaaatgttcaggtctcactctgcctagatttcaaaatcgttcaccatatggcttctctgtccctctagtctgcttactgttgctccatacatggttccacagctgccatgacagcagctgctctctcagtcaagacccctctctgcaccaaatgtgccccttactcagccttcaggggtaagctttctgtccacacctctgccccctgaattttgtcatcccatgaatctgcattcctgtacttctatgcctgtgaatactatttg

SEQ ID NO: 438 - DNA, 1200 bp, mus musculus
ctggatgtcataaagtcaaaagctcattctttcaaccattactgcaacaactatgcagaattatctaggtctaatttacacactggagacagggccttggataaagaaatagagaatttctctgttctcatggaactttcattctaatcagtcaaacagtgatcagtattaatggacaaagccatataggtattcgataataagcatcatataaaatatgaattacatgaaatacataattaagcaagtgataacatagaactaaaccaattcatttaaaaattccacacagtgcacttaaaaaatgtccatggcagtttcccaacccgagccagatcagtggcttgatacactcccataccctacagcctgtctgcctctcaggaggtccatagaaaccagcaacacaggtgaaagtccctcctgcccaagccagctgggacatccacagagcccagctgacaaaggacctgtctgccctgataagctccaccttctttctggtctttccccacccagaccagatcaggagcatgataccctcccacaccctacaatgtttctgactcccaggaggtctgcagtaatcagagacacaggaggtctgcagtaaccagagacacagaaggtctgccttaaccagggtcatagtccttccagtttgtacctccatctacaaatgggttagatcctgcccctgaagccctgagcctccttgtctcccaggaggtttgccctgactaggaacacaggagttctgctctaaccagagatacaggaggcccctcctaaccagagacagcactgactgccttccagaagactggctctaacccaggtcacagagctctacctgcctccagaggccagttccagtcagaggcacccaggccagtcaacaccagagagaaccatatgcaagctcaagaaaataagtaacagatccaaatgcaatttgccatcatcagaacccagttctcctatcagagcatgtcctggataccctaacacatctgaaaaacaagattctaaactaaaatcccatctcatgaagataaaagaggcccttaatataagtaactccgttaaagaaatacaggaaaacacgggcaattagaagccctgaaaaaggaaacaaataaatcttttaaacaaattaaaaatacaaaaaagcaggtgaaggaactgaacaaaaaggcc

SEQ ID NO: 439 - DNA, 1200 bp, mus musculus
cagcgagtgagtggcaatgtgacatacatacataatagaatattacagcatcactaagtactgccaagcagaaagcaagtcctgcacaacctcactcctatgtggaaccttagaaagttcatctcgtggaaactgaggatagaatggtggttaccagaagagagagtgtagttatgctgcctgagctgtcaaaatggccacacctctcaaaaccactgtatttcccacctcagcctgcagctgtcacaggagctgtacacagtggttgcatctcctttccctcctcagcttaaggctttggtaaaataccataggagctgtcccacaggagctgcccaacagtgacacctctccaagctcccctagcagctcagcagcaatggtgcctcagctgggacgatcttcccatcccaactcatgggcctgatacagggggggaagtggtgcaaaaagcaccagtccatgagcaggaaaacccaccaatccctgagcgtcccacaaaccctgccaaccccagaacaggaaaatccatgaatccctgagctcccagaactcaggacttgaaatcccaccaatcctcactttgggaaatctctgtcctgaaagctccgcctactaagaaatcctatataagccctgtcctttgttcaattccctgctgtccactcagggggagcagaggcagccaccctgggttcgtccttctataccctgaaccctccaataaatctttcacgagatttttctgcctggtgtgactttctcattggaagaagccaagaaacaatgaaaagaagaaggaaaaaaacgaagtgggtcagggctgaggctccggagctcctcagctggggataccctcccctgagagctataccgccaatgctgaggaggcttcctttcagagatgagcggtgcctgggcttccaagtcccgggataccctcccatctgagtagggaaacagcgaatgatcaggtgaagtttcaggcagatggaagtaaagaatactgatgtactgcactgtagtttatatgtaacaataattcactgtacctcttcccagtggcccaattgatctgagcttcttttaggcagctcaattggtctttgtttcttcaaagggattcattttgtttgtgcttctttcaagtggctggactagtctcagggtgactttcagcattctttttactgtttttat

SEQ ID NO: 440 - DNA, 1200 bp, mus musculus
gctttatataagtattctcattatgttttgaaaatgtgtgtatgtagatgcttctgtatctaatttaattagagaaggctctatttaaaagcatgactgaattcatgacagctttttatcactgtgcgtcttctccattgatcagtgggtgccaaaaatacaagcgtaacaacataagatgaagtcgaagctgagagccggtctgtgtttgtcatttccctccctcaccgccctcagaggtgctgatttccttgggttgcaacattctgcccgcagtacagagctcctaagacatcctttattctggactggcgagatggctcagtgggtgaaagtgccaatcacacaaacccgatgacctgattcgatctccagatcttacagcagaaggggacagttagctccgacttcccgatgcaggccgtggccgtacacccatgagcccacgcatgcatgcatgcacgcccacacacacatttttctacattaaatgcaaagcttgctgaaaattttccttctaggtacagttggcaggggtgtcggggtgaatccctgctgaacaattgccacagttgtctacagatgttatcctgtcctgagttagggtacctgccacagctgcctcctggtaagggctccagggagggacaactatcgactggaagtatccctccgagaaggctcctgcctagttgcctggtctctggcctatggtactgatgaatgggtcctttgaaggtaggcaggtgacacatcactgtcttggcagtgtaggggtactgagatcccagcactatcctctctctctagttttacttcctgagtactgtgaggtggcctgacctcttatgatgttctgtgctaccataggcccaaagcaacagaactaagcaatgatggaccaacgcctcaaaccatgatctacaataatccatttccttcttttagttagttgatcctctcatccatgactttggagctgagtgacaatttgccctgaaagcaacataaccttccgatggccctctgaggttactgttgtgggtcaaggctatagcagaggaaaaagtggagaagtctctctgcttctccctctcaggccctgagaagctgttgaaggggactgtctgactgccctgcctcctcactgaggatggggaagacttgtggaaatggagcctatgtctgagaaccaaatac

SEQ ID NO: 441 - DNA, 1200 bp, mus musculus
acatacacacccattacccattcacaaacaaaaatagacaaaataaaatgaacatccttaaaagattcactttgtttgtttgtttgtttgagacagggtctcactagcccaagctaatctggaattccttatataccacaggctatcaaaggattggagaggctatcagagattggaaagttgatgttattcttggtcttctttataactgtggccgtggtgtgactgagctttcagcagaactaaagccagattggaaggaactcacaccatcactgaagccagggctcctgaggccccatgtggaattccaggttctccttccgagactctatcagttctcttgacctccagcagctctccgtgggtggtggtctcaccatctgcaaccagcttgatgattgcaggattcagatagcttctgggcaatgacatgcttggcctgttgcagggtagcctctagctcggtcagattgccttgtcatccttaaagaccagatccccacacactgtttagtgtcagtaatggaaacctttagacatgatctttgggggccttgatctctgtctataagtggcttatgcttcatcttggagaactctacactattcttcccagccaacaatactcatatttgacccaatagtgctctccacctcagcccagggacttaggatctcaaacaggacaaagtcatggactttgaccacgatgccatccatgttcaggtagcagttgttgcctgtgagcagaaccatggccgtgtccaagaacacatggatctccaaggtctaagactgcagcacacagatctcaccgcacacggatctcgccttcatggatctgcccgaggaagttgacctcatttgtgtttccaggtcagcttccagctccattttgtttgtgtaagcatcatcctcatctttcacgagggaacaaattcattctccattcctgtctggttgatggcatctttctgcttcttcttggagttttctaccaggccggcatgttgccaagctccacctccatctacagcttcctctggcccaaggagcccaactgccacctcagactagggatgtagcttttacatttgttatttatattacttcaagctcacaccactttatgcactgcaggaggccccaacttgctttctagtacctggttctgcttctgaaagaagcacaccttga

SEQ ID NO: 442 - DNA, 1200 bp, mus musculus
tgggcttacctgctcaccttaggagggctttctatgactgattcagcaatcagtagccagtgagcatggcctgacacaaggggcatttccatccattcatcctttcccacacaccaagcctccaggggagaagctgagtacttttgtaaccgccccctagccaagccagacacatttctccctgaagtgattgattgattgattgattgattgattttgtctctgtcactactttaatggctgaataagaagctttctcatgttccagaaactcacactaaagaatcagagggagatgggcaggcaaggtggagaacacctaagaggctgaggcaggaggattgtgggttttggggtcagtatggacaattcagagagaccctaaataaaataaaggggggtggctgagactcagtgatagaactcttacctagcatgcgttaagttcctggttcaacaggcagctctgacgaggtgggaaaggggtggctaagtaaacgggacatgcaaaaggaagagaggaaagttagaaataaaatgagccatctctttctcccctacatctctcctcatttctccactcagcctgctccccgcccacccccatgtaagctgctcactctccccacctctttgtcacttctgcctgcctggccagggggtctcttcctagggactgcggcgggtcatactactggaagccagtagaggatggctctattctcgaagaaatggctagagcggatgaacttcttgagagcctcagcagactttgttgtacagatgatgtcagaaaagatcaaacagcctgctgcagacagcactgcagccctgaggaccgtgtcccagatggctgtgattcctcaaaactcttgactctaggggacaccttctaccccagtgctcagaactagaggtttgcctaagtggcaccacacacacacacacacacacacacacacacacacacacacacacttcctacacactcagcaatgtcatttcttctctattttgggtcaacttccctctcctattatcttagctattaggcaggctcagacagtctgtggttattcagaaaattaaagctctcagaggtctgtttgcacagacagaacctgtcttgcccagcacttgctttgagtcacactagatagccatgccccctcggactcctgcaatcactcagatcttgaa

SEQ ID NO: 443 - DNA, 1000 bp, mus musculus
gtcctctaccagcatcatgagatatgattttgattctgagtcttgcttttcgggtgtgttggggtatccaggactggctgatgggggagtgctgggttctgatgcaggtgagaggtcttggtttctgttagtaagtttcttacatttgcctttcgccatctggtaatctctggcattagttgttatagttgtctctgtctggagcttgttcctcctgtgattctgttagcctctgtcagcagttctgggagtccagctctctcccaagtctcagtggtcagagtgctctctgcaggcaagctctcctcttgcacagaaggtgcccagaggtctgacattcagacctgcctccttgttgcagatgaaggccaaaaacagggcctgtcccagaagatgtgttgcctccgcagtctgcactctcacctgtgcagactggtgtctgagggacccaggacacaagatggctccctcacctgctctggcagtcagagacttcccaggcatacacctctcctctagcgaagaatgtacctgggtgtctggagtccaaaacatggcctgtcccagaagctgtgtagcctctgcttgtcctagaagctgtgttgcttcagcagtccacaaactgacctgtgcagactggtctctgaaggacccgggagacaagatctcaagtcctattttttttctttttttctcttttttttaaaaaatttttttattaggtattttcctcatttacatttccaatactatcccaaaagtcccccataacctccccccccccgaaactcccctacacacccactcccacttcttgaccctggcattcccctgtactgaggcatataaagtttgcatgaccaatgggcctctctttccactgatggcctagtcggatccatttagatccttgggtactttctctagctcctccattgggggccctgtgatccatccaatagctgactgtgatcatccacttctgtgtttgctaggcccc

SEQ ID NO: 444 - DNA, 1200 bp, mus musculus
actcctgtctgcacaatctttctatatctgaagaagctgcctcacccacaacagtgttctttccaatacacacccacccatgagactgtcagtgattttacattgttctcgggataacagggaatggaaatcttgtaaatgataaggccttgtcactcttcagcatcaccttgaagaactgagcctgttggaatctgtactccagccttagtcttcttgtccttgaaaaccagagcaaacagcactttcttcagtgacttccctgatgcccagaccagagaagtttcctgtgttgtgtgctcctctagacccacactccttctccgcatgtttgtacatatccagaattagacattcaagccagggatggtggttcaggtctgacatgccaccatttgtggggctgcaggaggatcactgcaagttttaggtcatcctaaaaagacagggtctttccctcagtgaaacagattggatacttggtattgtttgctgtgtgtacatgcatgcacatgccagaggttaactgtaagtgataatccactgtgcaattacacaccttgtttttaatgtgggcgcccgggattgagttcaggtgcccctggttgcatggcaagcacagcgctatcctcagctgctagtgctgtggtattttgaattatatgtgtctctcctagcaaaaacaagtgccatgagcacgatgcatgccccgaacctcctcatcaaattcaacatttggctcagggtttgaaaaaaaagtagttgcttaatatatttgttgagtgaataaatgactatttttaactgtttagatagaggaagaagaacccactggctacattcgatttgaaaaatttattccagtgatgaccagagcccttgtagaaagaaggtaaggaaggaaatccaattttaaggcaaataatgaccagaatgacactaatgtgaaaacattctacttggccagacgcgctgcctcatgcctgtgactctagcacttatggggatgaagcaggaggatggcagcaaatttcaggatagccttagttacatagtccaagccagcctggactacagaataagatcctgtttcaaaagaaagcacttggatttgcagcttttattcacccagcatgtgtctcaggtggcttcctctagcctttcagtgtacttaaggctgggttagggataagcttagaa

SEQ ID NO: 445 - DNA, 1000 bp, mus musculus
tatttacccttatgcctcccacaatgtctctgagatctatccccatttccccgcccctcctaacttcacatcctttttaaaaagtccaattcatgttgaccatacagatacttgtgtgtttggagcgattcactggggcatagtcaacctttccaggggccacacccttgaaaaaactgactcttcctctgccagaggtgattgactgtcaggagctcctccactgtcagacctagggacccattcccaagctgttggtattgtggagactcccaaatcaacgccagctcttggcattgctcttagttgctcacaggaacagaacagtgtgattctattgctgattgcattacataccttggtcatgaaacacagagaaatcagatttatacggactagaaagtgtcttccctgctggctgtctttaatactaccaaaaaatgctatgtagtctgttggggaaaaaaatcatcaataattgtatccagccgtgaactatgacaatgacttgaatggcacaaggtgcccattgggcaataggagctccaagtgttatgaagggtagccaacagccaaatgctttctgattggatttaagacacacccgatgggagttttagaatgcctggttcatggttgtgaagctcccaggccccaagggttaatctactcctgttattctgctaagcggatatagtgttaaactactcattaaacttgaatctatatacccatacattagcctcacacctcatctgtctgaggaactgtcggtgattaatgcagaaactcaggatttggttaaagtgcagagaataagtgtgagtggggcactgagcctcaggagggacattcacatcaccctctccacagcttcaggaccattatcgtgaagaggagacaggaagattgtaaactccagaagctgggggcgggggcagaggcggggcagcagaataaaaccaagtcttctggaaatgtcaggaccgctggactcacc

SEQ ID NO: 446 - DNA, 1000 bp, mus musculus
aattaatgctgagagtgaagcaggtctgtcacccagagggtcccggggcacagcaggctcccttaggctcccttagactgaatattcagactgaagctttttaggatttagattagttgttcatagtcattttcaattttgattctattgatctattgataattatggattattcagaaccctgattgatctgtgcttgttttagtagaggaccatccttggctagcacatgcccgtggctcccagaagtcattagttctttctcagaataccttagcagggttcagtggaacttcatccatccatttgtctgtccatctatccatccaccaggccatgtgccctaaatctgttcattcactaaactaaacagagaactgtagtgggcactgtgccagcgcaggggaaggtagtcattttaaagaggaagacagatgagatgtctgtagaaaggacaatcaatgcattgataaagccgatgaaggctaagggtgattaatcaccaattaaatgccaagtgtaaggactgcagccagatggcagaatgattggaggatcagacccagaatttaatcacatgagtagctgtgtcccagcggaggctggttctcagtttggacaagttttgctattttgagatcaaagccttgagtttggcagaattgaatcctgagattcctggactgctggcatcattcgaacaaatagccttggatttctcaatccctctgtatcctcaaaggcctgttgaaagctccctgtgagagcctagtagccgctctagcttcaaggccaggccacaggggcagtgaataggactgaactacactgcctggcccctggggtggtggattcctattcactgagctacactgctgtgatctggcttggaaagtcctggggctgatactggaggaaagggaccgaggagccagactcagcagcatgccacaggagctgtgagagactcataacagtatcctgagtgaagtttatcggt

SEQ ID NO: 447 - DNA, 1600 bp, mus musculus
tatagccctggcagtcctggaactcactttgtagaccaggctggcctggaactcagaaatccacctgcctctgcctccccagtgctgggattaaaggcgtgcgccaccacgcccggcgcaacatgtgttcttaatggttgagtcatcccttcaggcaacaacctagagtcttaggaagaattatctggatcaggttggcctgtggtcatgtctttggggtgttgtcttaattgttaattaatgcgagaagaccctgcccattacaggtggcaccattccctagtcaggagatccagaaccacattaagagaggagaaagctacataagccacaagcaatatgtggctccacagggatccatgtgtttgttctctctctgctcttgactgaggacggaaggctttaagttgctgccttgaatttcttacaacaatgaattgtaagctgggattgtgagccaaataaactctttccttgtttatgttgccttttgttggattacacacacacacacacacacacacacacacacacacaaacaagcacacacagaaatgaaactgtatcaccagcttttccctcacatgcctggcttcatagttgcttagatcgttcttggcatagtgatgcttcctcagggagaccctccactccttgaccacccaccccactctaatttcctcataccaaccgtttcatcgttgtcacttaacctaccattttctgatatcttcttatctatttgttaattatttccttgttcttgattataatctttgtggtgacaaaggaccttattttcttcctcagtgctgtttttcagagctaaagcatggtgccagagaatcctgggcatccagtcaagatatgtaattttttctgtcttcactaactcaacactttcttttaccctttcaagtcgcagagtgggcacagcatgctgggtggagtacgggttggctgagcctcgtatctaggcatgtgctggctctgcctcactcatcctgtgatgttaagaatgccattcagactctccttgggcctctgcttcatgtactatgtcccagaggaagttcttgtcatatccagagttctcctgcagattaaactacatcaggtcagacagtatggatgcaatgcagggcagcttcaaccaaaataagggacaccacaacaaacacagggaagggaggatggcatagagactcatcctccggatgctaacgctgatgggcggcacaggaactcatcagttccccactttctagtgaggtctgtggaagtacacagttactatgtttagcagattacctgttttagaaggcatattctggagcgattgtgtttccctacctcacaagctgattctgggatgcctgcatcctgatgtttaggctgggctagttgaaggataactagacttagggcagacacaagcagtgactgatgccgctgcggtttctggggaggctcaacacatgggcttcacttggctgccatctttgttctatagccatctctgttgggggcacttagagaagagtgagcctgcctagggatgatggggccaacactgtagaaaaagcttccagtattaatc

SEQ ID NO: 448 - DNA, 1000 bp, mus musculus
tgttgactgggcctagtggtacctaccatacccactcctcaggaaatagaaggaggaagattcacgtctccaacaaagtctggaggcatggcgccagtggtagagcacttgcctggcatgcacaaggccctgggctcagtacttctgggtctgagtcatttggaggtcaatgaattctgtgatagcaaacaggctgatatagtttgcacactgaaaacagtcatggctcgggccacaccttctctagctggagtttggtgcagctgcaccagcagcctgggttctcaaagacacctatggaatgtacagaggagctagggctggcccaaggcagcttgcccaaggtaccagaggagagtccagtagttgtcaaagtgagtctccttaccctacccccccagcgcttacattcattcatgggaaaacatacagcagaaggatgctcacaataactcagtattcgtgttaatactgcttttaacagaatttaaaagtactttcagaaatgtgaaacacctgccgagcaccctggagggaggttgatctccctaaattgtgtttagctgagctaccattagcagctatgtttataagttccaggcagaggaaatataacccctggtcccctgtgatatcttctggggtcattttctttgtaatcctttaaggcagagttgggctgctcacatcacaaccacccacctggatgaactaactggtcaccagatgttttgatcctgtcttgggggaatgctgagtgtctctagtctggagacactgaagtacccctcctgggagcgtttaaagttcagaacgaaggcttagaaatgagaatggctgaactccaaagataatgaaacaagcaacctaaactcttaaaggcccctgaaaactgtcggtccagattttaaaacaattcccttcatcttctgaggagtagagtcctaatgaactgcttagtgctggtgttccacagcccagatagagttgggagacctcc

SEQ ID NO: 449 - DNA, 1200 bp, mus musculus
tgagtaattacagagaatcaatcataaggacatacttataaacctgtactttaccagattggaacatctaaatgaaattgctaattctatcaataggaaacactatttaagtaaactaatagtatttataaatgaatagttgtacataaataggtaatttactcagtaggtaacagatcagataaatgatgtaaatagactcacaaaccctagtaaaacagaagcagtcattaaaagtctctcaatgaagaaaagccacgagccagatgattttagtgcaaaactctaccagactttcaaagaagaattaatccaaacactactcaaattgttccataaaatagaaacagaaggaacagggcccaattcattttatgaggccacagttaccctgataactaaaccacacaaagacccaacaaacaaagacaactacagaccagtttccctcaggaacatatattcaaaactactaaataaaatacttgtagacagagtccaagaacacatcaaaaagatcattcaccatggtcaaacaggcttcatcccagcaatgcagggttcaacatatgaaaattagtcatgtaatccactgtggtggtttgattttgcttggcccagggagtgtcaccattaggaggtgtggttgttggactaggtgtggccatgttggagaaagtatgtcactatggggatgaactttgagaccctcctcctagcaacctagaagtagtctcctgatgctatgtagaactctcaggtcctccagtgccatgcctgcctggatgctgccatacttcccgacatgatcataatggactgaacctctgaacttgtaatccaggcccatttacatgtcctttataaacgttgccttggtcatgatgtctcttcacagcaataaaactcaaactaagacatccacatataaataaactgaaagaaaaaggcacatgatcatctcattaagtttggaaaaagcctttgacaaaatccaacagcccttcatgataaaagtcttggggagattagtgatataaaagacatacctaaccacagtaaagataatttatagcaagcctttatttaacatcaagttaaatggagagaaactcaacacaattctactaaaatcaggaataagacaaggctgtccgtgctctcaataaaaatattgatatatcaatacagtacttgaag

SEQ ID NO: 450 - DNA, 1000 bp, mus musculus
gaaagaatttattttggattatggttccagaggactaaggaccatcatgggggaaggcatggcagcaaacagtagatatggcagtcacagcaggaatctgaggacctaaagatcactcccagtgatgtacttccgctggcaatgccacccacccaaagcttcccaaacagggctaaccaagagttcaaatactgaagcctagggaataacagttctcattcagaccaccccaggctgaaactcatatagaagtttgtgctactctgaggaaaaggaccatgtgcagaatttaccacacagtgcctccaaacctagcctcacgtcccaaaccctcctctctagtaggcatgtggtagttgaagattagaaagtggaattttgagaactgaccctcacggtgcatctgtggattggcgcatgacatctgttctctcttctcaggaagcgtagaatctgcttctgaccctcttgtttacagagctctgactactatggttcacccctggcgataagatatcctggaactaagtttggaagccacagtgcagattaactccttcttttcccctcatcgtggtaacagcagggaagctctggctaacatggagttttccacagaattctgttctctggccagtgtcatctctgggcaacccaagctcaggacacgaaggcttacaactgcctatggtgaggcagtggcagggctctgtgatctttgataccattactatgaaataagcatgaacctctggggtaggcaagggctgtcagactggactattatcctctggcctgtctaagaatcggtccagcatctgttgcctaagtgagcatgtcaactgcaaacctacagggacagaggctctgatatcctctctccagctttagctgggggtttagaaaggtctcagaatcccagttgttgggttctagaagcttctagaaggccttgcactgatagctattacggtcacggctgtgatttactgtggaaaca

SEQ ID NO: 451 - DNA, 1000 bp, mus musculus
tttcctttgaacttccaaactcctagcgccaggcgttagaaagaggtcaaaatgctctgaacttggagattgtccagactgtttcaaggaagaagtctgctggcctccccgttcagtcagcctctgggtggcaggcaggccaggttagccttagggaaaacataccaacctttgatgttctggaaccattcgtcatggttaaagttgggccatggggtctagagaagccggggacatagtttgactttcagtgggatggactaagctttgtcctcagcagcctttcaaggggcagccttactcggagacagagtttgtgaacaactcttctggtgtgtgcacagacttggttttgtttgtttgtttgtttatttgtttgtttgtacagctgaattgatgcacatgagaggaggtccccagtaaagcccaccatctgcccatcctcagcatgccaagcgctagggcaccagaacactctcggaatctatctttcacttacttgagaacctcccttgagataagggcccccatttccagccctctggcagccctctcctcttccttccctagctctgacttacctcacacagtgtatatgccccacgcataagaccgtaagactggtctttgctgttgaggctttagccagctcacattctctgtcttactgggcaggtcctgttttaaggagtctagtttacacacttgggggtgatgtttttgaaggtgggcgacatggaccttggaggtggttggacagagattctcccgtgcagttggctgtgctcccattcttagggtgagaatcaaaccaggggcgtggagaagggtcagggagagcatgtggaaggaaagccactgaggttctcgcagcggtcacacttggacgtgatgttagagaggaaatttcaccccaccccattccatgactgagtgtgtacttattgttgaatgttttagaaaatatctggtgaaaacaaaattaagaaaataaatctgc

SEQ ID NO: 452 - DNA, 1400 bp, mus musculus
  misc_feature (1211)..(1400): n is a, c, g, or t
aggggtgacagcagtgttctctgaggctcacttcaagaagaggacagggcaggatcaaggggcgagaaggcacttgaggggtccctgactagcaggggtctggctcaggtgagtccacgcccaccgtcaccagtctccacgcccataagagcttcctgtctctgtgggtgtcacacccagagctcgtccccgctctgttgtgagctagcctctcccttctggttggaagtccctctattgcccagtgtcctgctgatgagcccagtcaggcacctactccagtgcccggacagcagtgggaagagcattgagcttgacaggagctggagcctcgcctttttaacctactaaacaggtcaggtgaacttcagcccccacaaaaaaaaaaatttgccccccacagttgacaagtgttaaggacctttgatgctgttgcctttaaacggtaggcattctgatggtatggcaagaatgtcagaaacaagactgtgggtccctcaacagaaacctgcgctttcacagtccccagcctctcacctgaagtcagcacactcacccagtagggcacccacctcagggtggagactgttgaatgggctcattcaacagaggcctctgggggcctctgcggccattctcttcatcgcccccaggtggcgctgcaagaccacagccctgagccacgtcttcagtcccaggctcaggtgtccttctgcaagctctcttgggactcctggagaccaacccttgaattctagacttgtctgccttcctagcaccccacaagattctggggcctttcaaattcatcagctcaaaggcatctagcgtgtctctgccatctgacatcagaagtggcacagggctttgagcctggctgttagaattcacacttagccaacacccagctggcccaagcccagaggcctgcttcttttctccccagcccagctcagacacagacgcctgggcctcaaagagaaaaatccctatgtgctcaagtcactcaaacaaacaacaaactaaaacaaacaaaaacacagacactggcatttcacagatggaaccatctggctggaatcacagctcacaacctccaccaacgttccttctgttagtcctgttagatgagtgaagggtgcacatacagacacactcacacacacacacacacagagatgtacacatatacagagatgcacagatacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 453 - DNA, 1000 bp, mus musculus
ggaaaatgtgcccttattaatattcttagccccactcttcccacctgtcctaactagttgctcagataaatcgagtccctgttaaacatccctgaccacttgtctgtaggagtggcctatgtggccactccattttgggatctcacatgtctcatcaacttttcttcatctgatgcatggtgaactctcttctcctcccttgtgtctctcttttcctccagggtcctggaagtcctgtctgtaccttctgaccagcagttggcccatgactttctttactgacagacaagaaccaattgtggaacaggacattaatatcagaaccacccctacaaaggatgaacattgttcggctcttatccctcagcatatggaatggaaattatctttctgctgcaggtttcgggtagcccaaggtgaccatgggtactgtagcccatgacattgtagcattcacccaagctggggcacttcctcactctgaagggcagggctgggtttatttcttattcagcttcaaaggtcatattaagattattgcccagagctcagtattattgccacctcgcccaactctactaactcctacctgcacaaaatatctttggtacttctcctggctcctgcttcctagcctcctctgggttttgttcttctgcaaaagctttgcatgggcacagtgatgagcaccagctacaggcacctctactgactggtcatttggaggcagttatgtggtcggccttgtttctcagaggtcttcattggttttccccagtcttaacttgtcatggtgacctacccttttggtaactgagagcctgagaagatgtgactggtggtgaatcatccaagccaagaatcatggcgaatgaacacagacttctcaacacatggtacctttggtgagccctgtccccacagagccccgtgaggctttcagagattccaaagacacagtaaaatgagataacgtcaagacagtaatgttttaaagatg

SEQ ID NO: 454 - DNA, 1000 bp, mus musculus
aagcagactccctgagtctggccccctgggacctacagggcagagagaaccagtttccatggactgccctctgactcctccacacacaaacatggtaacatgtgtgcaacacacacacacacactaaataaatgtaaataaaatgaaaacaaaactcagtttaataatgaatgtataaaaaccagttagaacagggcggtaagaaaatgcaatttaaaactggacaatgggttctggtgggcatttccctgaggacacgccacagctaggattgtgcaaaagatggccaacattaaccaccagggaaatgaaaagcagatccacagtgtttcaagtcccccacgcccgcatgactctaacaccaccctccgaagcatccttctcgcttgtccttgctcctgactaactcctgtttgttcttcagagttgatctcctgtgactttccatcctggagacctcttgtgatttcatccccacttttcctttcatgtctctgggagttttctgtccccagggttctgaacatctgtgttgtcctctgtcatggcctctagcatgttatactgcactaacacaaacacccactcctggataagagtcgtcatgtctggccagactgactgattccgtgtctccagtacccagcgcgtggaatgacaagttgaagacgaccagtcaatgatttgtccgtggtttgtaaaggcaccagcctgaccaaaatcgcagacaatgacaatgacactgacacaaacagcaagtgaagaagggattccaggaaccttacaaagaccaaggcatcagaacgactccccgaaaggaggaggtctggcagagagaaggcaatggcgggctcagggcagagcacagaatgtggaggccctggattccatcctgcaaagataaacaactgggcatatttccaccttcaagacaagtaaaggctgcccaggatggatggccacactgtttgaccacatttctccaacagtgtcttctgca

SEQ ID NO: 455 - DNA, 1000 bp, mus musculus
ccactgcggtaagatgactgtgcacagtcagtttacaaccaaatgaaggagcactaagtaattctgcctctggggtgcttagtgaatgcttagtccctgtgctggatgctctggacataaaggcggcaaattcatgcaccgcgcaattagcttgaacagctggcagcctttgcgagctgaagcacttgtctcccgtgatccagccttctaggctggagaaccacagagaatattctgaattaaaaaaaaaaaaaacaaaacgaaaattccaaacacatgagaagttgctcagtctcagcagacttttaggaaatgcaaattaaaactcaattaaacaagataccaccacattccaattaataggattttaggacaaaaaaatatgacttgctcctccgttggtggcttttgtcttttactgaatttgaagaggctgcctttccattttgaagagcaatcgtgtaagattccaggcaaccaggaaaaaaaccatgatttggggctaccaagcccagaagtaaccagctcatgtcacatgcaggggccgcgcacattaaagaagtattctactcagccttaactgtcaacttgacacagagaaggaagttctcagctgacggaaggattacctgcatcgtattgacttgggggtctatctctgggggattgcctttattgttagtgcatagaggagaggccagatcaccatgagttgcagcactccagggacctatggtcctgggatgtaaaagaaagctaagcctgggccttcaagagagctggcgagccatgttcctccttgcactgggcttcaagtttctgtttgagtctctgccctgacctccttcagtgatggactgtgacttggaaggaagacaaagagaccttttcttccctaaattgcttttggtcagagtgttttatgacaacagtcatggcgggtagtaaatcaggcttccttagagacccactgacaagacgctacttgccttaccaaaaa

SEQ ID NO: 456 - DNA, 1000 bp, mus musculus
agccacagagttttggcctagtttccagggagattccttcccaggccactgtgaccctcctgtgtggataccggcctgagctatgcacatagtaccctctctagtgaacttaggaaatctctggaaatccttggcgggagcccctggaaggctcagagcagctggctgccaaccagatttcctttacagggagtcccttccaactagcagcccattgtgcaagcagaaccctggccagctgccgaccagggactctgtgtaagttgggggtggctgggagctgggactgacagccagactcccacccttcagcacatctttaactacaccctacactccaggcaggcctctgtgaggccctgaataatccacagtgccaggtcctagagaagagctgagaggagtacacaggctgtctgtctttccttgcaggctaagggaaggatggacagaagccacatcgaccggggacatgtttgctttctgtgattgactttgaagccaatcattcctttttggcttccttccttccttctttcttcctttttctttcttttgggggatggaggaggcagaagggggtctcaactatgtagctctggaacgttctacataggtcaggctggcctcaaactcaaagagatccatttgcctctgagtgtcaggattaaagcccccaccacatccagctgattcatgacgaacatgtatttggagatttgagttgaataagatttctggacaaataggacataatccacagtcctgagctgagagagagagagagagagagagagagagagagagagagagagagagcctgcctgcctaggatgccttttccttgtctctcatctccccccaacccaaccctgggttcccctccaccaactccagataagcagcaggcccgagtcagattccatttcaccaccacacactctctatggtcatcttttaatatttgaaaggatcatttgttaactggaaatggtcaatt

SEQ ID NO: 457 - DNA, 1000 bp, mus musculus
cggcccctccataaacccacatatgcccctaagcagcaaaacacatccgaagagacacttcccattcgtctccagtgttgactttatgaagatttcaaaagcgtagatcacaaatttcagacagataaatctgaagcagagaatgaacaggggacaagagatgaaagtaggagattaaagaataaggtgctcggaggagaaaatgctgtatcgtataagcaggctcgtttttatgggcacagatattagctgtatttggagggttggcttgctacacggagaccggggaaaggagggcagctcctatttaatgcatcccaaggagatagagttatatagtcagtaattcatcctggcagaagggctctgacctttggctcttccttaaaggaattaaaacagttaatgactttcgtgcctattaagactacgggcgtttgtgggtctttgctttctgcattggaccatatttcaatgccttccagtgggcttttattttgaagctgtcgtgtgctgtttagtctgctccccaagatcccacttaagaatcagagagcaaacccaagagacatccttacctctattccccgtttgctataaaaatgtccacagcaggaccaagtcttcttttccaaaagccaggcagagaaagggatgctttctgttgtgaacagtgagttctttctgctgtgaatttccctaaacactgctcaaagcgcacagggtgtaccatggtggagtacgtgtgtttgatggtaggatactgcaattatttttcaaaatatgaaatagcttagagtttatagaagtgggtggttgtgctggtgagcatggagtgctctgttctgaccccacagataacaagattgtctcgcatttgttggtggctgaaccagagaagatctatgccatgcctgaccctactgtccccgacagtgacatcaaagccctcaccacactctgtgacttggctgaccgagagttggtggttatcattgga

SEQ ID NO: 458 - DNA, 1200 bp, mus musculus
caccaatgcacttcagcagagaagccaagaagaaaagaaagtgctgacctggaatgccgctctctctagtgaggttggaagaacagtccatgtgtacgtgcgtaacctctccccacacacaatgatcccagctgtgctatcacacacggtgccaatgatgggaagactgtcctttctgcaggagagagagactggggaagcagaagtcacagacaaggtgagctgtgcctagctcctgagtcacaggtgtgaaatgtacatgcgtgtgagcgcgcacacagaagctaacgtagagaggctatgtgtgctaaatttctgtactttcaagacataggataacaggacagaaagaagaacccttatgcacattgcaggggctgtgggggttgttggagtttgcaccaactccagggctgcaatggtgcagaaatgatctgttctaccctgtggtgaagaacggctgcctgactcagcctccacaagttcctccaagcccagcatgctccatacctcttcacaatccttcactgggtggcaatggctctatgaggggctcccagagccctgagctagcataatagctgctgcccactctggctgatcattagccactgccgataacagaccaactgccagacactttgaatatcagcttcatgctcatgaatcagcaactaaaggagccacttttaggtttggattttgtaaggactataaaggagttggtgcagaatcaccacgttaccagaattggcaatgtttcctgtctgttcatctccttccaaaagctttgcacacaatgtacacataacatgcatcccattgctctctctccttcatagctaaagaagtcaccactttacaaagtcaagtcttgctcccaaatctgagagagcacgtgttacagggcagtggatcctggtaacaatgagcctatttccctgctcagaagtggtgcaatagtcttatcaggtttctccatgtgtctccatcttgctcttggccagagtggtccagtcagtattaagatataagaaagattcttgcttcttactaaatgggcagtggttgagtagggaatggtgctgtgcagaccaggggctgggtcttcccacatcaattagtaattaagataatttcccacagatatggcacaggcacttctgtcaatcatagcatctctgtcagtcatggtagcct

SEQ ID NO: 459 - DNA, 1000 bp, mus musculus
ttagcaatgtgacctctgtaggttatttaaacttcttgtaataggaagtaaataggacctctttcagatggctaagcagactagtaaatgacataacacatttacatgctcattgagggtcttacacagaaagtgatcaagaaacaataggtggaaaagagagggggagggatgggggaggggaagagggcgaggaagaggttgagagccagcatcataatacttagtctctaccctccgtccttctggtcttccgcatgaagggacttaacagcttttccttggggcattttcaaactctctgcatgctgctctcctgggtggatgggtgatcggccaggaatccgaggagggcaaggcgcccaggagcctgtgaacagcactgaccttagtttccaacttgggagttctttatcatccggaaccagcaaggaactgaagccactcactcacagctgatgtgcgtgaaagctgctttagctgccacagtgagctgcagccctgtgctcgtcttcctgagccccgtggtagatactcccaccaataccagctcttgccctgagacggtgcttgagctgggctcacattgagtctcactgggagcagctgacattgctaccttcccctctcccccagctggtggaggatgagcagatgaagtctcctgacaacctgtaacagggaggctgcagagactaagtgcttgcccaacgagctaccaaccagctcactggcaaagggttcagccagctgagcagtgcatgggattagtccagcaaccattttcatctgtgtttcagtttaggcgaccaagagctcgctcatcacctcctacgcactaacccaagttaccccacgcccttgcatgacatcttgtagtcttcgaaggacttttgcataccaatctctacttgattttcataaccaacctctctgaaaataagtttaagaaaataaactcggggcttgggagatggtttgatccataaagtgtttccaa

SEQ ID NO: 460 - DNA, 1000 bp, mus musculus
atgtttaagcccccctaaaattcttgacctgctccgtttccaacctcggccggttcacccctccttaggcaacctggtggtcccctgctcccgggaggtcactatattgatgcagatcttagtgcggacacccaatcggcatagcgcactacagcccagaactcctggactcaagcgatcctccagtctcggcctcctgagtagctgggactacaggcgtgcgccaccgcgacggcccccctaaaattcttatgttcggaccttgcctctaatgtggaagtgacattttggtcggtgctaaggccctgaggaccgaatcctgcagctcccttgtgccctctctcacgtgagactgttgtctgtgaaccaggcaggggtgggctctgaccagaaacagagtacttcggcacttccacctaggcttctccacctccagcgctgcaggcgatgctctcctgtggcacctgtcgtgtcatctttgcaatctctttacacccaacacagaccaagacacttcgggacagaagatggtggacatctgggactcgggcgatcagcatcagccccacagagatggatgatcaggagcaaagcaaaggaagccagagaaccgggcgtgcctgacatgcgcagttggtgggctctccagctgtggcagcatagaggacaggaagtgaggctcaaggtctaccccactgacccgcatcctccagctcctagagtccccagccttgtgaaacaacaccgctagctggtgctgacttgcatgagcctgtaggagatgtcttctatcccaaccacggacacctgatagctggccacccggaaggacggtgcaaaggcagcctcctccagcgagatttccacggatgcctttggttttctcagtgtttgtgagatgtgttcagatcctaaatcactcactccagtgttcataactcatttacatcttatgttaatttttttgctaattgccttcagtcttttctttttctttcct

SEQ ID NO: 461 - DNA, 1400 bp, mus musculus
tccagtatcaagtgtgtttcttccagggcacctgggaccttgaccaaacatcagcgcagtcctcattccctcatcccgcaaggctggccacagcagctgttcctcccaaatacttgccatcattcagaaaagaatgttaagattcatgtgtctgacgagcatgggaaagtctgcacacccattagttagcagtgtgcaaagggatcctgaacttgaggttgaagtgaaaacgtgtaagacaaaggctggggagatggcctagtctgtaaagatacccagaacccaggtttacaatcccaggctgggatggatggatggaggaagggatggagatagatagatagatagatagatagatagatagatagggagatagatagggagatagatagggagatagacagatagacagatagatagagagatagataagaagatggatggtgcctgtgtagccccatctaaagttatccctggcttcatcagacagaaggacaggtgactagaagtcagccagacctaccagcttcccaatccttgtttcccaggacagtgggaagctctgggagatgctgactgtgactgaatcactcttcccaggggaaaagcaggacaccagagtgctgacagagcaaaactgtaagtttagatggaggtctgtgccaagagtccagtttccctgagttgaacacaacagggagaagctcctacacttgtgacccacattcttgttctctgaaatgtcacataggtaagaacaaagtaaaatcaagagccctgacccagcgagttcctagatctattctctacaagccccgatgttctagataattccgggaacatgatgctcagatgtgtgacaatgtgcaaagaacaaggtggcccatacaccccagacccatgcatccctggtcccacattctgtgcacccatgtaccctgatcccacataccccagacccacataccccagacctacataccctagacccatataccccggacccacataccttgtgcctacatactctagtcccatataccccacccctcacatacccaagacccacaaactatggtccacacaccccaggcctacatagcccagacccactcaccctgggcctatataccctgcacactcagcaggcggccaaagcggctgagtgtgcctgctgaaggataggcctggccttgtgtcctccacaagccagcagctccctagccactggtttccagaaagagtctctgcctatatctgtggctacaagactggagccctgacctttctattactccccagcctgtcctcctgctgcactccctaatgtgtgttttcctctttgatgaggagcaagaagaagatctgagagaggcttcagaaagactcaagttgccgtc

SEQ ID NO: 462 - DNA, 1400 bp, mus musculus; identical to SEQ ID NO: 461

SEQ ID NO: 463 - DNA, 1400 bp, mus musculus
agccacgccttacttttaaaagtgtgtaagtgtgagtaactgcatgtgtatatgtgtaacacatacatgctagtgtctacagaggccagaagaggctgtccaatctcttggaactggagttagaggtagttgtgagccacctaatacgggtgcttgggacctaaaggcaggtcctctgtaagagcagtaaatgctcttaactgctgagccagctgcctagtctgacactttgttttaaaaaataattattgattgatgattgactgatgattgattgattgatgattggcaggggcatgcatttatgccgtggaatgcatgagaagtcagaggacagcttgcagctgtctactctctccttttaccctgtaggttccaggattgaacctaacaggtatctcaccagggcgctgcgatctgaacttgggcgctcatgcttgtgcagcaaacactctcacagtcgagctgtctccccaggcctcactccctggcaatctgaattttgagtaagtgaatcatttgcacgtcatttcttcccgaggcatttctatctctcattcagtgtgttcccatccacacaggagtaaagagagcaaacaagagtccatttgcttagacaccagctcccccctagagttcccaaaggtaaactttggccttgtcactaaactgtcacgtttctgcatggtctagactaatgacatctccctcagtcatgaaaccaagtccagagacataccttccaaggccacacacgaacatgctctagggtaggcatgctttcctaagcatggctgggcagtcattctcctcaacctgcaaggatacctggtattggcctgcttctggtcacttgctgctgccggacctggaaagggctcaggcagcttgacagggaagagaacagccagttttgaaggctgctaagtataaggctttgtggtttcctcatggttcatcagggcaagcatgaggttggagcaagggggtttcctgccagtatttgggttcagtttgggtatgagagaacgaacacaaacggccctagcaaccagcctgaacttcactgccctgtttgcctggggaggtgcttggcctcctttaagctctctgggggagactttcctttagggtctgggagggtcctgctttgtgcctatgttgagtctggagctgttgggagtggggaactagctgattttctcttggtggctgtgataaaacgttctaaaaataacttagggaggaaagggttaatttagtttacactttcaagccagagtgtgtcactgagggaagtcagaaaactccaaccaggagcttgaagcaaaatgtatggaggaactgctctctggcttgctcccagggtcacgcactgctagcttcttacatagccaggt

SEQ ID NO: 464 - DNA, 1000 bp, mus musculus
ccctacttcctcctccttggaatgtcatctccaggcccttgctggagctgcttcctcgttctaaatgtcatcttgctgttttcatggatgtgagctctccctctctgctcaaaacatcacaggattccagctctcctcagtcacctttgcccttctgaattcttgacattctccttggccacattgccctgtgtcgtaattccagggttgtaaattagagtgtcacacaccagcacagaaactgcaaatctgtgcacagagctctgtggcacagctacagggggcagcttcccggctggcccctgtgcctctgtgtgaatgcagctgtgccccagtgcttagcacttgggtcttccagcccccaccttcttggtgaattcaccacatctagctttctgtcagcaggagctacaggggctgctgtagcccgagcccctccagagctcactcaccctccaccacctactggctcctacatcatagggatgtctgagaccatcttcctaggttgtaggttgaaggccaaatccttagtctttcctcctacagtcaaagacagctgcgctgtcattgcttaggtcgcacacctagagacacagctgacttctgtttctctcatgccggcatcccttcaacctgcaacggatttggacacttgcccctcttgccattctgctgtgattcacagccagccgttgcctgctttgtcctgttgtccttaatgtctccttgcctccttgtgtactcctgcttcctctgtaattcaaggagttaactcagcagccccactcttctgggaagtcagcggcggccgctcctcagcccatagccttcttctgatgggatcatgccctaattctgagtaggaattggtgccctcacaatggcctgtgtagctcctaacatagtggtgtctgctcactgcaaccagctgcagtggcctaaaggactccaggtgtaccccactttcaggcttgggcaatggcttcctctctgcttg

SEQ ID NO: 465 - DNA, 1200 bp, mus musculus
gtgataactccagctgtgtcaagttgacacaaaactagccagtacacagggtttctctgtgtagccctggctgtcctggaactcactctggagaccaggctggcctcagaactcagagatccgcctgcctctgcctcccgagtgctgggactacaggcgtgctataaccaggcccacttttaacatgctgtggtcttctgcacagaagcatgagcacagggaggggccttgattctccaagtccatccactaagcttcggcaactaccaagagcaggactcagagatgtgtgcagcgcacacagatgcccagctgacgagtccacagagtttggacttaagtctgtaggcagtgaaaagccaacagaggctcctaaatagggtgacccagagagcagttggctaccaagccacatacgctaattaataggcttattaagaagttttgtgggccaaggagcttgttcagtggtaaggcatttgcctagtgtgtgtgtgtgtgtgtgtgtgtgtgtgtgtgtcgggggttggggatgtctacattcaaatccagagtaataaaagaagtctgattaatccagagacttaaacaaaacaaacaaaactaaaaacaactgggctcagtggtacacacctttaatctcagcccttggcagtcctgtgagtttgaggccatcctggtctacctagaaatttccagcctagacagggctacatagtgacactctgtcttgagaaccaagaataaaccccacagaatgggaacggaacgttttgacaaaggcttatccggcttacagtgtcgtgagtgaggtctgctggatccagtgacatcttggccacacctctgctggagtccttcccggccaaggcattgtagggggctcctcgtccataaaactctgcagcagggcggaaggaagagtgtgggtatgcatggatggaagccaggggttggggggttctccagactccccagttcttggaaaggctatagttctgaagatgaacttcacagggcagatgggaggcccaggcaaacttatggtgttgcacctacccagaacacacctgtcagctgagagactgcagaaaacactcaatgaagtctctttaaaaactaaaatgtagggggctggagagatggctcagtggttaagagcactgactgcttttccaaaggtcctgaattcaattctca

SEQ ID NO: 466 - DNA, 1400 bp, mus musculus
acgtgctgtgtggtacatgcacactaaactcagtgaacctgtgagtaaagaaggacgggaactaagctctgcctgtaattctttacatgtttttctagctggatgctgactgattactgttctatcgtctacatagtttgtgtgtaagaaataatatactgagatgtgtgtgcagttttagattttggagagaaaaaagtcaggtcctctgtttttgaaatggtaagcttgagctggcatctgggctctgacatagagggaaccaaacagggaggactcctttgctgcctacatctaatccagtcagaagacaggctgccaacctcagacaccagcagaggaatccccacgagaaagagtgggatacaagaagacagtctccagagcttccctggtggaggtttcctccacaccacagagaaagtgacaaaggggcaggggccatccaggcagagcccgagagacagatgggtcgctaaaacgaagacaagggaagtgtggttctttaggtttctaaggagaagaaagagcacagagcacagaggaggaagggagagcctgtttgtgacggcagggaaggaaatcagagaagactggggctgaattatccaggaaaaacagttgtattgactttacctgagcagtgccgaaagcaactgctgcggcggagacttccagacgcagatgctttcagggcggtacttcctgcccagcagtcaaggaggagaaaactggggagatacatggaagagtgagttgttttccctgggcaacacacagcgagagaaataagggtccatccccacagcatcctcggctctcaggcacacatactgtgtcactgagaagaagaagatgaagacgtcgaatttggaaggcacagtggtgtcacagcctaagaacgactcgggtcagatccagtcacctgttctcaataagccaactaaaagagccaaattcaaagcaagaagcagaaaaaggagatttattcaatgtgggcacattgacaagaaagatccagaaaccccaccccaccccatcttcagggtcctaaggtaagaccaaaggttagagcagaggatacacacatctgagcaatcctggtgagggtatgtgcctgcccaccgctggcctacccttgtctggactgacaagttagaactgggtgaaatctcttccgggacacaggttcccgctctggctgctacctgctccttttccaagcatgagattcttgaggaaatcctcattgctttggggttggttgttttaacagtttgggagtcagcctgggatacagtgtctctttaagagttctccactccagccaggcctgttctagaggctggcatttgtgaggcagagaaggtactagagaaggggggtgggggtgggatgga

SEQ ID NO: 467 - DNA, 1000 bp, mus musculus
ggtgtacatctagagagtatgcatacaaagtgacattcaacactgtaattactgggcaacttgaaatccatacactgtcactctaatttcagaatggccattatcccaaccactgataacatcaaatgcatggaaatgtggagtgaaagcaactccttgctggagggcttacaaggaaaacatccacactcaaagacagtctggtggggctggagagatggctcagtggttaagagcactgactactcttctagaggtcctgagttcaattcccagcaaccacatggtggctcaaagacagtctggtcatttcttatgacattaccgtaaaatccagtaaataaacttggtattaatgaaagtaatttaaagtttataccgtcactaaaagctgcaatagacattaataatattctttttaaaaatatttatttgttttatttatatgagtacactgtagctgtcttcagacacataccagaaaagtgaatcagattccattacagatggttgtgagccaccatgtggttgctgggaattgaactcagaacctctggaagagcaatcagtgctcttaaaagcatgctgttcagtccatgaacaaacaggacacaagatgtccactgccaaacttttctatgacaaggtaggccaggccttcgtgttcctgcttcactaagagtctgtcagattataggctaaagatgcttgctccaacactgcaaaggaaccttgggtgactgtctgtcacttctataggtttagaagctgcttgctctgcacttcttgtctactcaggtaatagttatccttctctgctctctgataagcctaaagactagatagttttagtcttacataaaagcttaagttgtttagtatttaagaaaatgatttaaggtctaaaaaatatttttaagttgataaatgcaagttatggtagaaaactgatctgtattaattttgaaggaatccacagattttcatttcctgttgaaac

SEQ ID NO: 468 - DNA, 1400 bp, mus musculus
ctcaacctgggtgaggtatgcagtttcatggtttggccgttccaaaacaaaatgtccgctgtgacactcatgcacacacacatacaaatatgtatttatgcgtgtttgtgtgtcttttcattaaatctgaaacaaaccttaaccggaaaggttcaagtctcctgttctgaaactgtgagagaggtctttgtgtggtgctgttcagacaggatcccttcctgtccatggctttgggctatacccagtgctctgcacaccttggcccggaaacagtctaattccctaagtgcttttctgcttttcctccgcatcaagctgcttctgaactggtaagctccggctcatcctgtaaggcccagctgagaaggtctctgcaaacagcctgccttattctacctcaggcagagccactctctttttctgtgtcaggctgcacatacgtttgcagccttgtctcactggcattatctgctgcgactcttccttgctggactgtgagtctttcaaagcaagggctccatttcgttttgttcctgaagtcctggcatagagttgaaagtcactcagtatctgctgaaggggtgcgtgagatgagctcaatttagctctgtgccggaaaccacctcacatgcccagctgcccggctcaggctccttccctgctagtggaaatgacttggcaagcaggggcctgaccaaagggactcctgaatccaggtccagtgactagcttgaaaagtgggagtggtggtcttctgtgtcactgcaaacttcctggagtgtttcgtaacttcctgtttcacttctttaagcataaaccttcctaccaatgaggtgcattgggcgcatgggagactggcattctgcctcaacactcctgctgccttaggctttggtggcaccaacctgcttatcatctgttggacacatgagctcctagagactctttcaagggatctgcaaggcctctccctttccagcatgtgtctccatgacactgaattctttcaaacactttaactaaaagagtgaatcacaagaggctgaattcagaagcaaatagagtttagctgtctattttttcagctagatattgtaaatgtatattgtatatgccgcttctctctttttatccttttgaaaacaaaattcttcattaaaatacataaattaacgaatgatgcttgactagtgtcatttcaaaattaatgtttctaaatttctgttttaacttttaacaaggtgagttctgatatggtacacatccaaagttctttggaatttttaattaaacttagtataaagaaccctggactggagagatggctcagtggttaaaagcactgactgcttttccagaggtcccgagttcaattcccagcaaccacatggtggcccata

SEQ ID NO: 469 - DNA, 1000 bp, mus musculus
gatttgcccaatagggtgggctgatgcccaggaatcattaggctatgtaatagtgacaggaaaggaatattacagcaagatgcaatgctgggacgaagtctgtaagtatcctgcatcctaagagctcacccattgcaggccatgcaaaatggtgggccatctccaggaaactcacttgcatgttgtggtggtttgaatatgcttggcacagggagtagcattattaggaggggtggcttcattggagtaggattggaaggaatatatcactgtggcagtggacaatgagaccctcctcctagacatgaggagggcagtcttctcctagaagccttcagatggattttaaactctcagctcttcctccactatgcctgcctgggcactgccatactcctgccttgataataatgggctgaacctctgaacctgtaagccagccctaattaaatgttgttttttataagagttgtcttggtcatagtgtctgttcacagcagtaaaaccctaattaagaaacatgcctttaatctttcctagatggcttctgacagttactaactagtccaagaagcacctgtgtggtgcacatctgcctatccagattcggggcactcctagttcagataactgtgcttgaaagttgggctataaagagagagaaagtaggagatgtaatcttcaatggttccaaagctaagatgttagcttcctatctcagtctatagctgctactgacatacacagaactaaagcaaacccagctgataatggactcatgaatctggggaggatgtgagagaggacaagactgagaataaaccaccatcactataccaggaaattgggctgttctggtgttcatccctgtagccaaagttgcagtagcctctgtgtagccttggaaatgaagccccatttgcaactcaaaagaagagctcactatgaagagaaatgacctctctactctgttattactgccttgcagttagataaactg

SEQ ID NO: 470 - DNA, 1000 bp, mus musculus
tgtgctgatgttctctatggaatgttctgcacctgagattctctcttccatctcttgtattctgttgctgatgctagcatctatggttccagatttctttcctagggtttctatctccagcgttgcctcactttgggttttctttattgtgtctacttccatttttaggtcttggatggttttattcaattccatcatctgtttggtcgtgttttcctgcaattctttaagggatttttgtgcttcctttttaaggtcttctacctgtttagcagtgttctcctgtatttctttgagtgagttattaaagtccttcttgatgtcctctaccatcatcatgagatatgcttttaaatccgggtctagcttttcgggtgtgttgaggtgccctggactgggcgaggtgggagtgctgggttctgatgatggtgagtggtcttggtttctgttagtaagattcttaagtttaccttttcgccatctggtaatctctggagttagttgatttagttgtctctggttagagattgttcctctcgtgattctgttagcctctatcagcagacttgggagactagctctctcctctgagtttcagtggtcagagcactctctacaggcaagctctcctcttacagggaaggtgcacagatatctggcgttcagacctcctccaggccaaagatgaaggcccaaaacaggacctgtccagaagctgtgttgcttctgcctgtcacagaagctgttagcttctgtagtccagactctcacctgtgcagactactctcggcagagtccttgaaccaaaatgtctgctgctgatgctcaggcaaagacctcccgggccgggcggacacctatcctctggccgggaaggtgcccggatgtctggtaaagccccatttcttttgaagtatatgtattttgaattttttctcttttaatctccctttgttttagtctttatataggtagaacacagataaaagataatagagtg

SEQ ID NO: 471 - DNA, 1000 bp, mus musculus
ctcttgttctcatcctgccaagtgtatttccacacacaagctccagccacaaaggtttgtccagatgctttcttataataagttactcagaggccaaagcctagtccaaaaggagacagtaggtccacaaaatacctcacaggtggccccatctgtctggctgatgcttaccatcctgcctctgggaagacctattacacaagcatcctttgctaagatgcttgcccaccccctctttgagggagatgaagttgcccttaccatgtctgaagttctgaggttgcttgagctacctcgcagcatccacagaaacactgagatcagctgagttacagaggaacttgcaggctgggtaccctgaaaattcactacctcttctaactggcatccccatgtggatgttttgatttgctagtgagtcttgagtgacatgagcagcacccttagggttagagtgtgctgaagggacacagcagagaggtctcagcctgggccaatccttttccagatctgcagatttgcagttcagtagcaccactgtgactcttccaatagcctacttgtctgttttcacaacaagcccttgggaggggctaagattcctgatccctgctgcttacctgcctgcctctcccactttctggacagtgcccctgggttcactgctttgaaagtttggagcttgcctgagctccactttcagcactcacgaggcatttccccttctcccttctggaatcaagctggatagcttgcattccccatcaatcagctgacactggagttaccaaactgcccagaggtggtcagtgccagaatattagcaactgaagagagatttttaggacacaagattttgttttgtggcttcaggctggtaaactgcaagtactttccacccaatggttatgagaaaaggctcagagcaattaggacacatgtctgacactgtggagcactcttgttaatcagcacactgtcctcagtggtttgtcaaaac

SEQ ID NO: 472 - DNA, 1200 bp, mus musculus
gctcaaaccattgcatacaccagcaagattttgctaaaaggaccctgatatagctgtgtcttgtgaggctatgctggggcctggcaaacacagaagtggatgtctgctattggatggaacacagggcccccaatgaaggagctagagaaagtacccaaggagctaaaggggtctgcaaccctataggggtggaacaacaatatgaactaaccagtacccccagagctcgtgtctctagctgcatatgtagcagaagatggactagtcggccatcattgggaagagaggccccttggccttgcaaactttatatgcctctcagtacaggggaacgccagggccaagaagtgggagtgggtaggcgagggtatgggggacttttgggatagcatttgaaatgtagatgaagaaaatacctaattaaaaaaaataaagaaaatagaaaaaaagaaaaaagaaattaggatgttagttgttgtgcccagcgattgagttaccattgattctgaactgagtttgtgttgtgttttccttcatgtggcagctcaactgggttccagagagaaaggtatggtggtaaagtgtgggtttgcaagaagtgtaccccaaaaggctgtgggaattttgaagtgtggggttggcgtggtagtgacccaccagtgggaccttagtgaactggttggagagatttcagagctgagtcagagagtctccacaagatgagaacaggccagccatgccctccagtgcctggccagtcagcctgccagggcccgtcagtgaagcatggtttgcagttttcaatatttcatgctacagatggcgtccaacatgacaggcaagaatccactagaaatgtatgattcttagcttatcagtttgaaatttagttagaaacttggaggtttgtcaagtggagcagagtcaagtcccatgtgcaggaacattgaaacaaagaaagagggctctgagtgcaggctgctctgatcactgagagccagagaatggaagctgcctgtttccttagcagatgttgattggagtatgatttaattaaaaattgggattatttgcttttaggatagatttataaatagattttgtctgaatcacatggggaattttgcccatggtttgaaactagaatagggaaaatttactggccccaggtagagagcataacagatagataagaggtat

SEQ ID NO: 473 - DNA, 1000 bp, mus musculus
gaatctttacatcttaggaaggaggccccatttgggatctggaagacctcaggcagggagtcctaacttaagccccattcccagcatccccaactgcttatagttatgtgacccgggcaggcattgggcctctggggattctagttttttttatctgtgaaataactctggcttcctgcctcccaaggataccagaaggaagaatgagttgaggtttacagtgcaccctgggagccttccagaaaggccctgcagggttaggaaatacgatacactaaaacaggaagaatgtccctcatttttggtgtttatctctgtttaggctccatgagccatcactctgtacagagaaatatagaaaagaaaggtctcaacttggagcaagtagcataattcacactcaaaattgctgggttttgtttgtttgttttcttgctcactttgaggggaggggtttggaagcagatgacttgcttgctatatggctctggtctgtattcagagaacagcagacagacagacctctgtgctgaaaacagcaggaggctgagctggagtggtcggaagctggaatttatcatcacgatggacaggttctggagggcaggaatggtgttggatggatcattacattttcagtatctgtttaaggatggatgcacagtgctaccgcatttggcctaagatgacatttgcagctatgagactcagccatatggaaatggctcagtcagtaaagagcttgccttacaagcacaagaccctgagttcccatgtcaaagtgagaaagctcgatatggcagcgcatgcttataattccagtactggggaggaagcagagacaggaagatccccagagctggctggcccctctggcttccacatgcatgcacataagcacacatgcatgtgcagccatacacacatgcctataaacatacagaaacacacagagaacagaacagatttcagctgtgttctttcctggctgtgggtttct

SEQ ID NO: 474 - DNA, 1000 bp, mus musculus
ggatttgaactcaggaccttcggaagagcagtcagtgttcttaccactgagccatcttgccagccctggtctctttcagtgaattctactttttgatattccatgtataactgggatcatgtggcatttgtcttctctgactggcttattttaattatcatgtgtcttctaagcacatcatgtcatgagcgactgccctaattagggttactgtcctaagggtgtacacaggctcccttctcccactggaacacctacgtgatacagtgtgtgggaaggaaaatcacaggacaacctcagttgttggtccttgccttccttctttgccctggatctcttactgctgtgcaggcaggatggttggcctgtgagcttctgagtgtgactctatctctgcctcctatcttgatgcacactactgtggatatctgacttgatgtgggttctaggccctcatgcgtctgtggcaagtgatctcctaacaccacctccccaacttgatacacaccgttatttaacaatgccatcagaaagagtgttctgcatgtgtctctcaggtacatttggtctgaaatatggttcatgtccctttgggctgtggctggtagtccatagttgaaatgggggactgactgtattataacctctccttgagccctaaacacttgctttgtctgctcaggattaagatgttgagtgcatgtcttttttcttttcttttttaaaaaaattattgaaaatagtttcttctctcatgctacatcctgatcacagttccttccctccagtcctcccagcttcctgaagctcccctctgtcctaggttcaccccccctcgccccagacaggcaacggctgcacctggaagctggacaggtcacctattggaaggaaagagtccaagagcaggccaacgagtcagaggcttgcctttttttttctcttcatgttggtcagaaaaactttattatttttactgatcactctccttccaaatgct

SEQ ID NO: 475 - DNA, 1800 bp, mus musculus
agagctgctgtctctaacaagtccaggagctacttgactgtctgaaactgccttgctctgaaaaaaaaaaaaatcaaattttattagaaatccctggtatctcactattactaactcccagtggtccattaagtgaatgcaggcatatcgactagagagtcataaattattgattctgtttcactagacccaagtcagtgcccagtgctgtggagtacgctgtcttgtgtaaaaataaatcagtgtctcggaagaggtcctatgctccagtttctggactcctggtgtttgttgcagaaccatgctggtctgcctccttgttccctgccgagtctttcagcatctcctgttctgaactaacctggcttcagtcctcagcctatctgccctcgcagatccatctcctagcttttggtcttgtcttcctctcttaaccggagactgccacaaagcaaacctttgtggtcagccatctgtgaagggtttccttgaattctattcaacttcaatcaaaactgttcagagaacacacacgccacgtctgtactgaagggacagaaacttgcccccttgttactcttggactagttaagtacagtgtaataatgatttacttactagttattgcattgagttttataactcatccacaagtacacagacagatgtgcagagggctatgcgaatgtctcttcaccgtgccagactagagtcaagctcaacagggtcttctttcccccctgattccgccaagcccgttcccttggctgtggtttcgttggatagtaggtagggacagtgggaatctcgttcatccattcatgcgcgtcactaattagatgacgaggcatttggctaccttaagggagtcagtttctcccgccgtttacacgcgcttcattgaatttcttcactttgacattcagagcactgggcagaaatcacatcgcgtcaacacccgccgcgggccttcgcgaagctttgttttaattaaacagtcggattcccctggtcctcaccaggggaattattttgtgtgtatttgtgtgtgcgcgcacatgtacatgtgtgagcatatttgaggaggtcagaggtagtgctgtctgtcatccctctgatgctatccatcatggggttttgaagcaggatctctcactggcttggaaagcatcaaggaggctaagctggcaggccagcaagccctagggatgttcctgtctttctccccctagtcctgggatgacaattgggaggcgccaggtatgtttctgtgttttaatatgggttctggggatgaactgaaccatctccttagcccacaagttaccactgtagataacagactgatgctcagggacaactgtcagggtcatgtccttcctgagacttgacaccatagccaagtctctttgcttgtcttctaaacactcagaaccaggagttccagggaaggcttcccacacagcgggtgggggacaggccttgagaagggctggttacaggcagacagaagggaaacacaaaaattaggctccaaatgatagggttaaattagctcttatcttggttattatggtgtttttgtaagttaggaagcttatgagtcatgaatattgccacctttagtggatatcatcacaagtaatttatttttcaaaaactactcatacaaatatgaatttcacttggttcttatgggcaactgttattggcctggtagcagggaagaactaacaaggtcacagcaaagataaattggttggttagtaagaagatgtgattaaatgaatagtttgtgat

SEQ ID NO: 476 - DNA, 3600 bp, mus musculus
ctacccgagacccccctctttttctctctcagggcacggaggccctgccttgtcctctcctgcccagctataggctgatgacctcttcattgaccaatcagaagatgatggagaacatcatttttacacaatactgagtcacaaaatgcttcctaataatgacagcaccaagtcggactgcagcctaggttcagaagtcagcacagctgactgcacagaacattctcaaacagcttggtgactatgatgtgtgttggatgtatctgggcacccagaagctgtggttctccatggttctccatattggtacagttccgataaggtacagagccccaccccatgccatctggaaggcacaaggatatgccactgcttttgaagtagctggcacgagaggtttggcagatgcacatttttggaatgaagctgcctagagcccagcacaccaacccatatccttgatggttactagctgctaagttgcaggggtagatactgcagcgatgacgtgggcagtgatgatctgctgtttacttcgatttctgacctgggtacagtagtttcctaatagagggtctgcagttatatggaattattggaaagttttgacctttcttaccctttcacacactccaaagacccaaagtgcctctggttccctatattgaaagccattttgctcttaataacctggagtaattttgtttttctctgactaaatccttgttgaaatatttgaatagtttcctgataatttggggtgtttgttgagcgtttactaccctccactgggctgagcattttgcaggcatggtctgtttagttctgtaaagagcctgtgaggcagcttctcttactcattttacagagtagtgcgatgaggcccaggaccacacaaccatgccaagtctcagagctggcaagcagcagaggctgagatttttttttttttttttgagacagggtttctctgtgtagccctgggtgtcctggaactcactctgtagacctggctggcctcgaactcagaaatctgcctgtctctgcctcccaagtgcttggattaaaggcgtgcgccaccactgcccagcagaggctgagggtttgattctgggttctgactggagagcctggctgagtactttgtacggtttcaccttcacagaagcattgatgtagatctacgccacagtcccttcaggcctgagaccaggaatggctcaggattcagaagttccgatttttaggataacatggactatgaattacttcagaactgctatgcattaggtgtagcataatataatcaaacacactaaaaatttgaaggataactagtgaggtattagaatagcttggggcctgagcagaacctgggctacaaaaggagttcaaggtcagcctggacaacatagctagcttccaccttaaagaaaccaaaccaaagagccccaaccaacaccaccccagaggaaacccacaagtaattaaagaaagttcagttttcaccatttagttgccaaacatacattgaaaaatattttgtgaaatatcttgaaaacctttgtgaatcttaaagttacacattaagaattatgaacctagctggcagtggtggcgcacacctttaatcctaacacttgaggggcagaggtgggcagatttctgagtttgaggccagcctggtttacagggtctacagagtgagttccaggacagccaaagctatacagagaaatactgtcttgaaaaagaaaaagaattatgaacctgtaattttcaatgcatattatcagacagaacaagctaggcagatcaaaaagtcatttttttttttttttcatctctaacctcattttcaagagtcttgagtctggctgcttaagacccttatgtcttttccattttagtcagagtaggttgtcaaggacttatttcatgtctgagtcaaatgtaattgaaagtactgtgtatttacttagatcaaggtcattatgttgcttcgcagagtccaatcatgtatcatcccatctcaaagcagagacccagacaaaattagaaacttctctgtaaaagaaggtgcccttgaagtctctagagtatgctattttttaccttgttttcatagcctgacctatgaccatggcatttctgcagattttgatgttattttgttattaaactttaggtgaaatgtgactaaatatagctttagaactttgtgtgtgtgtgggggggcacatgtgtgtctggggactcatgcacagtgtgtgagcgtgtggaggtcagaggttaattttgaatgtcacttaggagcagtttgccttgtttggtaggggacatggtctcagattgtcctagagctccctggttgggcttagctggctggccagaaagtcccaggcatccacctgtctctgcttctcaatactgggatcataacagtgtgccactatgcctggctttccatatggcttctggggactgaacttgggtatcacacttgtgtggcaagtgccttgctgactgagccacctctccagctcagaacttcattcttaataaatttactgcacttttcctgcaggtttgtgacaaaagacattgaagtctatctgcaatttattattgttctgtggctccctgggctcacctggaaggtcaccacctagggtttctcagggtgtcgttcagctgggactccaggcatgcaatacccagttgccttgcccatgtcgccagtttgaggttagcggctgttggcagtgggctcaggtgaagttggctatctggtgtgctcactgtaagatgcctgagtttcttccttgacagtatttgaattctgagagaaagtgcacaaaggatttcagagactcaggtagaaccttgaggcttcttctgctctcatcttagagatcaatcactctgcctcattccctccacactgagtcacagggccgtcgtagatataaacggagggtggctaactgtgtgagtattggtaggcatggttcactgggaggtttcctaggaaaactgcctttcaacatacacagagttagaaagttaataacaatcatgtacatgaaggctaatgttttatcactaaaatggagacaaaaaagccaggaagtcatattttaatttttaaatacttatatatgtgtgcatcttaatatttacattttatcggtttgatgaaacttaaaaaatcatgggaccggtgagatggctctacaggttaaggcgcttgctgtcaattctgatgacccagggttcagtccctgggacctgaacgggagagggagacaactgactcctgaaagttgtcccccgagtgccatactggcgctgtagcacgtgctcaaaccccgttccagaatgggcgaatatatgtcctaaaaataatggtatggcatctgggaagggacttggggcagctgacatatggtagacggaagcgctgctgacagaaagtccgccggagctaggaagacaaagtggcacatctgaaaagtgatccagcctcgttacagactcctggcagactgtgatgtcttactgtgtagtcaggaacaggttggctacaagcaaggagta

SEQ ID NO: 477 - DNA, 1000 bp, mus musculus
ctgaggacccagagtcttcctggaacccagcagggcatgtgagggaggctgaacccaaggcagcaacagtggctctcctgtgtctctctgcctagtgccacctccaggtgaccctatggcttcctgggcagcaatagcttcatgtggagaaatcagcacacttgcgggctcagcagtcctctgatcgtggtgtttggagcccaaaagggaaggggacttaaccaccctgagcagcccacccaccgcatgcctcagcaggctttcccccaacatgggaatgactgattgattccgggagacaagccggctggttcacattgcccgaggagattttccttattgtcttgttttgggttgttgttgttttcccattggctggaaatttagaacatgccactctagggcaaagaattctcagaactctacccagtgattgctaagctaatttgctgtcatagcaactttagagtttgctccacctcctctcttttcctggagacaggttagtctcaaactcagtaccctcgagcctcagtcccttgagtgcagggattgcaacccccagataccaccacatctctaagcggcctctgaattttacagcctcgctttacctgaggctcacacacacctgtgaggacaacagccactgttgtcatctgaaagtagacaacagcggcgtgaatgagtcaaggtctcagccaggttttacagagttagggagggagatagaagacagtaggtccctagacggcagttcagtgcttgcttctggcaaatgctagtctgcaatgcgccacctagtggcaggattcacatacaggctcaagtgcgcctcattagaatgacttcaatctacatgtggacaggaacacagcgtcttctgtcttgtcactctgctgacctttacgctgagtccactgttgagctagaaactgagtcgctctttcacgttgctgtccacaggaaggaagaaaggaagggtagggcaagcaatgtc

SEQ ID NO: 478 - DNA, 1000 bp, mus musculus
tacctttcgccatctggtaatctctggagttagtagttatagttgactctgtttagagattgttcttctggtgtctgttaccgtctctcagcagacctgggagacagattctctcctctgagtttcagtgctcagagcactctctgctggcaagctctcttacagggaaggtgcgcagatatcttgtttttggacctcctcctggtcgaagaagaaggcccaaaacagggcctctctcagaagctgtgttgctttggcagttcccagatgctgtcagcttctgtggtgcagactctcacctgtgcagaccaaaatcctaagttccagggagtcctggaaccaagatggtgaccgctgctcctgaggctgaggccgtctcccgagcaaggcggacacctgtcctccggtccggacggtggccggccgtctgcggcctgccaagagtgctgcctcagcggctctgcgcctccgcccgtcccagaagctgcccggttctccggcgcaccctctaacctgttcagaccaatttcctaagttctgctgagtcccggaaccaagatggcgaccgctgctgctgaggttgaggccgcctcccaagccaggcggacacctgtcccctggtccggacggtggcccacacacatgtattaaatagcaagaatttctgggaatataaaacttctcctgttttgcaccacacttttttatatcacaagcttccctctcctatccccaaaccccaaattactgtctttgtttgctttaaagagcagagatgccacagggaggaaaccaagcaaataatgtaactagaaaaacgctgttaaaatgcacacccctaaacagactttaaaagagatactaaataacccattgtctccaaagaaaagaaaagcaaacagataaaatcacaacatacaccagggacaaaaatccccaagtgaaaaggtggttatataaagcgccattgaacaatgtaagaactataaatacatacata

SEQ ID NO: 479 - DNA, 1400 bp, mus musculus
attatgtttctttttttttattacatattttctttatttacatttcaaatgttatcccatttcctagtttcctctctaagaatcccctataccctccctactccccctgctccccgatccacccactctacttcctggccctggcattcccctatactggggcaaagaaccttcacagaacgaaggacctctgttccattgatgaccgactaggccatcctctgctacatatgcagctagagacatcacccccaccatgtgtcttctttgatttgtggtttagtcccagggagctctgagggtacaggttagttcatattgttgttcctcctatggggctacaaacccctcagctccttggatactttctctagctcctttctaggtccattgtatggaccctgcgctccatacaatggatggcagtgagcatccacttctatatttgtcaggcactggcagagcctctatggagacagcaatatcaggctcctgtcagctagctcttattggcatctgcaatactgtttgtttttgttggttgtttatgggatggatccccaggtggggcagtctccggatggtaattccttcagtctctactccacactttgcctctgtaactccttcgatatgtattttgttcccctttctaagaaggatcgtcgtatccacttttgtcttctttcttgagtttcatgtattttgcgaattgtatcttggctattccaagcttctgtgctaatatccacttattagtgagtacataccatgtgtgtttctttgtgattgggttacctcactcatgatgatatcctccagatccatccatttgcctaagaattttatgaattcattgtttttaataacagcatagtcctccattgtgtaaatgtaccacattttctgtatccattcctctgttgagggacattgtcgcacccacctcgtctgacaaggaaaacgcaacacggtcggattcttctcaacggctttattgcaggaacacctctatgctacgggaacccctggaacccagggaggactgcttatatacaccccagcactggggagggctatgtgtcctcctgggattggtcagtctgccagcaccttaatttgcatgcacccgctcgagaggggttggcgccagatttgggctagtgcctgtgcagtggtgttgtttagtgacggtgtaccggagaccggcaccatcttttaggcgtcggctgcctatatctcccccttttttgtttaataatatgatgctggactaggtttgggcaaatctgtccatcggccacagctcctgtcttaggtcgatcctttcatgtcacagccttacccgtcataccctatcgcctccaggcccagtgtcttaggttggtttatgcataagg

SEQ ID NO: 480 - DNA, 1200 bp, mus musculus
ccctctcctcctctcctttcccctccctctccttcccttctctttgctcttctactttccttcccttccacttcattcgcctctccttcattccattgttcttgagatggggaaagattactgtctttgcctgggaaagctcagggctcctggtctaccccccacagcctcccaagttggtgagaatgtaaaaatgcatgtaccactatggctgtctaaacttcttgtcttgaagcagccatcctatttcatgaattcagggaagcaaatcaatggcatgagactgaacttcccaaattgcatgttttagcagccaaacccagcataaggatattagctgaattacttcattagacaccttccaatgaatgtgataggcaacccatcaaaactgaattctcatgccttgaatgcttctttttcatagtcgtgttctttggccttgcatgatgcagtctaagggacaggaacaggtggcatggtatgccacataggaaggagacacttgttttggaagagagatttcaaatcggtgattcattaaaaggtaaattctgtgttttaaaccataatataccattaatgtggaagaattttaatccagcaacatgactgctctggcaagagatcatatccaaagacctatgtctgtgtgatccatctggaatgcataacgacataccacatacctctaatccctctaactgaaacacacacacacacacacacccttagttcacacagttcaggtaaaattagttaatagaagaaagcaaccatgtatgaaagtgaccgaaagtgaaatcgaatggtgaagcagacaaagtgatgaatcagagaaaggtttgagagaatgaatcagagatagtatgcgcccagctctcatgggaacagcacaggaaagagaagctagttacgagcagtacagggagagagacagtcagttgcgagtcagtgcagcgagtgcagtgcaggagagttgagtttgttcaggagttcatgaacttcaggacatcagaggcagttgaagccagagaacgagaagccagaagattaatatacaagccatatattaatatataagccagagttagtttgaggccaagtagagcaattccgtgaatagctgagagaaaccagattcaaccagagctcagaaaaaacaagaaaggataagcttattcagcaatgagcctctga

SEQ ID NO: 481 - DNA, 1200 bp, mus musculus
ttttttaattaggtattttcctcatttacatttccaatgctatcccaaaagtcccccataccctcccccccactcccctacccacccactcccactttttggccctggcgttcccctgtactggggcatataaagtttgcaagtccaatgggcctctctttccagtgattgctgacaaggtaatcttttgatgcatatgcagctagagacaagagctccggggtactggttagttcatattgttgttctacctatagggttgcagatccctttagttccttgggtgctttctctagctcctccattgggggccctgtgatccattcaacagctgactgtgagcatctacttctgtgtttgctatgccgccaccattgcatacactagcaagattttgctgaaaggaccccactcatctttctatgagggtgttcctccacccacccacacacctcacagctctagtatccctctatcctggggcatgaagcctccacaggaacatggccctcccttcccattcatgccagataaggccatcctctgctacatatgtagctggtgagttagtccttgagcactcttgtgagtccagttagttgatattgttgttctgcatatggggttgcaatcctcttctgttccttcattccttcccctaactcctcccttggggtccctgggatcagtccaatggtgggctgtgagtatctgcatcttccttagtcaggtactggctgagcctctcaggggacatccataccaggctcctgtgagcaagtgcattttagcatcagcaatagtgtcggggtttggtgtctgcagatgggatggaaccttaggtggggcggggcagtccctagatggtctttccttcaacattctttttaataattattttaaactagatgaacatagaaataacaaaactaaagactcatttcagcataactcaaatgtgtgaaccatgcttaaattagcatgtagcactgaattttacataatgctctcaagcatagaaaaatattttttaaattcctgtttacatggctacagtgcaagtcaattaacttccatagaagagttatataacaccatcagagttaggcatcagtgctaaaaatgacattaaatgtagttgataattttagaactaataaataagttacattagatgtaactacacattttgaaatactt

SEQ ID NO: 482 - DNA, 1000 bp, mus musculus
attagattcagtgtatataaagatccttgatcacttggacttgagttttctgcctagtgatacgtatggatctatttgcgttcttttgcatgcaaaccaccagttacaccagcaccattttttgaaaatactttctttttcccaatgtctggctttggcctttttgtcaaaaattaaatatctgatctgttccggttggggccagccccaccatcttctacttgatcccgccggaggccaccaagggccctagagtactctccactctgcaggaccttggaatcacctcaggatcacaagtgagtaaaatgcaacatcagcttcaaagaatcaaggagggtcttgtgccagcaggaaaagggacagaggaaccagaggctgggatccaatcaggttggggccagtaccgacatcttctgcgagaacccagccaagggcatctaggtccccagaggactctccatccacaggacccctagcacacccaggacctcttgatcacctgaaagcatgtgggtaacagaagcaacagagcttcttggacagggtcctgtccagccttcattctcagccaggaggcagagctgggaccaagacccttggcatcttccttaccagaggagagtcaccctacagggagggctctgaccacaagactcagcaggtagatcagagcttcagacttctgaaaacctgccctggatgaagagagcttgcctgcagagagtgttctgaccactggaactcaggtgacagttggactcccaagagtgctgacagaggctaacagaatcatgggaggatcaagcactagccagagacagcttgaacattaacaccagagatttccagattgcgaaaggcaaaattaagaatcttactaacagaaaccaagaccaatcagcatcagaaatcagtacgcataccacagcgagtcctggataccccaacatacccgaaaagcaagatttggatttaaaatcatatcttatgatggtgg

SEQ ID NO: 483 - DNA, 1200 bp, mus musculus
aaaatattttcattaaaggagcaaactgtagtcaggatacaaaaattataggttactccccatctttcccactatataaataaggagttgtttatcttccaaacctagaactacagccactttatacatttcaccagatgggaccacttggtgtatgaaccctgaaactcagggtgggcccaaaactaaaaattaaacaccattcctctaatccacaatctgacagattgggggggcagcaaagatttgaacagcctcatttgtgaggagtcaccctcacattcgccattacaagatgtcactgacatcctgtgttctaagtggtaaacaaataatctgcgcatgtgccggggtggttttccactccatgtgctctgccttccctgtgacgacaatccggccgatgggctgcagccaatcagggagcgacacgtccaaggcggaggacaattctccataaaagggatggagtttctccattcgctctcttcctcctgaagaagtaagcaataaagccttttgccgcagaagattccggttgtcctgagtgtgttcttgccggtggggacaaaagctcgggatactcattcacatatccacaacaagaagtaccacaaacattgtgacttcagatggctagatcccattgcaaaaaagaaaatcacaaatggggagaatatacatattctggaagcaataaactattataaaatttcccaagtacaccaatttaactggagtacaagacacaagacaagcatgttaaaaatagcaattgtgaatacacacaaaaaccaccaaaaacttaaaaaattgaaaaaataatgaaaccaactcaagacataaaagtagaatttaacaaagaaatagaatcactgtagaaaaaccttactgcaacaaacttgaaatgaaaacctaagggtttcaagcaaaaacagataatacatggaagaaataatttcagggcttgcagacaaagtagatatggatcaatcaccaaagaaactactaaacctcaaaacaataacaacaataacaacaacaacagcaaaagaggccagaaagaaacattcaggaaatcaggagaactgtacaaacaccaaattaatggataacaaatatggaagaagaagaagaagaaacccagattaaaagcatagaaaattattttaacaaaattaaagaagttttcaaaatcta

SEQ ID NO: 484 - DNA, 1200 bp, mus musculus
gtctgtttccctaactaagactcagagtcaggaactagcttcactatcagctgttaagcatgacaatatctacaaggggtcccaagtgatgttggtcgagcttattcctccaccttacgatggtccacaactgagaagcgttcaggagaaggcagactctgggttttgagatttgatctttcccagacaacatctgtgtaagagagccttgctatttagagccaagtccacagagcgcaagggctctgttctcacagatttactaggagagccgaggtaacaaataaacaccgaggctaattcacagtgattaagagctaggaagccaataaaatagggcagtggatgtggagagagacaggctggtgacagaatcaccaaagaagtgatgccacagctgtcaccagacaagtaaaacgtgaccctgggtgacaattgaacagacatgccagggaagaaagacagagggtaaaagtctcactgtggtgccagtgtcagcattggctggggcctgtgtagaagggaagcagctacccagagagtgcctccagcctacaggagccactgggcagcagcagcagtgcactgtcactgcgggaaggaaaaaacacccaggaggagggcagaggaagctgagagcagatcttcgagtgctcacttctctgtgaacaagagaaactatcagataaggcatatgaacctacctgtgttcaagtctcaacaaggtgagctgattggtcagactgaacaaccacagccagctggaaatctagcattagatgatacgacatagacacaaagtcactaaacaagaatgaggagccaccaactcccacaggttgaacagagagcagagggcagagggcagaggccagggcacctcagaatccccttggagaaaggctatctccattctatttgaacagctagctatcaggatggaagtaaagtcctacacatactgatgctgcctgccagtacttcttcacaatgtgcccactcacggatgcaatgtctgtgcggcacctgagcctaacactgtctcaatgaccttgacaaaatttggagggaaaaaaatccctcaagacctgggctttaaagttattttaaaattaactgtgaataattgtcccataatatgagttccttgattaattgcttaagataacgtctcctttcctctgtggcctccagggctcc

SEQ ID NO: 485 - DNA, 1200 bp, mus musculus
ttgattgtattttcatgtatttctttaagggatttatttgtttcttctttaagggcttctacctgtttgcctgtgttttcctgcatttttttcaaggaagttttttgtatcctacttaaaggcctctatcatcttcatgagatgaaatttaaggttatcatcttgcttttcatgcattttaagatagccagggcttgctgtggtaggagaactgggttctaatggtgtcaaattgcattgggttctgttctttatgatcttgcacttgcctctggccatctggttgtctttggtgttaactggcctgggtgtctctgactgaaaatcatctccttggaggcagatagagctctgtgacctgaattagggctggtttccttggaggcaggcagtttgtctctggttaggatgggcgtcctgtgcctctggttagagcaggcttcctgtgcccctggttactctggatttcctttgcccttggtttctgtggacctcttgggaagctctcaggctgtagcatttgggctggtatcagaccactggtctggcttggatgggtaagtggttcagtgggaagatggagctctgtgtccttggtcagtgcagacctcctgggaagcacagaggccgcaccattagaatgggtattggctaagccactgatctggcccaggtgtggagctgggcaggaaggaaggtagagattgggggcagtgggagcaggggtaggttgtgcttcagctgggatatgtagatattccagctgatatgggtacttgggtggaatcctcatatgtgcccttggcccctgtggacttcttgggaagcacacaggctgcagcatttgcgcaggtatcttcaaccttgagcctgaacagccttttgcttccttacattgtttcttgtgaaggatttgataacagaaatgagagaagtaactgaaatgcagatgtctaagagacccctttagtagtgctgcaaaatgtatttccccctttctcatcctcccctttcctcctttcagagatgctctctgaaatccagaaagtgaggtcgaaggcatgcctcccacttgccctccagccctgagccttacatgtcatcgtatctggacttaaggtcttttcagttgtccttagtgaggaggtcatgttgaagctgtgtggatcttcactctgtaagtggtgtctttataagaga

SEQ ID NO: 486 - DNA, 1200 bp, mus musculus
cattctcttgtggtctgtatattcatgcctcattactatttcactattgggtatttctgttagattctttatttgaaaagaaatttggaaaacatgcatgatggaaaattaatgatattctaagttatgagtggcttttttttccggttttgttgagatgagctctcaggtagagagaattggtcttgaactagctatgtagctgaccctggccctgaactcctggttcttcgcactgctcaagttctgggagtgctttattgatatagaatctgtggttcccttagaaaaacagggcaaatttatattgactgaagctttcccacataccagataaataagtgtgtgctgacttccttctgttcacactcaaccaacaggctgtatgtcgatggatgaagcctgtaatactgggagctccgtgaaaagcaatacaatccccactggtttttctccatgattgttagcaagcaaaataggctgctatggcactcgctgcctggacctctgtggtttatttcttccacctggttctttggagagttttatcgcacacaaatggcattctctgagccatcaccatggaaacccaaggattcctatactacttctgtagaatgtagcctatctaaactagaggatggaattcacatctcatagttcctgtctcacagtaactttgaccatcatgtcagtgggaatgggtatttgaagtcctttcttgtataggggaaaatttcacctgcctgttaagaagtcctccatgttcttatttgattgtttggggttttacattgttggcactgcagactgaatgcacagctttggaaattcctggcaaacactttcctactgagatatattaccaattcgttcatgtacacacacacacacacacacacacacacacacacacacacacacacacacagtttttattgttaattatgtatctgcatgtatgtgtgtaggtacctgcagaggcaaggagatagcactggatatccctggagttggagataaaggtgttcatgatcttccttaaatgaggcttaaaacaaaacctgggctctctgcagagtacttgcactctccctgactgagtcatttatctagcccatatattttatgttttattaagtctctcaggctagcctcgaacttgcaaccctcattcctttgcttttcaagtagtggaga

SEQ ID NO: 487 - DNA, 1000 bp, mus musculus
cagaggcatttccaaatccttcacacaggactgtgaggagttttgctaccacatgcacgttgaggctattgccaagcagccggtaacgctgtttcactgttgtcttctcaggaaaccctagaaaacagaggtggcatttacaatgcaatcacttgtgatcccaatttccagaagtaaacggattccttttagtaaaagcacactatgtgcttaataaatacactcctgccttcatggtcagtgtaggcctgttgtacggaggcctacacaatgcatcaccttgtgatgctgtacttgtcattgtgtatgtgcgctctttgatgctcgcacaatgaggaaatggcctaaggacaccattctcagagagtatactcataattaaaacacaaaaggtggtaaattgctaatatgcctacgaagttttactaataaatgagaatttggagaccaaaatattgtagaacatcattctatgatgataatacagcgagatgctgtataagacaattatatcacattatatccaagtatggttaatatttacagaaacatatgtgttaatacactttggaaaaatggttgctactattttccttggtagtttcttttacttaatagtacttttatagtgctctaatttacatcccacaaaatttacattttaaaaatatatggttcatacatttgaggattgaattcacaaacatcttaatttttattccttcaacataaaataaaaaagcaaagcaaacaaacaaaacaataacaacaacaacaaaaccccaaactctaaaaagcccctgtcccatcaacagtccctcccggttccttcccttcacctacctgcagctctaccttttgatggcactgaagagttggctattctagtctcatataaatggagtcaggtgacatgtttatacctgcctttttatagtcatcataatgtttttaaggttcattaacatttcagcaagctctagcacttactttttattac

SEQ ID NO: 488 - DNA, 1000 bp, mus musculus
tgtagaaattccgaggactatcacatagatacagcttttcttaagtgagcattctggtcagtagatgatcttgggcagctctgtggttcatccgagaccagccttctccttgttggagatttacctacagagtcagtgctagcttcacttcccctctcctgtctgacatgcccagccactcgggacacaacctgtactgatgtagatgaggacggagagtgggacagtgctgccgcactgggcttgcatggttctagcacggctgtgagaacttcccttctggacatgctttgggtagactgaagctgtcagcaagccagggagccttctcccatgagcttacccttgccagagcatatgctctctgtcagaagtgctgtcctttgtagtcattcctgtttattggttctgagctggcagtaatcgtcatacccagccttgcagtgctggggcatacttgaataaccaaagaagaaaggtagcatgagactgaggatttactgttctcggggttccagtgcggagtgtgaaattttggtcctcaagcaaaatggaggcagtgcatcctctcgttgactctgttgtgtcttctcgttggccatcacactgctcagatactacagcactgggacattgtaatttttgtccttggtgctgattaagaatgtcttgaaaatattctagatgaaataaaaggtcaccatcctaaatggtgaagaaaatgccattctgccccgtttagttgcaagttagccttccagaatgtcagctactatgttgatttatttaatgatagcgattatgtgatttatttaatgtaagctactatgttgattgttctgatgaacttatttttagtgttatttgtgtcacacacaataatcatacaaaatactggggttctgttgtgacattgtcatacttgcatgtttgtaccttggtcataatcattctctattacctaccccctcccactgctccgccaggaactcttatcaat

SEQ ID NO: 489 - DNA, 1200 bp, mus musculus
catcattagaattggttgcaagttttgttgttgagtctcacaaaacggtgttttgagttgtggtaaaacccctccccttatcctcttgtcttcctcatccacaagttctcacctaaaacattaactgtgattagccccacctcctcctatttgcaggtcctgatgtttgtgtgtgtgtgtgtgtgtgtgtgtgtgtgtgtgtgtgtgtgtgtgtgtgtgttggatgactctattactgaaggcattgatctctttggtgctttataggcactacatagagaaatcaacctcaaactgaccaggaaccctttccttgctgaccagcttacatagtgccaaaggaggctcatttatattaatgagagatgagagacaccaatggtcttactcatgctccctgcatactacaatactgacctgcttggaaggaggtacacattggtgtaatgacggtatgacaaggttataaaaataaacaactactttctgatcagatatgaggtctgccctggagaggagagtccatgtctggtattatcaatctactcaaaacctcatgtctgttgtggtattgctaagtgttcatgctgccaaactgcattctaaatatgtgtgcatacccgtagatttttttccttcaactttggtcaaagatgctcccttttgcaatgagtagtgattaatgcaaagactcataagttgtcaagtgtggaggataattgactcattgctctgttgttgtgggtcatctataccaacctccccttgcacataatttagaaatttttgtggagtggttctagaagactggaagaactgggtaggtgtatagtaaaatgctgacttctgaacttaacatggctgctgtgcacaatccctcaccacagctgtggttacctgcataagaagagtagaagaagccaatcagaattatagcatgaatgcaagggggacttaatagtttccagagctgcattagcagttggcagctgctgagagggagcatcctctttggaaacacagctgccagtaagttgtccatgccctcctggattctttacctagatgccacacctagcttcttctatatatagggagcagaataaatacactgaaatgcaatattttcaatgagaattcaattcctatctataaatttgattacatttgcatcagtgaatgcaattgctgcttttccta

SEQ ID NO: 490 - DNA, 1000 bp, mus musculus
taatgctctttggcaagaatgagagctacttctttcagactctcccccagcattcatgttctcctgtgcatcacaataggtgttaagctggctggctgctgtagctggaattacacactatccaggcagccacagttggtgagatctgaagctaaaggaatggatctccagtttggaaagttgccatgcccgagcacagcacatgaaaatgctcaagacccatcaactccagctcctttcattttatcttagaattataaacaagactgacagagaagtacaggtctccagggaacactcctgggaacatgcctggctaggttttctttggacccagtatgcatatctagctgttactagattcttaaccaaggaattttcatcttcacttagcacttacaagaatgctaagcatagtgtgattgacctgcctactatacaacagctctttgaggcccatttctcttcctggttgtagccttcagttttctggggatccaatcagaagacttgtgttttgggaaaggttatctcctgaaatcattttgcaattctagtagcttctggttttaccttattagatgctaattctctccagaatatccctggatatcagaaagtctctcatctctcttatcaaaagagaaaaatcaagaacatttcataccaacttgagagacaccaaaagtatttatgcagtcatgttgttaaaacaattgactgtcctcttcctcggggagcccagatatgtgctcaaaccattgcactctctgaggaacctatgttcgtgttcctgggagtgtcctgctttcttcttgagtacttctctttgtcttttaactctcatgcctatgcctatattacaacatctttaatgaagccagcagcctgttttgtcatcctagataatcctgaaatgcttttcaggttaaagccaatagtcctggtttagcctgagagaaggtctataaaatgttatggctactcctcaggattccga

SEQ ID NO: 491 - DNA, 1200 bp, mus musculus
acagaaactgaggaaatagaaaaaaatcatcagatcctactacaaaagcctatactcaacaaaactggaaaacctggatgaaatggataattttctagacagatatcaagtacctaagttaaatcaggatcagataaaccatctaaacagtcccataacccctaaagaaacagtcattaaaagtttcccaaccaaaataagctcaggaacagatgggttcaggacagaattctatcagaccttcaaagaccgaataccaatgtggggcaatgggctacacacagaaagcctcgtctccagtcgatctgaggtcttgaaccccggtaggacccagtgggtagtaatttccacctacatgggatggtaggcattcggccatgggccatgtctcctggaccccagactcctgtcaaagttaccgcccccagagcccccacaggagaagcatgtggctagcagtcacatagacaatgtcccaagcttctggccttctggctagactcatccccacagttacctagcaaaagcaagataacaagcaagataagagggactgtttggcctctcaccactctctaagcttttacctctctctctctaagccttcacatttcttattctctaactctctctctctctttcccttcccccttctttcctcttggccatggtcagtctctctccctccctctttttatcttctctctttcctcctgcctttctacaataaagctgtaaaaccatagactgtctctgttcatcaagtcctgccatgcttggaagatgggataggcttttgtctaaagagctgcttctaaactcctgtcaaaagaccttcctgtgctccaaccatggactggactaaagactcttgccttcgtaggaaccacccagcaccccctttctctccctgccctctcttcccatatctccagaaccaagtgctgccccggggcacctattctgttctcagctcttctgccctatccagtgtgcgatgctgaagactaagaacctgatactgggggtttcattgacccatgctgtgtagggtcaatggcttcacacagccagattgtccacctggggctgcatggaaaatgttcggcagtcctcccacatctgcctgcccagagcacaggaactctggccagacacaggctctctccctcccccctcttcccctacacccatgaccct

SEQ ID NO: 492 - DNA, 1200 bp, mus musculus
aagatttgaatgcaaaaaaccttacataaatttaaaaggatggatacatttactggtgttaatgaaaacgttccctattcgagtcaagtaacaacccatgtcagtcagaaggggaaaacaaaaacaaaaaagaacacggaaactgggccctaaggctcggattctcactctcatagaccagcaagatggaagtggtaactggttcaggaacccttcccagactcaggaaagcctggaagtctgtggtcagttaacaccctgcacagaccgtcactacttggtgctcacacagatccaccaggctggggatttctcatccacagtgtgctctcctcagccacgaagggcccgagccacatggattatggctaaatcaagatatgcacagggtgttaaacatataccaagggaactgttaacctgagtacaaggtcaaaactcagcaacaagtgctacggtccagtgctgataccagatacaagcttcaagtttgtgtttcttttctttttcaaaggcttatttattccagtttcatgagactagatgaggtgtacgcatttgcctgggcaaatcgatgcttcacatcagctcatgcagcagatgcctggcacctgctcagtccttctatgaagcagtgagggtggataatggcttgccatactcctgcttgctgatccacatctactggaaagtgaacagtgaggccagcatggagccactaatccaaactgagtacttgcactcgagaggagcaacagtctttctttttttctttttttttattatttcttttttactagattattttctttatttgcatttcaaatgttattccctttcctcatttcccctccgaaaacctccctatttcattcactaactcacccactcccacttccctttcctggcattcccctacactggggcatcgagccttcacaggaccaagggcctctcctcccactgatgtcccacaaggccatcctctgctatgtatgtggctggagccatgggtccctccatgtgtactctttggttgagtccctgggagctctgggggtactggttggttcatactgttgttcctcctatagggctgcaaaccccttcagctccttgggtcctttctctatctcctccattggggaccctgtgggagcaataatcttaatcttcattgtgctgggtgttatccctctg

SEQ ID NO: 493 - DNA, 1000 bp, mus musculus
catggcctgtctgatgcttctttgcaagatttaggaaggaaggtctctaactgcctctgatccttgctacttcagcactgttgttaacctggaggctttggtgatctctattgagtgttgcagtgttttaggatggtccttccatacgaggtagctttaaaaaaaaacaaaaacagaagcaaatatctcccagccctgtatgaagtttggtgatttctttgttcacagcacccatatatagctctgcatagtattcagcatacagtcaaaaacttgacagagcagccatggctcaaatgtctcctcaggatctcatatggttagtttgtttcctacacgctaaagacatgctaaaaaggttggggttttgcagataatgaggattggtaaggccattagtgtgagggctccccatgtgtcttagtcagggtttctattcctgcacaaacatcatgaccaagaagcaagttggggaggaaagggtttattcagcttacacttccacattgctgttcatcaccaaggaagtcaggactggaactcaagcaggtcaggaagcaggagctgatgcagaggccatggagggatgttacttactggcttgcttcccctggcttgctcagcctgctctcttatagaaccaagactaccagcccagagatggtcccacccacaaggggcctttcccccttgatcactaattgagaaaatgccttacagttggatctcatggaggcattttctcaactgaagctcctttctctgtgataactccagctgtgtcaagttgacacacaaaaccagccagtacaccatgataaaacaaattatagtaggatgaaagatctaagagctgcttcatgcttgttctgtctcttcaaggaggccctctgtcacactgtggtacagaccaaggtccacacttgatgctggagcagtggctggcaccttgttcttggacttcttagcctctagaactaggaactaaataagctttatt

SEQ ID NO: 494 - DNA, 1000 bp, mus musculus
tatttctatatttaaacaaattatatacctatcacttgaaatcaaagtggaaaactcatattttaaatctataatgagtgctctcagaacccataggattttgcattgtaaacattacaatgaatattacaacttgcaaacccactcaacaatcagtgggctaacatttggcaataccatacacaacttgcagttttggaggaaattctgtgttacccttgtcctaggagcacagaactgtataaaagctacctgtgctatatggttttagcccatattaatcaggattcaagactcttacctgttctgaatgagagcaattacttgggaataggtctttcctatgacactttctccattgacttttataattctgtcaccttcaaagaagagggggggggggggagaacaacatattaggaactccttgaaagaactactcactctgagtaactgtgtcgaaactcccaacactgctccctcctcttcactctgtttccatggtgctgggatcaaacccgttgctgtctgagctccacacccagaccaaataagcccgtattttttaaaatatgcctgcacatttttaaagtacctgttacaaaaataaatcttccttttaaaacatcaaactgctcatgaaatatagcaatgttctgagaattctagacaccaatgagcttccactgaagtggtaatgccccaggtgagtgctatgtctatcaatgagaaagacccacagaatgctcacagacatttataagatggaacacagggccccagtggagaagctagataaagtacccaaggagctgaaggggtctgcaaccctataaagtggaacaacaatatgaactaaccagtacccccagagctcgttcgtgtctctagctgcatatgtagcagaagatggcctagtcggccatcactgggaagagaggccccttggtactgcaaactttatatgcctcaggacaggggaatgccagggccaagaagc

SEQ ID NO: 495 - DNA, 1200 bp, mus musculus
caaacaagcaaaactatggtgaaagaagagctaataccaagtgtctcaaaactgtaaaaggaaggagcacactgtcaagcttattctctaagacagaactacgatgataccaaaatgagagataagaacacaacaaaacagaagaatataaaccaataccctttataaacaaaaaacactgaaattctcacaaactgccttgtgagactaggccggggcctagcaaacacagaaatggatgctcacagtcactattggatggatcacagggcccccaatggaggagctagagaaagtatccaaggagctaaagagatctgcaaccctatcggtggaacaacattatgaactaaccagtaccccggagctcctgactctagatgcatatgtatcaaaagatgtcctagtcggccatcactggaaagagaggttcattggtcaggcaaactttatatgccccagtacaggggaacgccagggccaaaaaatgggaatgggtgggtagggaagtggtgggggagggtgtgggggacttttgggatagcattggaaatgtaattgaggaaaatacgtaataaaaaaaaaaaaaaaaacaggaaaaataaattgaagaagtgttgtgtccgaccagcggctcacgtgtctgggttctagcctggaaaggcatcttggaaacctggagagaagagggagctagacgggcgagaaaaagatgcagctaagacagtcgttctgatcaaagctcaattttactattccgacactcagttatgaaggagggggaggggcacgatttccgccaaataatcctggggtaaggttgcaggtgaacgtgtgatggctccagaacaggaaagcggcaggctccagcagtgggcgtggcagaacaattgatcggcaagctccacccctgagcaagcaggtttcaggctggggaggggaggctacaaagaagtcactagaaagtagaaagacctcacatgttcatgagtttgcagaattaatattgtggaaataacaacattgctgaaactgatctacagattcaactgaatccttgtcaaatttccaatgacattctttacaaaactagtttaaaaaaaaaaatcaaccctagagtttatatggaagtacagacatctagagagctaatgcaatcctaagcagaaagaacaatgttagaagcatcgaaatgcatga

SEQ ID NO: 496 - DNA, 1000 bp, mus musculus
ggaaactgagctaggtccatctgaaagagcagtacttgctcgtaaacactgagcccatccctccagcctcttctgatttttgaaacaacacaagttgactttgcagagatttgacaggctggactacgcacatgcgcattaacctttattggcttcaggtagtcgagggtcacaggcacgcacacgttcacgcacacccttgcatatttgcgtccaccagtatggcttgacaagaactgttctgccaactgtccctgcagttgatagacactaaaccagggagcagacttgaagggacagggactgtgggagagacttggcaagcctatgacaagtgataatatttggataaggatgagtgggcttattacatcgttgatacttagataacgaataatgggctaattataaatattaaaaacaggagggtggacttataattcgatatgagatggggagagtctgcttgttataataacgttgatactggggcagttaacggttggtttgttataaataaccttgcctgagatgggaggaaagtacagccgtggggaagagaggaggcctttggggtttccaggcttctctgcgctgtgttgctgtcagaaaacaaatagggaagagacccccttgggtttctgcgatattaaggcacggagaagtaacctgagctttggaagggaggatcctgcttatttagacatggcttactttcctgacaatgatctgcacatggcggcctgtgcaggcgatttaccttttgtgcggctgtactttactctgggtaaatacgaagtcaatcacagagacagggagaataggtaagagattcttcagacctggggtctgagggcagtgtgggcagtgtggaagaagacacctctactcactcccgggacaggaacaggagtggggagggcccagcgctgattgttgccactatatagtgaccgtttcagcacctgtgatcagcacacctgggaggaacccctggccc

SEQ ID NO: 497 - DNA, 1000 bp, mus musculus
aagattaagaattaggttttcttcccaaaactccaggcccactttcaggtgaatattttctttttttattacttttctagggtccatgacttaacactcatgtacttatagcctcaaacggcctaagatgcccttcagcctttgaccttaatcatgaaatcctttatgttgaagttgagttacacttgggcatttgcaacaagagcaccttaccagtatgacacgggcaatcaaatgcaggttgcaagagactgggcatctgtgtatatctgttctctgttttctctgcacttaagaaacactatctgaaatgtgttaagaaactacaccagaaataatattcactatatttgatgtacaagaagataaggttattaaccccttaagtaatcatctgtatttgtgaatggacagtacatacagtaatatattgtaagatggtgtcaaatttaaaaataataaaaacctacttggcttgatgaaaatgtgcactaggtaccacctcaagaggcttctgcccagtcccagcgagtgctaccccgcacagcctgcctgcacatgccttccttcacctcttgctaccttctggaggctaataattgacacttacggttaaagccatcacacttttaccctaaaatatctacaagaacagataatgcagacagtatggctaccaaaggggggacatgtgaatattttagtttggtttgtatgttgaacacagacatgctatgaaacttgctaacttctctacttctacttatatcccaatacgttcaataagttgcctagttctcttcataacaagctctccagatccaagcttataagcagatcctaatgacattctgttaaagtgccaggtactagctgcaccctccacacgatttgatagggaagagaagatgaaggaaatgagggaagaagcggtgggatttgatagggaagagaagatgaaggaaatgagggaagaagcggtgggaggcaagtaaagacc

SEQ ID NO: 498 - DNA, 1400 bp, mus musculus
tgcttatttcagtgatatgtttgtctgattaaaatattacttccacaaagaaaataagcctcaactctttatttcaaccactcaacaacttaataaaaatgtgtcaagaatttacattagaaaatggaaaaaagtaaaaaaatgagtaaatgaccaagaaaaatgctatatacaatgttcattattaatcaaagaaaggaaaaacaaaatccaatgaattatctcttgcaaaccagttatgaatagactctttattatgttagtctagaatatatattatgaaggtaagtatcgtcttaggaattatgcaacgtaaatattttagcaggacctggacttagactaaaactataaagccatctttgttctgttggaaactcattgggttgatctgttgcatgtaataattaaaaaattaaaccacgctatttccagctactctctggccctggcagtctctccgtccccatggctaactgcttgcggtgaccaccccaactttttgtagtttgcttgctgcagaacccactcatattcccagtcatctaacccctgcggcttgctactgccaatccaatcagcaatcctaaatttccatggctagctgggggtacactctggccagcctgtgctctgcttgctacctttcccctggagctcagtccaatcttcctgtcccaaagcctggccaaattcacctccactatgttctttcctctggcccacctgtgatgctgagaaatggaaaacaccagacaatcttagtttagaatgaacagataacacaattgctgggtgcagaatctatcatcctaaattcatcaagtattctatgttaggaatcttctggtggtggatcctgatggctactgccaccagaactatcagtccccaacctacatcttgtctgctttgctcctgtcatccaaaaggaagtgctctcccactcccttccctcatcctctctcagtcccaaaagacctgcctcctacttgcccagtgattgggttcttgctgtctttattatttaatcaattaggggaaaattctgctacattgatccacaaaactttaataacttttattcaatgcataatgaataatcattaccaagaaatttatcacaatattaactgttaaaaatataaaccagaatgaaaaaatgtcattcaaactactatagaaccatagaatataatcaatatggtcactaaaatatatttataagataacatgattttaatggaaaaatattattttaagtgaaaaaagtaatactaaaatatatgcccactatcatgttttattaaatatatgaattttaattatacttaaaatactcattaaagcttcaaatatttgaagttttagtttaatggcaatatttaaatagtattgaa

SEQ ID NO: 499 - DNA, 1000 bp, mus musculus
aaaagctgggaatacccacgatacaattcacagaccatatgaagctcaataagaaggaagtctaaagtgtggatgcttcagtcctatttagaagggggagcaaaaaagatagcaggaagtagagggagggagggacctgagagaaagggggaggggaagggaaaaggggagcaggatcatgtgtgggagactgggtagaagtacagtgtcagagaattgaatggaggtgtgtagcagtgggggatggggactggggttatccactagaaagtctcagatgccaggaaggcaagaggttccaaggacccaaggaggatgacattatctgtaatacccaacaaattagagagagaccctgtagagaccacatccagatgttaggcatggccacaggttgagtgatggtgccaccaacccatcttaaaaatattagcacagaattgttcttgtctaaaagaaatgaagagacaaaacgtagagcagagattaaaggaaaggccatccagagactgccaaacctggggatccttcctatatgcagacaccaaacccagacactattgctgatgccaaaatgtgcttgctgacaggagccttgtatggctgttctctaagaggctctgccagagcctcagcagcggatgcttgcaaccagccatcacactgaacatggagaccccaatgggggagttaggggaggaactgaagaagctgaaggggtttgcagccccatattaaggatgacaatatcaaccaaccagaatacccagagctcccaggactttagtttaccaccaaagaaagagtacacatggagggacccatagcttctgcagcttatgtagcagaggattgccttatctggaatcaatgggaagggagacccttggtcctctggagactcaatgtcccaatgtaggggaatgttagagcagtgaggtgggagtgggtaggttgatgggagagctcccacataaaagcagggggacgggggtttaga

SEQ ID NO: 500 - DNA, 1400 bp, mus musculus
tcaccaaattatccccagatagtcggagagtactgcttttcttaaacctaatctctcatgtgtaaaccatctctagtcagggtataaggtacctatgagaattaccttcgtttctctagattttcacatagctctaaacacatgcacaaaaatacacaaaatagagaccaacagatccagacacatgccatcctttcttgtcctccacaagcaggcaaaagaattagacgattttggaaggttaagcttccacttcagaactccgtctctctgaccaaccgatctcctgagactaccaggagtccctggctctccctgcttccccgggcataccccagggcagcggtggtcttcctagcacatctgctgaccacagtcctccagtccttatggaccgaaaggacagctgcaaataccaagcgtgtgtttcagaaaaccccatcatctacaatcaccagagaaaccaagctcaattggatccaaactcagactgagccatgcttcagaagcaagggacaaaacacagacaacagaccaacacaacgagcacatgttcgtttcagaaaacataagacagacactcagaacaaagacactggtggcacgcacacaagaggggattccctggttttctctctgtctctgggagagtttcagaatccactttcctcccgtctgatgtagttcccaactgcagccatccgcctgttccattgatttacacccttatatttctctcgcctaaaaagcagtcacagtcagctattggatggatgacagggcccccaatggaggagctagagaaagtaatcaaggagctaaagggatctgcaatcctataggtggaacaacaatatgaattaaccagtaccccctggagctcgtgtctctagctgcatatgtatcagaagatagcctagtcggccatcagtggaaagagaggcccattggtcatgcaaactttatatgcctcagtacaggggaatgctaggtccaagaagtgggagtgggtgggtgggggagtgggtgggagagggtgtgggggacttttgggatagcattggaaatgtaaattcttacacgcgttcacgcgaccggccaggaaagacgcagcaaaccagaatcttctgcggcaaaactttattgcttacatcttcaggagcaagagtgcaaaccccccattgcttacatctttaggagccagagcgccagagcgccagagcgccagagcgccagagcgcctgagcgcagagccagagctctattgtttacatctttaggagcaagagagcaagcccaaacccaaaaaacgaaagtgaaaccccttccctcttaaggagagttatccttcgcctaggacgtatcactccctgattggctgcagcccatggccgagttgt

SEQ ID NO: 501 - DNA, 1200 bp, mus musculus
ataattaatatcttaatattatgtaattataatacattaattaataaatatgaattaacacataaaataatataattacaattattatgaaactataaaatatattttatttttatacatctcactaatattaaatgcaaacattcaattctcccaacaggaataatctgggataattagcagcactctagtgtgaaccaaagctaggggaaatcttagggtaggattagaagcagcaaggacagaaagcagggtcctgtggggtgcgatgaccacagtgaaagctctgcatgtcctaccatgaagtgacaactcttgagggttttgagcagggaagttatatgaccatagttctatctcatcatggtcataggtttgttgacatttaagttcaaggagaaagagtttcctgctgtttgtgttgctttagtttctccaagagcccagaagagtcacacctggatcgcttccctgccttcccttcaaatcctcagaggtcctcagtgccagcccagttttttggcttagtgggtacagctagggccagacatggatagtagttagggaatatgacaagattctaaggagaaggcatgatggtgtgtgtcagagaatctgaccatgacccacatttgagagttccctgagagcaaagtttggaacagaacaagtttctttcagcgtttagcactgatccgcatcagtaaacggggaagacttccttctagtatcaatgtccaggctgtgtctgacttgacctgcagagttaggaattcacaaacctgaaagtctttcatagcacctttgtctggttcatgcacacagagtgcattccaaggcctcctctgtgtttctgttactacagtatgcagaagatcaagacccaaggtgaacacatcacacagcaagcaagagagaacgcacttgcccttccacttggctacacagcatccctggctgcctgacatttttgtcatcacttggggcttgtttttctgattgagaaagatagatggactgtaaaggactagtgtgaggattaatagattacccaggaaattggagctcttacagctttatcagaaacacaagaagatgtcaggagttgcggcatattaaatatgtaaaatgtctgagatcagaactgggctctgccacagatcaaggtaaacagggctttggtgttaagctgttcactga

SEQ ID NO: 502 - DNA, 1200 bp, mus musculus
ggtcacggttgacaacaaactggctgacttttgacctcttcagagagtaggcggtccatgctttgacaggcacaacctaggggccccatttagtggtaccacatagcactcaccgtcttggtatactgggagggactacaatcttgggtggacctgagaaacctgtgctgacccttcatggccactgggtgcttgtgggtaggctggtccttctaggagatcaggagggcctaggccagcacatgtttgtcatgtccagtcctgggcaggcagtggacagactgcatgtggcctcatgtggcccaccctttccagtgggtcctggcttttgagatcttcatcccgcttgtcctcttcttcatcctgttgggactgcggcagaagaagcccaccatctctgtgaaggaaggtgaggtgcaggcatagcccgggcacgtgggtgggcagggagggagcagcgtcctttctgtgcacgagtccgcctgaggttctctgaggccacagccccaagtgcctgctccctatgtgatcctagccacacatggctaggtcatggaggtcatggctggccatggtgcccatgaatgatggagttgcctgtttctggagggccaggcgttcacctctgttctcctctgttctgttttgacctgtcccccaccccgcatggtctcttgtcctcctcggcccggcctgcatgcagtctgtaagtgagcagccatctcctccttgctggctcgggtggcagccacggatggcctggcaggtcctcctggtgcggcttaagcacccctactgcttgcattaacagccttctagcagctgggtcctgtagaagccactgcccgtggtcaggaaaggctggcttatgactcagggtggcgggctgtgatatgggtggtggtgatcagtgaagggccaggccatctgggtcatagctgatatcctgctcaagccactggagtaacttcttggcagggtatctgtgaggttgcctggccgtgctttataagggtggggttcctgggctgagcctgggctagcctgagatgagactgggatggccagtgactttcccttcagactccttagctgttgcacttactctgctaaccagttggcctgagaggtcagaggtcactgctaaggggggtgcctcctgtgctacctcggtctctgttggaaggggagatagttggg

SEQ ID NO: 503 - DNA, 1200 bp, mus musculus
cttttataaggagcactttacccatgttctgtaagtaaggccaaataaattcattggttctgcacagtgaactttgatttgtctttggggccttacccttatgaagaggggattggtattgtctccccagggaaagaattctcacaataggtgcagttttaggagggaatctgacactagggagctacagaaggtacagatagccgagctctggatgtcaaactcacaaattcacctgcctctgaatccccagtgctgggattgatggcgtgtgccaccacgcccagctatgcgaggtctattttaagactggcaagatttcatcattggaacgctcactgatatactggagcaatgggaagacctggtgctggataggacagcagagtgctggtgtcatacaattgggcagaagcctagcagagagggccttcctccttcctcagcatcaggaaagaaagcaggaggtgtaggggcaggaaggttgaccggggtgggtaccagctacttctgcactggtggcagagcaggggtactatgggttagatgcagaaaaagccgggacaattgtctggactgtatcccccccggacaggagctgaaacacgagcaagggcttgggcagagctactgagttggaccaggatagaaccatcaaaggatatgctggggtcattagtgacactggtccacatggctagcaggcaggtggagggtccagtaacacaaggtgccctgggcttaaggcacagcccggggtcacttgagaccagcagcagactgcacggaggaagacagacttgagcgtggaggaacagtagccatcctgggctgggtagagctgactgctgagaggctagtgagcttagcccttggcttaggcgctgagtttgttttcatttttcaggatcttccctcaaagccatttgatcaggcttctgcacagagctgctgtcttaacacgggaaggagcgctgcacccgaaggcaggctgtcctagcacctagaaccaactctactcttctctctattggagaagctatcaaaattctaaggagccatgaggaacagcttcctcttctgtccatccttgaatcctcagtcaggatccaatgaaagtacaaatcaaacagtgggaaatggcttacccccacccccacccccaccccaactagctcgcaaccacagcaggaggaagtc

SEQ ID NO: 504 - DNA, 1000 bp, mus musculus
cagagctgactgaggtgtggccctagcaactcctctcattcacaaggatgaactagggccaacactggagcaaacaggagctcggcatcttctcccaatactttccccagtgatgagagtctaccaccctcacacatgcctagagccaggaagtttagactgaggagagtccaggtgtatggctgctcttctagcctgagtgaattctggtatccagcatctttagggttaaaaaggagatgtctccatgctgctgaatgaacttgtaactgatcggccatcagattcataagaagacctgaggatagtcaggtctccagcctcgggtgattcccagagacaatttagaggatgccagttcctgcctggacatgaggtactacatgggtgacccatacccaagtctcagtggtactgtatatccctaactagggtcctgagggatttcaaggttaccatctccccagagctcctggatcactcctgaggtgtcactgaaccctggaatcccctgtttcctccggatccaggagtacccaggggctgcagcaaaggtggctggagagaagccgatgaggacactaagggatgacaccttggaatactgccagctcctgggggaggccagctaacagcctggtgccaggccgggcagcttgtgcgaaccgcctgcgaagcaagctggcggctggcggcgcttggcaggcagcgttgggggctgtttgcagactgccgccgacagcttcgcagctgaaattgccctgggtaaacagaggagtgcatcgtgcccacagaaactaggagggggcagggaacaggagatgtagagggctgttttagggtgactggagccttttgggaggcccttagtatctactggccctatctggatctgacttggtctctgggtcctggatctaagactggcacccagaaacccagcttcctgtctcaaggctatgaaccaggaaggttgatggggctaaggtgaccctttacc

SEQ ID NO: 505 - DNA, 1000 bp, mus musculus
gtccatgcagtggccattgtgcagacaggggctgctggcgcactcatccgtgttgatttcacagtatacaccttcataacctgtggacgggagatggtgagaccgaggacggcttcggtaggtccttctagagccccagctgaagacttgggagagaaataaccctccctcatacgggcctaatgtgcccactgtggttcatgtctatatctactgagtctatgcacccaactctgggtacattctccactttgtcctgttatcctggcctcggcttcccagatgctaccaaccatgacagaaatgttacttgaagctatgcagccttgactcattcccctgctgcctgctcttagcagcccccatggtgggaaatggcataagacatacctggcatacatatgcattggaactccccaatctggtccaggcaagtggcatcattctgacatgggttggagatgcactcattaacatcaatctcacagcggggtcccgtgtagccctgtagacactggcactcaaaagaacccagtgtgttgaggcatttgcctgcgtgctcacaagggttggcacctggtgaaagaggcacggatgagggctcatctggccttgcagcctcccgaccacccgcaatgccccagcccaggccatcaaaatggtggttctccaggacagatcacatcccatatatgtgacagccagcccgttcctgctgcctgtgccactgcatctgtacctacccagagcacactcatccacgtcctggctgcaggctggccctgtgtaccccgaggggcaggtgcagatggctttgccgttgacagggttggtgtcacagttggagccctcgttgcaggggttgctgatgcacgcatcgttgaggtggcacagcagacctagacaaggcagctgcggtgagtgggtgctgcttttccctatcctgggattaacaggttgttgcagcagggccatcctcacccaacaccctggaatgaat

SEQ ID NO: 506 - DNA, 1000 bp, mus musculus
ctaggactccatccagactagtcaggacccatagctgggagcttcttacagtaaggcagtgaactcctcaaatggacggcaaacaataagtcctcaactttgctgtcctgacagccatttccaaatcagctgtcctgtcacctgctgtaggccacaaggagccagtctccagagacaacttttcccacctacctgcctaccgctccattcccctcctacagcctgagatctgcaggccccacccctaccctacttcctccctctcccaagctgtcagctcacaataagcagctcccaagggctgtccctgcagtcacccttgtcctgggatgtctggagccagccttccttccacctcaaaactgcttcccacagccaaccaactgctcaccacccagcccctgtgcctcgggtactctgggtccttgtcgggaaccaagatacccacgttcacaaacgtatgcataggatggaaaacttgaggcaggcccagaaagggtaatccaactgctaaagtcacaacactggaagggtagggctagacctacccagaatcttgttcggattcccattccttccccacccccacccccgtctctgttccttcccctacttgaacctgtaaagggtagccccaacatctggtagaggccacttttattgccataagctaaagccttttgtagaatccctggtatgattttgagcaaatactccagtttgctgttcttagttccccctctgggaccacagtgtggacctctgcaaccttgcgctctgcattgagtggatagggaaatagggatcaggattcctgggcaaggggcaggggatattgctggagatagctttgggtggtaccagaagtctccatgggccctgagcccctttccccatttctccctactcttcctggtcaaaagcacatctgtccatccattcatccatctaagtagtatgcagctataatcctcactaagatggctcttgtgtgaggcaa

SEQ ID NO: 507 - DNA, 1000 bp, mus musculus
attcttgggtgcatgctgaacgggaattgagtgggggtttccccactaagttctttcactccctccccaatttcttcacccaccctcttccactttgcttctgagagggtgttccccaactcacccacccacccacccacccacccacccccttacccacacccaaaccctttaagcatccccctgttttggaacatcaagtttctacaggattaggtgcagcctcttgcagaggccagacaaacagttttctcctacatatgcaccagggcttagtctctgggaaacgtgaaggatctgggttagttgatactgttgttcttcctacggggttgcaatccccttcagctcctttaacccttcccctagttcttgaatagggatccccaggttcagtcaaatggttggctggagtgtctgcatttgtctcagtcagctactggtagagtctctcagaggacagccacgttaagcacctgtctgaaagcatgacatggcatcagtaatagtgtgaaggtttggtgcctgtgcataggatacatcccaacttgggctgttgattggcctttctttcagtctctactccatttttgtccctgcctttcctttacacaggaacaattctgagtcaaaaaatgcgaagatgggtgggtggctccatgcctcaactggggtccatgactacctattagaggtggtctcttcaggttccatctccccactgttgagtattttggctaaggtcatccccattgaggcctgagagcctctcacattccagatctctggaacattctagaggttcccctggaccctgcacctccccacaaacacactgctgaatattttcattcattttcctggccttctggacttttctcctgtctcccaccacacctggtcctgccctctctcctctctccctcccctctcccacccaggtccttttctccctctgcctctgatgattgctttgttccttcttttaaatgggagtgag

SEQ ID NO: 508 - DNA, 1200 bp, mus musculus
ctgtagaagtcaggatgaccttgctgaagttggttatctctttccactgtgtgggtcccaagggattaaactcagaacttcatgcttggcagaaggcacctttacccactgaaccatcctgccagcacctattgctaagacctttgaggatccattgaggtgtcatggcatgcaccttcagcttactgtgtgagctgtccagggttgctgtaacagaagacagtgaatcaaggggcaaaacacagagagcatttccttcaagctttggagagatctatcaagggagatctaacattaagtgccctacccaccgcccctgccacactctcctcttctcagctctccaactcatcacagatggggaggagactcctgtcttgccctcccactttctgggttcccaggcatgcctgacttgtaaatcatcactccaaattccatcttctcctggcttcaaagcctctggtcttcccctcctcctagcaagatttgtccttgggtccagggtttatcaggtccagcccttcactgtcacatctacaaagcctctttctaaacaaggccccattctgagttctaagaggacataaacttaccggtgaacgtcttccaggacagcccttacttaattaggcatttcctaggacctagcaggctctaggctccatgttggggactaccatcctgatacctttgatcaccttggctctactctgtggatggtaggtgatcgtgatggactgactgttcgcagaagtttcctagggtgccctggcccaggacagaggctgacatctgcttctacttaactgcctcacacgccaggatgatgtcatcgcagctcaggcctggggggagttggcgtctggccaccagtgacagctcaactgggagccctcaactaatgaggagggggccctggctgctctggcctgcatggaaatgttgtctctaagcccagaatggggcctcgtaggctctgaggcaatgtgtagggagagagcaggatcagtggaagggtagagttggctgctgtcctaggtgaaaatggggctggggtgaggggccactttggtgcatgttatgctagggctctggctgcacccaggatgcattctgggtgttgctaagcaggagccacaaaaggaagctccttccccgccatggatccatctttctgttgcctgctgagagcgaatg

SEQ ID NO: 509 - DNA, 1000 bp, mus musculus
tcagtacatgtgtgtgtcaccacccccaacccctgccctcaacaggttgtgcctcttggaagcccagttgctcatttgtggttactagactttccttgcaaagtgcacactgtctttctacgtgatcaaaatgacatccagtgtcaccaatgtcaccttgccaccacgagccaagacattttctgttacgtgagtagtccagtgggggaaactgaggtagctggagattctccattcctgagtgcaagcaggaacaagatgccagacagctcgctgcccctgctgcttggcacccatcccagatttcccgcagactccaagcctgcttgctgtgtatcaggtatccagtggataacaaaacaaacccagacatttctaggcagtccacggagaccccagacatgcaaagtgtccgccgcctctgctctgaccagagtttctggaagcatctcctctttggggagggaggggggcaaggggtggggaagagacctcagagagacatgaaactgcgaggctctcagctgtgaaattgccctggacaggttttccctagaagcccagcctgcctctcccggcaggaagccccgctgtagcatctgggtagcccctggcgtggctggtgctgcagtcaagccactctcaggccttcccaaaggcaggggtggctggaagccccttttcctctgggagtgtccccagctgatggaagcatcgttgcatggttctcgagggggggcccctgaagcctgagctgctgaggcctccttacctacaaacccagctcaggggcacagggggcagctaaggagctcagcaccagccagccctgggagcctgcaactccacacttgtctgtattgctcggggagtgccattgtggcagcaaggggcagtgggtgacagaaatcactgagtgcagagggacctggccaggctggagctgaggagcgtggggcctgagaacagagaggtcatcgcagccacgcgcagggatcca

SEQ ID NO: 510 - DNA, 1000 bp, mus musculus
atctgtctttaacaggtctcctgctaagcactgtgctatgcgctgagatggtttaggaagccagagtgaagcacgttctcccagcgggagtttaccggccacaaactgaaacactcataaatctatcacaaagcgaaaaatctctaaaatccaaagactagaggagtataaggtttcagactttggttttaaaataatagggggttggggacaacagccaacacctgttgacagtctcctgcaaggcctcacctgggaaggggagaaacggctcaggcaacaaaaacagctattcctgggtcaaagtgacaacccaaaaaatgccacagacacaagcaatgcctggtggagagagctggaagacagcgtggactcagtggagaagggctttctggggaagggatgccagagattttgtccctgtaggctcctgggagtaggatggtttccactactcaaatgccccacaaccatctctaaacaacccagtagggttcacagtgttctacggatggggacacagtggctcagagggtgttgcccaaggtcacagagctaaagaaaatggctggactgccaatgaaaccatgctctttctacgacaacatgttacccaaggaactgcacaaacacaaaagtgttcacttctgtccaagccacccatttgatcaatacgacgccagcctaccagcctatatgatgagtttccctcatgggccatccccagccctcacagagcataatgcactagacaagccaaaaaaaccaaaacaaaatctgtcatagaagtctaaggaatctcaactccccgagttcccgcggcgtagctttaaagtgcgcgcagctcggcggcatatggcaaatcaattactagtttaaatcttaaaacaaaaacatggcaaatgcagcacggaaataatcaggtacaatggtgcagctcggattacagcggccactggagttttgaatacaattaatcatcgttccaggcaatgggaag

SEQ ID NO: 511 - DNA, 1200 bp, mus musculus
ggcagccaaatgacaggccatcagtctctgcccagacactctcttcacagttctagcccggatgccactccacccgatggtcacccccagcaccgggtcaggaagggaggtggcccagggaaggggctgcagtgggaggtgcggagtccggaaggccagaggaacagtcttcaacctgtgaatctgaccgtgcctggcccacagcctccctgccccagccagtgtccccggatgcactgatgcacgctgaccccaccccgaaacctctgggacagattgtcaccttcacgtgctgtgtagagtcggaattgagggtcctggacaggaagccaaggttaaaagctacatggctactttcctgttggagtgtgtcaagtctctctgtgcgtgaaagctatttaatccacttggcacgataagacgaagggaagctgaaaggaagacacccctgaaccagagaccccagtcacatgtcccacgttgcactcctgaggaagccctgccagcccccctaccccacccccacctgccggaggcaaccaagccaggagtcaaggtctccgggtaaaacttattgtttgtacttcctagaaaatggctctttttccaaagccttgttccatccgccctttctaaagcaccgtgtgcttttgtgcccatctgggaggtaggctagtttgcctgtttattaaggtcccatttgaagcctagaatgtcaagtcatctttcccaaggtcactgttaggaagaaaaggaatcaggacttgaacacatggcttcacacaccaagcggcgatcccctggcctggctccctgcccattgctacctcgttgaggggtaggctttcatgccagagacaccctggttgtccctagtcctgcgtccagagctatgagatcacgtaggtgtagagacctgaggaccaggctgccttggagacatctgtccggagatcctgtcaggatccaaccttctcactgttgaaactttacttacatcttggttactcatttaatgtggggcaataaacagctgtgtgacccccctcctcccaaaaagtcattcaccctctctgggcttctgtttcttcactacttttaagggctgagttctaacttcagtacccaactataacccagccccgtggtgtgtggagacaggaggattctttggggcttgccccacagttaagtctagct

SEQ ID NO: 512 - DNA, 1400 bp, mus musculus
ctcagggaatcctggagatagaaaacttaggaaattgaatagaaacaagagattaaagcatcaccaacagaatatgtaagaaagaaaagaaaaatctcaggtgtagaagatacaatggaagaaactgatatatgagtcaaagaaaatgttatattttaaaagttcatgacacaaaatgtccagaacatctgataccatgaaaagacctagcctaaaaataataggaatagaaaaagttgaagaaacccagctccaaggtatagaaaatattttcaacaacatcataaaagaaaactttctcaacctaaagaaggaagtgccttacagaacaccaatttgactggaccagaaatgaaaatgctcttgacatataataataaaaacatgatggtcagctccagatcctggtccccttgggcacgaactctgcagatagtttcacagtccacagaggactctccacgagatcttaggatcactggtgaggagaacacaacataggttccaatccaattgtgacaggcctgtgacagcaggagcaaggacacaggagacctgcctgaccagcagcttgcattcctactgatcagtactggtataccttggttttgaacacactaggcagccaccccaatcctcagaggacacacaattacagaccctgtaacacacccaggatcttaggattccaggatcccaggatagcagaagcttggtcaaacaggatctcagggtctcagaggaagcttgactgccaggaaatcagatacacccagaatctcaggttcacaggagcccggagtcacaggatcaaagagaaagctggactctgaggagtcctgaatcaacccgaattataggaaggacaggctccaatcagatatattgagggcagcaagcacttgagataatcagatggcaggaggcaagcataagaacataagaaacagaaaccaaggttacttggcatcatcagaagcaaactctcccaccataagaagtcctggatacaccatcacaccagaaaagcaagacatagatgtaaagtcacttctcatgatgataatggaggactttaagaaggaaatacaggaatacacgggtaaacagcttgcagtccttaaagagaaagcacaaaaatctcttagagagttacaggaaaacactttcaagcaattgaaagaattggacaaaaccatccagaatctaaaaatagaagtagaaagaattaaaaaaaatcacaaagggggacaactctggagatagaaatcctaggaaagaaataaggaaacataaatgtgagcatcaacaacaaaatacaagagatggaagagaaaatctcaggtgcagaagattccatagaaaacatggacagaacaatcaaagaaaatgcaaaatgc

SEQ ID NO: 513 - DNA, 1200 bp, mus musculus
gtagattttttttcctcccactatatcacaattgactttcaggtttaacacttaaaactaaatatttaaatgaagtctttaaaaatttaaagacaacatgccacacctgcaagaataagaagtaggccaggaacttgtaaacttttccactctttctgttctctaagaaagacaccccttgttcaaacatatgccatgcctgccaaaatatcaaatatactgtcctcccaaggacctccttctctctctctatcagtgtcacctctccttgacactatccacaaatcccccttcttctttttctttgatactagcccacaatgtggatggagacctcatgctcaacaatagaccatgtctagcaccagaagtctatcccccaagtctggtggagactccctactcaaccacagagctcacagactagaagaccagaacaggagaagcaaaaacccgccaaacaaagacaaatatagaaactgtcacctagacctataatcaccccaaacctggattctgaaatgtcagcataagaacacaatcaaccaccaggcatggtggcgcacacttttaatcccagcactagagagccagaggcaggcagatttctgagtttgaggccagcctggtctacaaagtgaattccaggacagccagggctatacagagaaaccctgtatcaaaaaaccaacacacacacacacacacacacaaaaccaaccacagtggtggaaataggtccatcccagagcacatctattctactacaataaacccaaaatatttcaacagagctgaggcacaataaaaagaccttaaatccaaatttataaagaggttagagatgcttaaataagaagcaaataaattgcttaaaggaaaatataagctgaaaaatgaagaatattaataaatcctctaaagaaaaatctagaaaaaaccaaacagttgaaagaaatgaataaaattgatgaagacctgaagtaaaaataaagcaataaagaaaacacaaaatgagggaattctggtaaaaagaaatctatgtaaacaaagagcaagcaaataggagcatgagtaacagaatacaagagataaaagtgataatcttggaagaagatatggtagaagaaatagatacatcaatcaaagacactgttaaatttaaaatgttcactacaaaatacccagtaaatctaggac

SEQ ID NO: 514 - DNA, 1200 bp, mus musculus
cggatccaagatggctaccactgatgctgaggcaaagccctcctgggctgggcagactcctaacctctggccgggaaggtggccggatctatttatattttccttaaaggactctattatcttcatgagataggattttaggtcagcttcctgatttttcaggtatattggtatattcagagctcactctggtgggagaacttgcctctgataatgcccacaaatgttgacttctgttgttcatgttcttatgcttgcctctcaccatctggttatccctggtgtttggtggtctgggtaactctgtctggagtctgccttttttgtccctgagatgtttctggcctcttagtaggccttcagacctggctgtagaagaccacccatgggaccttccaactgtggtcttttcagaggagcagagaagctcctgaactgttgctctggcttcagtagatcatctggaaggcctttagactcttgagtcttcagaggagcagctaagttgctgtactttgtgaaaatattttccaggggttctatggactgtggtttctttttccctgtgtgcagcagaaccccaggaggctttaagtctgtctagtcagttgccctgcatgtcacagagttcctgagaggtcttcagactgtggtgtctattgcccagttgctctgtgtacagaggagctcttgggatgcctttaagatgtggtgtcttcaggggagaagctaggctggtgatcagttgctcagttgccctgtgtgcaactgatctgggatgcctcaggctgtggtgtcagatgctgtgttgctctgagtgcagcagatcttctgggatgtctcaggatatggtatcctcaggggagcagaccaggtagcagtctgccccagcagaaagtaccaggcagaagggtagtggtattcagcgtgtgttcccagagtgtgttgagtcccaagtccactgggctcccagtggcagctctgggagtttggggtggagatgggggggcatttcttgccaactgttctgagtgcagcagatcttctgggatggctcagaatatggtgttttcaggacagcagactggctagcagtctgccccaacagtaaggactgggcagaagggaaattttaattttttttaaaaagaataggcaatcctaaattccatatagaaccacaaaagaccctgaatgtct

SEQ ID NO: 515 - DNA, 1000 bp, mus musculus
ctcaagaagaagaaagaccaaagtatcgatacttcactccttcttagaatggggaacaaaatacccatggaaggagttacaaagacaacgtttggagctgagatggaagggaggaccatacagagacttccccgcctagggatccataccataatccgccacaaaacgcagacactattgcatatcgagcaagattttgctaacatgaccctgatatatctgtctcttgtgaggctatgttagtgcctggcaaatacagaagtggatgctcacagtcatctattggatggaatacagggcccccaatggaggaactagaaaaagttcccaatgagctgaagggatctataaccctacaagaggaacagcaatatgaactaaccattaccccctgagctcttgtctctagcttcatatgtagcagaacatgtcctagtcggccatcattaggaggagaggcccttggtcctgaaaaaattatatgcccaatacagggggaatgtcagggccaggaaggagtggatgggttggggagcagggcgggggtagggtataggggactttcaggatagcatttgaaatgtaaataaagacaatatctaataaaaatgcttaaaaaatagaaattaaaaatgtgtggcactattatgaggtgtggccttttttgaggaggacttccttgctggaggaagtgtggcattgtataagtgggctatgaggtctcttatgcttaggctttacccagggctgaagagatcctcctcttcgctgaccattgaagataatcgcctttggttgcctttggatcaagatgtagaactctcagcttcttttccagcaccatgtctgcctgtaggctgtcacgcttcctaccacaatgataatagactgaacctctgaaactctaagccaggcccaattaagtgcttacttctataagaattgctatgatcatggtgtctcttcataccctaactaagaaagtagggtaaataatttt

SEQ ID NO: 516 - DNA, 1600 bp, mus musculus
gtataaaatacatagatgtattatatacatatatatgtatattatatatacatatacagatagcactgagaactccaacataaaagcaacagaagtttctaccaataaaagaacaactttcattgtctaatttaggaagcagtttagactttttcaacttgtagggtctttgatgttactgttgtttttatttttaatataatttcttcaactaaacatatttttaaatcctaatgaatggcattgagatttcattgcaggccagaggataggagaaacattgtcttgatcaatttgtccacaccatttccaaccatattaagagacaggaaaatgaacagcagcagcacttcagacttcatcttgctgggtctctctaccaatccctggatgcagaaacccctttttggcatcttcatcataatgtacctggtcacagtgatggggaatgtgctcatcatcctggtcatccgctctgactccaggctccatacacccatgtacttcttcctcagcaacttgtcattcatggatatctgcttcacaacagtcattgtacccaagatgctagtgaactttctctcagagacaaagactatctcctatgtgggatgcctagttcagatgtacttcttcatagcattagcaaacacggatagctacctgctggcctccatggccattgatcgactggtggccatctgcaaccctttacattatgatgtggtgatgaggtcacaacgctgcctcctcatgttgctgggttcttgcaccatctcccatctgcatgcactgttccgtgtccttctcatgtctcgcctctcattctgtgcttcccatgtcattaagcactttttctgtgatactcagcctgtgttgaagctgtcctgctctgacacatcctccagccagattgtggtaatgactgagacactggctgtcattgtcactcccttcctatgcatactcttctcctacatgaaaatcattgtcactgtgctcaggattccctctgcagctggaaaatggaaagccttctctacttgtggctcccacctcactgtagtggccctgttctatgggagtgtcatctatgtctactttaggcctctgtccatgtactcagtggtgaaggaccggatagccactgttatgtatacagtagtgacacctatgatgaatcctttcatctatagcctgaggaacaaagatatgaagagaggtttaaggaagttaagggacaggcttcactcatagaagtgcaaaagtatgaaacatataactgcaagatgacctaagacattttcaggctatacttcctttctctacatctctgtatcatacactatgaagttatgttaaccaccaacatcactgatctgaaagcatgacagtgttctataaattatcttgaccaagtacatgttcattctcatactgtgtactacagtaatccaaatctcagaattttgtcaaactcaatagattggtaattaaaccttcaataagcatgtccaagttctcacacataggaattttaaattgaccagtgttaagtagagtaaattaagtgatcttagtggaaaattgagaatgattt

SEQ ID NO: 517 - DNA, 1000 bp, mus musculus
atgtatttctctgtcaattcttagaaaatatgtttcaaactcatgacaaatggtgataagggttttttaaacagacttggagttaggggagaagttattcagatgaaaattcctctcacatctttcctacaacttctccaaaatttatcctgagacagagacatgaacaaccacagcagcagcagcagcagcacctcagacttcatcttgctgggtctctctaccaatccctggatgcagaaacccctttttggcatcttcatcataatgtacctggtcacagtgatggggaatgtgctcatcatcctggtcatccgctctgattccaggctccatacacccatgtacttcttccttagcaacttgtcattcatggatatctgcttcacaacagtcattgtacccaagatgctagtgaactttctctcagagacaaagactatctcctatgtgggatgcctagttcagatgtacttcttcatggccttagggaacactgatagctacctgctagcctccatggccattgaccgactggtggccatctgcaaccctttacattatgatgtggtgatgaggccacaacgctgcctcctcatgttgctgggttcttgcaccatctcccatctgcatgcactgttccgtgtccttctcatgtctcgcctctcattctgtgcttcccatgtcattaagcactttttctgtgatactcagcctgtgttgaagctgtcctgctctgacacatcctccagccagattgtggtcatgactgagaccctggctgtcattgtcactcccttcctatgcatactcttctcctacatgagaatcattgtcactgtgctcaggattccctctgcagctggaaaatggaaagccttctctacttgtggctcccacctcactgtagtggtcctgttctatgggagtatcatctatgtctactttaggcctctgtccatgtactcagtggtgaaggaccgggtagctactgttatgt

SEQ ID NO: 518 - DNA, 1200 bp, mus musculus
gatgggtactccacaagtggacaggaggccacacacggcacattgctactctagtttatttaatgttaatgcagtgatgggggtggtattaaaagtgatttagttatagggtcagtaagatggctcagtgggttaagtcacttactgtcaagtctgacagtctgaatttgatccctgagacctacatggtgaaaagagaaaactgactcctggaaagagctttatttacaagcgatgactggggaaggcagaatgtcagctaccttaattttactggccatatattatctggtttcaggatagagtctccctaggctccaagtaggagctggtagttgggtttatgaacactgaacatgtttgctttagaagaggtacacagtaacaactattcctgcagatgggttatctcacatgccaaggctcttatcccgaggctctccagaccctgcctgcctgtctaggctgcctccaagcttcctcttccaccccaacaagcacaggtgtctcctctctgggatgctgcttcaggcttgcttcacctcttcctgctatctccccacctgagagggactgtgaatattactttagcttccatctatcctacctctgtgacaagctctaaggctgtttctagggtatgccaaccctcaacgtctctccagccaccactcctgcataccagaagtctcctttcctgccagctgctcccagcttcctgcaagctgtaccccaggctatgtgttagtccattcggctcatgccatcctctttttctggcatctttatgaatcatcctcttttctgtatcaggctaaccactcctcatcctacaggtaaagtttagcatcatgacctccacaaaactttcctttttcatacacttttgggtcttcctctgaactcccgagggccctaagcttacttctatcacaccacactatcaggtacctgtctattcctgttttctctcaaggacacgagctctttacaggggtaaactgtcttcctgggtccagcgctctcttactcagcacaagacgtggtgtacaaagtaagactaaacacagggtgtgttgaatgaactgtccattctcttttatgggaatgagtctcatgaaatgaagtggctttcagtaaagcgaaagaacaccaacagtgctaacaagagacccacatggtccctgaattcttcctata

SEQ ID NO: 519 - DNA, 1000 bp, mus musculus
gggctcactgtggtgggagaactggattctgaagatgtcaagtagctttggtttctgttgcttatgttcttgctcttgcctctcgccatctgatgttagctggtcttgctgtctctgactgtggcttgtctctcctgcaagcctgtgtgccagtacacctgagagaccagttctcttctggaggaatttgggtatggagagttgtggttcagggtcagctttggggtacagatggaaaccagaaggatcctgtccccagattttccttggtttctgtgtcctgatggctctaggtgggtcccacttgggccaggaatttgaacagaagtggtgtcttacctgtgttcacaggtgtgttagcactcctgggagaccagctctctcctgacattatttttatatgtatctctgtggcacaggatcagctctgggggcagatggaaacctgaaggattctgtcccaggctgctccttgatccctgtgtcctgaggtctctgggcagcttcctttgagcagaagtaatggtcttacctgtgctcacgggtttgttcccactcctgggagaccagctctcttccagccatatttgggtttggagtgctgtggcacaggatcagcattcagtgctcttaaacactgatccatctctctagccagcctctcatattttgaggcagggtctcatatagaaaagctaagctctaattcatatatatctgaaactctctttgaaattttcatgcttctttctttactagcagtgctgggatgacaagtgattgccaccacacctggcccattttgtggcatgactgaattatcaaccaggcactgctcctgcatacaggcttactgtgatttttgtagttttagcctttataaactgacagagaaagatgttcataagttgtagcctcaaccctgaattctgagctacagccctgatcaatcagttttaggtgtcagtaagccactcttgtttgactgaggttggtgttt

SEQ ID NO: 520 - DNA, 1000 bp, mus musculus
actaaatcaatttcagagagtacttatatacagtttgaacccatgaaaatccactatgtttcagaggacagaaatattgagtgtgttctttaaaaaaaaaaatatgggcggtcctttcagagctccatcttccttctgatctacacctgtacatgcaaccacagatttgcaccccattccctagcccacatctctgtctgcctcctaggaggttttctctaatttgggaaacacaggacaaacagctccactctcccatccatacctatttctgcaattgaggatctgtactccataccccagtccacagctctgcttgcattttgtggggcctgctgtcatctgggagaaccaatcccagaagattgctattcccagggactactaggccagccaacaccatcgacaaccagatggctaaaggcaagtgtaagaacaaaatcaatagaaccccagtacaatatggtacattaaagctcagctcttttactatagcaagttctggatatactaacacacccgaagagcaaggctatagtattcaatctcatcttatgaatatgatagaggtttttaatgaggaaataaataaatctcttaaagaaatacaggaaaacatattcaaaccgatagaaccctttaaagaagaaacaaataaattccttaaagaactactggaacatacaatgaaacatgtgaagaaaacgaataaaactgttcaagacctaaagatggaaatagaagcaacaaagaagatagaattggaggcaaccctggagactgaaaacctaggaaagagaacagaaactatagacacaagtatcattaacagaatacaagagatggaacagaaaatctcaggaatagaagatacaataaaagaaatagatacatctatcaaagaaaatgccaaatctgaaaagtttctaactcaaaacatccaggaaatttgcaaagctatgaaaatatcaaacctaggaataataggatagaagagggt

SEQ ID NO: 521 - DNA, 1000 bp, mus musculus
ccacatttccacgaaattaagcacatcctctcctacttaggccataccaggcagtcctctgttacacatgtgcctggggccatgaactagtccatgtatgctccttggtttttggtttagtctctgggaggtcttaggggtccaggttagttgacactgtttttcttccttctctttagctccttaaatccttcccctaggctcttccatattggtccccaatctcaatccagtggttggctgtaagtatctgcatttgtttcagcaatttcttggcaaagcctctctgaggatagccatgccaggctcctgtctgcatgctcaatatggcctcagcaaatcaaagtatgcagcagtcaggggttagggggcagggggaacctttagaaagtcccagagacctgggctgtgacaggcttccaggactcaatggggatgacattagccaaaatgcccaatagtggggagatagaacaaatggtggaggtttcttaaatcttaaaaaacagaaagactatatgagcatgctgtacaactcctaccacagagatcttggcataaccatgtttttctcagattacttagagtagccaagatagagaagtagctgaagtatgaatagatgaggaaactgttatgtgaaacaatgggatcttactcagccacagataaaaaataaaatcattgcttttgcagaaaaataggtggagctggaaaccattgtctcaagcaaaccctaaaagcaaataatgaaagttttaggtcatacatagctacttgattttacttttaatacatgttagtggtcatctagaaagtggatcataagaaggggaaaataattttttatattttgttttttcaagatagggtttttctgtgtaacagcttaggttgttctggaactcaccctgaagaccaggctggtctcagactcacagagacccacctgcctctgcctcctgagtgctgggattaaagacatgtccaaccatgcttg

SEQ ID NO: 522 - DNA, 1000 bp, mus musculus
tttctcttctgataaccccctatactatcctccctcaccctgcttcaatgagggtgctcctttcatctcccccccccccattcccacttccctgtcctggcattcccctgcaatggggcactcacagagccaagggcctctcctcccattgatgtaacacaaggccatactctgctacatatgtggctggagccatgggtctctccatgtgtactctttggttggttggtggttcaatccctgggagctttggggggaggagagagggtctaggtggttcatattgttgctcctcctatggggctgcaaacctcttcagctctttcagtcctttccctaacatctccattgggggccccatgctcagtccaatggttagctgagagcatccacctctgtatttgtcaggctctgacagagcctctcaggagacagctatatcaggctcctgtcagcacacacttgttggcatccacaatagtgtttctatttggtgactgtatatgggattgatccccaggtggggcagcctctgaacagcctttcctttggtctctgctccacattttgtctctgtaactcctctcatgggtattttgttcccccttctaagaaggatcaaaggatacacactttggtctaccttcttcttgtgttttatgtggtttgcaaattgaatcttgggtattccgagcttctcagctaatatccacttatcagtaagtgcatatcatgtacgctcttttttttaaaaatatttttattaggtattttcctcatttacatttccaatgctatcccaaaagtcccccataccctccccccaagtcccctacccacccactcccactttttggccccggcattcccctgtactggggcatatacagtttgcatgtccaatgggtctctctttccagtgatggccgactaggccatcttttgatacatatgcagctagagtcaagagctcaggggtactggttagttcataatgttg

SEQ ID NO: 523 - DNA, 1000 bp, mus musculus
gaaagatggggggaacatgggttgccatgatgctgtttgtattctgatcttaattttgattcctcaagaggggttgccccccatgagtagtctatcatgtactcaggtgatctcatgtgaatcttctccccattttaactggtcaataaaggctagagactgtgtttgggcagtggagggggaaggtgggactggaggatcaacagggggccaggtagagaaggggaggaaaacaataggggaaggagaggtcagaggaagagaaggaagaagcagcaatggaccagaaccacgtgaccaggagaaacttcaagtggcaaagggtcatatagctggggaataagttagtatagtgtttgattgtcctaatctaggcatatagcttataattataataactgtattatgtgttttttatatgggcttattggggttggaaaatccaactacaaatatcctccttccctggggcaccaagtccagttgtctgctacatatctgctgggggcctcagaccagccaatgtatgcttttttgttggtggtttagtctctgggagctcccagggttccaggttagttgacatggtaggtcttcctatgggttaccatccccttcagtcccttcaacccttcccctaactcttccataggggttcctgactttaatcaaatggttggctataagtatatgtatctgtctcagtcagctgttggtagagcctctcagaaaacagacacactagactcctgtctgcaaccacaacatagcatcagtaatagtgtcagggtttggtgcccacacatgggatggatcccaagttgggtcagtcactggtcagccattacttcagtctctgctccattttggtgcctgcatttattttagacaggagcaagtttggattgaaaatttttgatggtgggttgctgtccccatctcaccactactaactatctaactactagaggtagtatcttcaggttccatctccccactg

SEQ ID NO: 524 - DNA, 1000 bp, mus musculus
caaattccttcctttccaatttaaatctcattgatctttagttgttttattgttttacctagaacttcaggtgctatattgaatagatatggagaaagtggacaactgtggggcagaagacagtaccactggacaaaaaacttggcaaagtcaagcagattcagaaaccccagaaattctcataactgagaatgatagacatttaaatctacttctgaccaggttcctgtcctggaacacatgaccacaagaccccgtggagaggactgtgacaggacatgtcatgtcacccaaaacccttccacatgcatataaggcatccttaatatctcagaccaagtcaatagaaaacattgcatttagacccctatcctccctaatgtgtataagaccgtatccacaagggaaaaaatacatgagttatttcaccaaaggtcacctgggaatgtctttcttatagagctgtaacactttgtggaagagaattttctcctgaagtgtcccatcccccgcccccccccaatcccccgtgcaatcggcttgagcctactacagatgtttcccactcagtaccctgaccttggctcctagctgcccactgcaccctgcagccccagagcagtagcagctttgctctggttcctcttccctctccccaggttgaactgtaattctttggtcaatcaagccatgctagagcaccacagagagcagacagcatcaggtattcccactgaccaggcccagtatcacagaccggcagacaatcttgtcttatcctttattttagaggaattgctttgagtttctccccatttaatttgatgttggccataggcttgctgtaaattgtgtttattatatttagaaatgttagtttaatccctaatttctccaagacttttatcatgaaagcatgttggatattatctaagttttatattagcatctaatgagatgatcatgcattttctctttcagattgtttacatagtgtttt

SEQ ID NO: 525 - DNA, 1400 bp, mus musculus
tgtgttctcattgaagcataactacaaggtgctgagtgatgatggttctggagcaacacaaagtatctttttgttaccatccgcacaaaagaatctagaaggtaacagagctaacatagttctgttgcataagcacctcaaccctgatgtcatttaatagtaaatgaagtcaatggtgatgcttcagtcctacattcacaatactcctctgggatgctgaagttaaagaattaagaacgtgaaactaggggcacaaactcggtggacggtcccaagtttcccagaggactatccaggcagcaggtgccctagcacacccaggatcttgggatcactggtgagtagaacgcaacttctattccaaaacaacccagaggggcttgtgccagcaggaacaaggacacaggaaacctgactgatgagcagctgggattcattctggtaagcaccagccccatgccaccctgggcacgaactcggcagatggtcccacagtccccagaggactctccactccgcaggcaccttagcacacccaggatcttaggatcactaaggagagtcagcgtcttgagagggctctgaccctgggactcaggtgtaagttccatcttgtatctggggtctctcagaaaccagtctgcacaggagatcacatgggtctaagaagcaacaaagcatcatggacagggtccttagggccttcatcctcagccaggaggcagagctaagacccagacctctgggcacctttcccgccagaggaaagtcagcctccaaggaggaccatcttgtatcccaagtctctcacagaccagtccatgcaggaaagcacaagggtcacagatgcaacagacttcttggacagggtctcttcaagccttcatcttcagacaggagtcaaatctgactccagacctctgggtgcctaccctgcaacaggagagcttgcctgcagagagtgctttgaccactggaactcaggagagagttgggctcccaggaatgctgacagaggctaacagaatcataggaggaacacgcttcagccagagacagctagaacatctaacatcagagattaccagatggtgaaaggcaaagataaaaatcttactaacagaatccaaaaccatttggcatcatcagaacccagtatgcccaccacagtgagacctggataccccaacacatccgaaaagcaagattcagatttaaaatcgtatcttaagatgctggtagaggtttttaagaaaggcattaataacttacttaaagaaatacaggagaacactcctaaacaggtagaagcccttaaagaggaagcacaaaaatccctcaaataattatatgaaaacactcctaaacaggtagaagaccttaaagaggaagcaaaaatc

SEQ ID NO: 526 - DNA, 1200 bp, mus musculus
acatctgactagcaagaatgatgaatgctgtttccttctagagcttatggtaaatatagggatactcatattgagaggtttggtatattcatttatcagaaaacatccataggtagtttgattgatgtttgtgtggcactaatcttcattaagatcaatctcacgagaagctgacaacttctgggacaggcgggagccacagagcttctgaggcagtgcctttttcaggccccagacatccggtcaccctcccggccagaggataggtgtcctcccggccagggagccctttgcctcaggattggcaagagccatcttggttccaggactccacccaacttagtctgcacaggtgagagtgtgcaccacagaagctgacagcttctgggacaggcgggagctacagagcttctgaggcaaaccccttttcgggtcccagacatccagccaccctcttggccagagaacagttgtccacccggctagggagccctttggctcaggatctgcaggagccatcttggttcctggactctgcccaaagtaatctgcacaggtgagagtgtgcaccacagaagctgacagcttctgggacaggacaaagcaacacagcttctggaaaaggtcctgttttgggccttcatcttaagccaggaggaggtccaaatgccagatatctgtgcaccttccctgtaagaggagagcttgcctgcagagagtgctctgaccactgaaactcagaggagagagctaatctcccaggtctgctgatagacagtaacagaatcaccagaggaacaatctctaaacagagacaaatataacaactaactccagagattaccagatggcaaaaggtaaatgtaagaatctgactaacagaaaccaagaccactcaccatcatcagaacccagcactcccactacacccagtccagggcatcccaacacacccgaaaagctagacccggatttaacagcatatctcatgatgatggtagaggacattaagaaggacattaataactcagttaaagaaatacaggagaacactgctaaacaggtagaaacattaaagaggaagcccaaaaatcccttaaagaattgcaggaaaacacaatcaatcaggtgatggaattgaataaaactatccaagacttaaaaagggaagtagacacaataaagaaaacccaaagtgag

SEQ ID NO: 527 - DNA, 1400 bp, mus musculus
cattttccacattgactttgtcttataaaattgttctatttcttgtctttgacttataaatttgttctatttcttgatgaaaattgtaaataaaataagagcaacttcttcacgtgttccactatgttcatagcagccttatttgtgtagccagaagttggaaacaacccagatgtcccacgacagaagaatggatacagaaaatgtagtttacttacacaatggaatactactcagctattaagaatgagaacatcctgagttttgtggggaaatgaatggaagtagaaaatatcatcctgagtgaggtaactcagtcccaatggacatgcatggtatgtactcactaataagtggatattagcttaaaaaataaatacagaatacccaagatacagtccacagaactcaaaaaggtcatcaagctgatggacccacgtgaggatgcctcagtccctcttgggagggagaagaaagtaatcacaagttgggagggagggagggacctgggagggaacctgatttggtatcgagggaaagaactgaagctctgagaggcaatagaaagaatggaaacaggcaacctcaggaggtaggaggttgggggcaccctccagaatgcaccagagacctgggtagtgagagactcttaggactcaaaaggaaggaccttatatgaaaggccatacactagagagaaggaacttataaagcccacctccagcaaaaaggcagcatcaaatgagagatgagtttgtcatcccacagtcaaaactctcacccataagtgtttctgtctgaaagaactacatggatggaaatggagaggagcctgaggaaaagaaggtccagtgacaggcccaaaatggcatccagctcaaggggagattccaaggcctgacactattactaatgctatggagtgcccaggaaaagggaccaagcatgaccacactccagcagacccagcaagcagatgaaagagtcagatgcagatattttcacctaaccaatgcaaagaagctgcatagagttacattttgctagataggtcaagatttcaaatactattaagctcagaaaggaatcccatttcaatagcttcctaaattgtctgtcttgagtacaagttaattacttctgtcactggtgtgagtctaggattattaattcccattaacctatgatagtaaacatatttgagaattccttactttaccagcgtgaatatttctttagcagtgaaactactgatttataaggtatgtctatctttcaattttttagaatttgatgaatatgcttttctaagaagtacacttaaaatcacacaaaatacaattgttcttcccagagacaaacattcttttacctgaaaaaaaaagaattagaaactaaag

SEQ ID NO: 528 - DNA, 1000 bp, mus musculus
gtgacttcttcctgcatgggatagcaggtgttcagccatacctcctgggcccctggctcctgtcacagctaaagcctctcatagccccctccctaccacacgcaaagaggtttgtgaccatcaatcatgtaggcaatgctccaagctcctggtattctgtctggactccaccccacagttacttggcaatagctaggtaggcccagccaactatagagagctccttgcccccattctctctttcttactcttttgctcctgtctctcccactcttgccttcttgcttcccctctctccccattcccttctcccctctttccacgtggtcatggctgacctctacttttctacttttctccctttctctgccttcctacaataaatgccttaaaaccacggactatctctgctcatagggacccaccatgctgtagcaatggagcaggtcttctaatgagctgcgcttctaaactgcaatgaggcccccctgtactccaactagccggagctctctcttccttgcccttttctcttttggcccctggccagagtctgcccgtgcgcccccacctgtttttagctcttctgtgacactcagcagtgtatgaggtgtctaagacagagaacctgacatccctggcctctgtgtgacccaggaaccccagaacctgcttttccacggcatccagcagcatctgtagtgcccaagagtctgagcccaactccagcatgaccgccggggcctcatactgctccttccctagacccgacacaggttcttacagccccatgtctacctggaggtttcgtgggggtgcgcttagtcaaactttgcgtgtccagccttgcccaatagcctagccctgagcagaaagaaccccatttttgacccacagtcattaatgtggtgaatgggctttacaattgggcaagattgagattaatcttgtcctgcactatgcttagcaactttcagcactatgaaccctggccatttga

SEQ ID NO: 529 - DNA, 1000 bp, mus musculus
cctgatgtgaagttctctaaagttgtgtgctgttgcaatcaaacctggcctcattattccttagataatcaatctaaatatggccaactagcagtactctcaatcccaatattatctggtacctttactttatctaagggaacagaaaagagattctccatgccatacttcttagctacaaaccctgtttgcttttgtctggtctcccccacaaactgattaaaccttctgtctctgagttacctttgatggatctgtaagtttgttgcaaaatcctggctgtagcaggtcctagtaggaagcagatgagtaagtcagctgcagcttgcacacacctagcacacaccattcctgcctcaatgtctgccccaaaccaagctgttgatcctactcagttaaagtatataaggatcatttgtttctgctggattttgccacccacaagcttgatccaaattttagagtttgattcttcaggtgctgtttccctctacctgctatgccctctatgtgggcacctgtctttgactcttacaccttgctgtacttctggcctgctacactcaagtggacatcaggttttccctctcactctgaactacttgctgctctcattcttgacttgttccctggcctttgcatttcaagttcccttgtctctcattcaactctttttgtaaagcatataaaaattccctccagtagaattttgtatatactcttccctctcttattccctggtcccagattttataacaatggcttgacatcagtacaggtcaatgtcacaaaaattggcaaacttgatttctacattttttactaatcagaataactgctaccacacagacaaatgattcctaaatatcttatatctaacttgctttactatatactttctttactttccaatcttaaaaatctttactctctattatctaactgtgctctgctctaaaaaataccctataaaatctagtcaagatttttaagatcattg

SEQ ID NO: 530 - DNA, 1000 bp, mus musculus
ctctcaaaaattaaaaactgctagaatgggtgacctatatgacatgcatgagttttgaaattcagcctgtcagggctgaaatctaggcctctacttaaccccattacaggtttctcatgtctcctgcaggagcaagcaccctccctgcttggtcaaatcgtgccagggatccagcccagtcttagctctgaccactgtccttaagatccatttacattgtgcatgtgtactctttctttttcacatcgttctttcctcctttccattttccttcatttattcatttactgtcctttttttctttttaatttggatattttatttatttacatttcaaatgttatcccctttcctggtttctcccctggaaaccccctttcccatccccctcccctgcttctatgagggtgcccccacccactcacccaaccactcactcccacctcaccaccctggcattcccccacactgggacattgacccttcacagaacatatgacacctggattgttaaactagtagacaagtacttcccattgatgccggataaagccatcctctgctacatatgcagctggagccatgggttcgtccatgtgcactctttggttggtggtttagtccctgggatctctagtgtgtctggatggttgatattgttgttcttcttatggggttgcaaaccctgtcaactcctccagtcctttctttaacacctgcattggggaccccttgttcagtccaatggttggctgagaggatcttgcagagcctctcaggagacagttatatcaggttcctgtcagcaagcacttcttagtatccacaatagtgtctgggtttggtgtctgtatatggggtggatcctcaggtggggcagtctctgtatggcctttccttcagtctctgctccacactttgtctccacatttcctcacatgagtattttgttccctccctaagaaggactgaagcatccacattttggtcttccttcttc

SEQ ID NO: 531 - DNA, 1000 bp, mus musculus
tagggagacatgtcatctttcatgaaggttcagtgtcctagttcccttcccccaggcaaaacgacacgggagcaggtcagggttgctctgggtaaaagcctgtgagcctaagagctaatcctgtacatggctcctttacctacacactggggatttgacctctatctccactctcattaatatgggtggcctatttgctcttattaaaaggatagggggagatgttgggagccgcgcccacattcgccgttacaagatggcgctgacagctgtgttctaagtggtaaacaaataatctgcgcatgtgccaagggtatcttatgactacttgtgctctgccttccccgtgacgtcaactcggccgatgggctgcagccaatcagggagtgacacgtccgaggcgaaggagaatgctccttaagagggacggggtttcgttttctctctctcttgcttcttgctctcttgcttcctgcaccctggctcctgaagatgtaagaataaagctttgccgcagaagattctggtctgttgcgtctttcctggccggtcgtgagaacgcgtctaataacattttactgtgaataggaactgttttttctgagtttaaatactataacacctagtttcaagtcagtggcatcattaaagagggcattcagccttattagaagaagtatatcactggggttggctttaagaatattatcaactaactggatcacccacatctcccagagactaaaccaaagtatgtacatggagggatctgtggctccagatacatatgtagtagaggatggccttgtctgacaaaatggaaggggagtcctttggtcctgtagaggcttgatgctccagcataaggagatgttacagctgtgtggctggagtgagtgagtgattgggagaacaccctcatagaggcaaaagggaggtgggagatgggtatatgggatgggagggtttgtggagctgtaactatgaaggaggttatcat

SEQ ID NO: 532 - DNA, 1600 bp, mus musculus
aattttaattggaagtttcacagtactccaacaaaacaaaatctttgttaatcaaatattgttttcaaaatgaaggaatgaataatttcatattcttttcactgaaatattttcaaatctcaacttcagaatgcttagaggagttgtctctagcacacaaatatttggaaagtaaatattttattttaagttagccctataccctaaagcattcctaagttttctcctgttgaaaggtgaatttttaaacacatagaattatttgaagggtagattttttttctatccttgaaatagttaattatggactgttggcaccaacctggctctaaacaaatttttaaatacatttcagtctaattatatatttattactaaattctattgctttttaaatgcaagtatcagtaattcattagaaacttacatcaaaataaattggttacatttttttgtttcactgagaaataaaatattattgctatcaagaaaaataatttgataaagaaaaatccatatttttaatttcctgaaccctacataaatcctgtattggttctatgaaattcctctagtggaacataacagtaacaattcacaagcatttatcagtgtagcatgaaggcctgacatagcacagtgcctgggtgtctgaggaattaattctcataatgtgactactgaaaacgaatatatttttttaatcaacctgttgtaacttttttggtttgtttgttttttcaagacagggtttctctgtgtggccctggctgtcccggaactcactttttagaccaggctggccttgaactcagaaatccacctgcctctgcctcccgagtgctgggattaaaggtgtgagccaccaagactggcataactttttaaaaatagtttgtagacatcaaatttagtgtgaagaattaatgcaattattgtagaagttgctgccagaatgaatgaaggctttatttttttagactaattatgagctaccgaagttttctcctacacattttctagtttgtagttgttaactgcttccataacactagatagccacacccttattacatagcagagattacaaggctgatatgatatgttattactcactatatatagttacagctcctctttcaattatacaaattcaaatacattctaggcaataatctaaaacttaacaaattgcttgtatggtattataggaaaatatgatctaggattttcaatatatttagttaatacataaatgtttactgaaaattttcatggtgttttcctcttttgcactgataaaaaggatggtttccatggcaccaacattagagggaacacatgtgagtatggggctgggatggctctactgtgctcagtttggaacacttctatctattttgaaaagtctatattgaaagacagttgctttcagaaactgtgtgtaggtttccaaagtcagctttctgaaagaatagagttttctccgtgatctataaatctccaagattttcaaaacggtgatgggaccataaactggcctacaaaaaaactttggatccacaacaaatgaactatgtctccttagccaaatgaagac

SEQ ID NO: 533 - DNA, 1600 bp, mus musculus
gtcgccatcttggtccgggacccgccgaacttaggaaattagtctgaacaggtgagagggtgcgccagagaacctgacagcttctggaacaggcggaagcacagaggcactgaggcagcaccctttgtgggccggggacagccagccaccgtccggaccggaggacaggtgcccgcccggctggggaggcggcctaagccacagcagcagcggtcgccatcttggtccgggacccgccgaacttaggaaattagtctgaacaggtgagagggtgcgccagagaacctgacagcttctggaacaggcagaagcacagaggggctgaggcagcaccctgtgtgggccggggacagccggccaccttccggaccggaggacaggtgcccgcccggctggggaggcgacctaagccacagcagcagcggtcgccatcttggtcccgggactccaaggaacttaggaatttagtctgcttaggtgagagtctgtaccacctgggaactgccaaagcaacacactgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcatcagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatca

SEQ ID NO: 534 - DNA, 1400 bp, mus musculus
atttatttggttctacttctaatcaggaaaaaaaattctatgtgattttaaggatattaaagaatctatacattccagaaggaggaacctggctgggaaaggagacagggaaggaaagaggggaacatgattgggtatctggcatgggaacaggactaaagtcctgagggccaacagaaagaatggaaacaggcaaccttgggaggtaggtggtggggcaacactccagaatgtaccagagatctgaggtgatagactctcgggactcaaaaggagggaccttagatgaaaggccctacagtggggagaaggaacttgtagagcccaaccccaccagaaagacaggtcatcaaatgagggatgaggttgccatcccacagtcaaaactttgacccataattgttcctgtctgaaagaactgcagggatggaaatggacaggagcctgaggaaaaggaggtacaacaggcccaaatgggatccagctcaaagagaggccccaagtcctgacattattactgagactatggagcgctcacaaaaaagggacctatcatgactgccccccaaaagacccaacaagcagctgaagagtcagatacagatatttgtgcccaacaaatggacagaagttgctgacccctgtggttgaattagggaaaagctggaagaagctgaggagaagggtgatcttgtaggaggaccagcagtctcaactaacatggaccctgatatctctcaataattggtccaccaactaggcagcatacactcagcagaactaaggctcccaacatatatacagcagaggactactgggtctagactcagtcagagaagatgcgcctaaccctcaagagactggagagcccagggagtggagatgtcaggtaagattggaatgggggtggggaaatcctcctggagattggggagggggtgtgagaaggaggtgtgggatatcaaacagtcagagggtagacctggagggggataaaatctggactgtgaaaaaaaaaagattaaataaaattaaaaataagattcaagtaaaggggaaaatgcatataaaaacaagtcttaagaatcatattcattgttgaaaagagtccaaactgggatggtgattatggaaattagtgtgtcaagtccaaaacaaacaaaaaaacggaaagacacacacacacacacacacacacacacacacacacacacacacacacaaacaactagacatagattgagcatttgctccagttttattttcaggcatatatacccgaacaattcacactttactctagagatacatactcattcatgatgataactgctgtatccacaattactaggatataagagccactttaatatctatgatctaacacatggaaaatgcaa

SEQ ID NO: 535 - DNA, 1000 bp, mus musculus
caactcccacctcacccaccagatctctaaactccctggggcctccagtcttttgagggctagaagaatcttctctgactgaacccagacgctgcagtcctctgctatatgtgtgttgggggcatcatatcagctggtgtatgctgcctggtgggagctccagtgtctgagagatctccagcatccaggttaattgagactgctggtcttcctaccgggtctccctcctcctcagattcttccagctttcccccaattaaaccagtgagttcaacagcttctgaatgtttggttgggtgcaaatatctgcatttgattctttcagctgctttttaggtctttcagagggcagtcataatagatcccttttggtgagtgctccatagcctctgtaatactgtcaggtcttgggatctccccttgagctggatcccaaagtgggagtatctttcagtattaaatatatcttttaacttaaattctgcaataatctgccatggtttttattcaaagaactataaaacatatgttcacataaaaatctacagtctacctatggctgtttataggaattttgaggttgaataaaaaatgtgtatatgtggaggacagaggacaaaattatagaatcgattcacatctgctcctgtagatctgggactgatgctctaggtcaccaggcttgtgcagcaagcacttttgctggctaagtctccctggcctcatatttcctctttacttattgtactatggtgattgagaagattcggatggtattaaattcatagataaaagagcctatagaaaatctctcagtcagatccacaggtttgcaatgaatctaaagctgcttctcacattgtcattataaggtaatcgtctttaaaatatcaaaaagtatttctaaaacatcagcaaatattcatttgtggaattaattgaggtgaagaaaaattcagagttcaagagaggtgggcatgggaagcagagaaagagaaag

SEQ ID NO: 536 - DNA, 1000 bp, mus musculus
attaatgttacttgtataacttattaaactagaagataaaatatcagggaatttgctgtgagattgtgtcttctagtaattttagaagctatgcccacaaagtctcaccaacatggtggctcaaacgtaagctgaacaaggataacaccaagaggcacggaaaacaggatggacaatatcccatggggcttcaaacatacacaaaggactataggcaactgtcttagtcagggcttctattcctgcaaaagcatcatgaccgagatgaaagttctggaggacagggtttattcatcttacacttccacactgctgttcatcaccaacggaagttaggactggaactcaagcacgtcaggaagcaggagctgatgcagagccatggagggatgttccttactggcttgcttccattggcttggtcagtttgctctcttacagaacccaagacttctagcccggagatggaattaccaacaataggcccctggccttgatcactaattaagaaaatgcccttacagctggatctcatgtaggcatttcctcaaggaaggctcctttctttgtgataactccagcttgtgtcaagctgagagtcaaatccagccactacagcaaccaaaggaagttgagaattagagagttaatcttcctcaggaaagagcacaccagttcgttgtctagtgccaaacttattcccacaaacatacatataggtagcatgatgtaaactcaataggttatatttagaaacgtatacatgtgtgcattcaataccagttttgaagacaaggctattaatttagtgataaaaagatagaactgttgtgttattgccaatccattatatctgggattaaaagaaaaccgaagcatctggtcatgcctatgaataacttttcttgattggatcgttagcagttggaagactcaccttcaatctgtgccttgtcttcttatggcaaactctataaaggatgtgaatgaaagcagcttt

SEQ ID NO: 537 - DNA, 1600 bp, mus musculus
caggtgagaattctttgttcagttctgagccccattttttaatggggttatttgattttctgaagtccaccttcttgagttctttatatatgttggatattagccccctatctgatttaggataggtaaagaccctttcccaatctgttggtggtctttttgtcttattgacggtgtcttttgccttgcagaaactttggagtttcattaggtcccatttgtcaattctcgatcttacagcacatgcctttgctgttctgttcaggaatttttcccctgtgcccatatctttaaggcttttccccactttctcctctataagtttcagtgtctctggttttatgtgaagttctttgatccatttagaattgaccttagtataaggagatattagatattttcttcctttacagtttctgtacctctttgacactttgaatattaatgaaaataggcaacaagggttgacaatttgaaaaaatattttgtttgaaagattcaacaagagcattgtcagccacctcacagcacagttgcatggaagacagtcaaaggcctgcctgctgcttccgaggcttagttcaggccaggtaggcaccattgtgatgagcaattctgtgatggagaaatggaagggaaagagaagtgaagtggtttgtgtgctatgaactggagatgtgatggaggtgagaagcagcttgatatgagaggttgttgctgccatctgaggtcaataggatgcctgagctatgtctgggtccatggccttattgaagcaggggtgtgtttcaatgcccaaagctgatgttaccaccaaagaccatgaaatggttcacagtctgggctgctatctgaagccatgtttatgtctgagaatctctgagctgtcccaaccatcaccagcagtggcgccagccttgatgtgggggcaggagagatgatcctgcccctgactagttgtgggactctgaagagcttgtcctgcatgttgctgaggcagtgtaggagatccccagtggtctgggcatgaaagaaatagtaggctggtcaactcagcttaccaccctgtctcatatccagcttgagcggacccaccccaatacctaaaccacgtaggagctagtggagctccagaagggctgcttcttcggaaccacagtggaaggatctccatgactcagggaaacggcaggatatctgaaaggattcctggcgagggtccagtattgatcatagagcagaagccagaggccttgaaccagagcgatgactctttacagtgaacatttgtaagtgaagctgtttgggcaaaatggtttacatgtgacacgctgtgacactgtactttcagtggcgagatttcgtttcaatttttatgtttttattgtgttttgtggagagattacaagcgtggagggtaaacattggaaggactggaaaatgagtgatattagagttcataatttgaaattcacaaagaatcaataaaaaaaaaacctttttaaaaaagtgtgaagtatagagtatcctttaaaaagattcaacaagagatttgagtttttatttgtttttgatgccagtcccaatactgtgccatttt

SEQ ID NO: 538 - DNA, 1200 bp, mus musculus
aagtaaatgaagataaaatatgtagtcttataatagattacagccaggtcttaatgccaattaatacataagaggccacaattacaaagtaatgtttatttctctttaaatctttggaatcatactcacttggttttggagaaacattgaagagtctgatgtttgtacatggtctaactctctgcttctcttctccgtgctttcagcttttaacaaattggtacaagctattgaaagtcagagcaaagcaatggcggctgtgtttctatcagtgcttttagtctgtaccacatggactgacagcttggcagagctgtgcacaacattgccaatcctttagtgctgtgatgtgagggcctcacacagcaacagccaagcccactgtcctgaccttcacctcacatccatgaccttgaaagtgacagggttccgatgaacaaccctcattccatttccaccattttattttttttccaatgtaacactctggagccttaattagaatgtttcttctcccctgagtctcaagggtggtatttcttccctttcttaaccctaaaactggtagctgtaatttaaaacactcagcttgtctaatcactattttgcatgtatttttattttactataaagtgtttgagctgcagtttgttggaattgaaataaaaaaaaggcaccgtccactgaggaaaaggcaaccacagtaagaggacaaagatgattctttaactcagtttttatgtgtatcatgcatcagaaaacaaatgcgatcactttcagtagcatataaaatcttcctaacagacaatttttttttaagccaagtaattttctttcccattatttgccttcctgcttatgctcttgcaatgcctcagacaactttagggatatcagaaacagatatctcatggaggatggtgagaacaaccttgctattgcaaggtatttgtggtaatttattgagagacaccatcttgttactcattatgtggaatatcttcatgtcatgttattaagtctaggggcacagtcatttttttattgctctgagtgctgaataaacacttaaatatttgagaaagttatatattattgaaccaagttgtattattcatctaagaaatgtaaattacaccaaccacaggaatggctctttttttcctttgaaccttatagaatttttgaattgcttttcag

SEQ ID NO: 539 - DNA, 1400 bp, mus musculus
agtttggtttgttcttgtttttccagatttttgaagttgtaacattaagtcatttactgtgctctgaatttttaatgaagatatgtagaactataaattcccctcataggactacttacaatgtgtcctacagattttcagtgctatgtttttattttcatttagttccatgaacatttttatttctttcttgttccttctttgacccatttatcatttggtaatgcatggtccctgagtttgtgtatgtaccagatatctgctgctgattttaaattttgttacatcatggtcagattggatacatagaattaggtctatttttctgaatttgctggatttctttgtgtctacatatatgtgacatatatgtgttttttaaaagcctttgtgtgaaacgctgacaccattgcatatgccagtaagattttgctgaaaggaccctcatatagctgtctcttgtgagactatgccggggcctagcaaacacagaaagaagtggatgctcacagtcagctattggatggatcactgggccccgagtggaggagctgcaggaagtacccagggagctggggggaactgcaaccctataggtggaacaacaatatgaactaaccataacccccccccccacccccagagctaatgtctgtagctgtatatgtatcagaacatggcctagtcggccatcagtggaaagagaggcccattggtcgtgcagactttatatgcctcagtacagggaaacgccaaggccaataggtgggagtggataggtgggggagtgggtgtgggagacttttgggatagcattggaaatgtaaatgaaataaacacctaataataattttaaaaaaaaagaaaaaaataaatgaaccaaaagaggaaagaaaagcctttgtgttcttcttagtaaaatgtgtactctctgttgttcaggctgattattttgtacccacttattatgtccttttgatgtctagtgacatttaattttgatgtttctttggtaatttttttgtccagaggacctctcaattggagaacgtaggatattgaaatcacttactcttattgggttgatatggacttgtgtcttcaattttagtggtatacttttttacaaagtagggtgcaccaaattttggtgcccataagtttaggatactaatgtctccttggttaactgtagttttcattgcaatgaagtctcattctttgtgtcttcatatttttaaattgaactctattttttctgatattaggataatgataaaaaatatgggatataaatatagaataatgtctgtctcctggcccattttatttgaatactataaccattcattcacattatagtgtacctatctttaaagttaaggtgtgtatctaataga

SEQ ID NO: 540 - DNA, 1000 bp, mus musculus
gggggagtattatgaagatagaaagaaaagagagacctggtgaaaggctgtatatagtatccacatgaccagttcctcttacccctgtatgtgacctccagcctgctccaggctcctcttacatcagagtgcaagagaagtctgaagggttgggagcaggggaaacctggcccaggaagaggaacagcatgcatgtcagtcatcccaggcagccaaaacaaagactgggcagttttcaaagatccatattctcgctgaggccaacagctcatgatctaaatgctaccaggctctcttcctggcttgcaaaaaccaatttcacatttttacccagtgggattaagaccttacccctatgacctcagtcattaattaccacaggggatgaggacttcagcatatggcctttgcaagacacacttaattcataacatataaatgtaagcatgctcttagtggcagttaaaactcacctgaagactgtgtaccttctctgtgctttaaatctcaaggttcaaacaggacactcaccttcctcaccacacaatttactaggatcaccttactgtcaacaatatcacatgcttaattatcatcttttacattgtaagccacattactatgttatctattacaaaactttaaactctgaatcaaaaaattgcaagcaaaagtaacattaatttccaattttattgagttcctaatgggcaaattttacattggtttaatgaggccttattatgggatctgaatatttagtgtgtactaaaaataccaccccttctgaaagatgacaggaacaatataagcaaatgtgtctccacagaccaaaagtatagctgttatgaaagagttcaggaatgtgcaatcgccacttctgagcagcacacaaaccttcataagaagctgtcgggtgtgtgtgctatctggtgtctggaacacaataaccaagggtaccaaagggcatccaagttcaggaagggtagaagcgcagcat

SEQ ID NO: 541 - DNA, 1000 bp, mus musculus
gagagagagagagagatgaaatgtacatattttagggtttaggtttagataagtattgggggaatgatattcaagcaaagtcactagtctgtacaaatcattctgaagtcaagccaagtcagttaagtagaaaaagcattaagagttaagtcaaaccccaaatcaatccaagggaaagtgttcactatgtctgagtatgtgcctcctaaactaccctccccaggacagttatgatttggtcaatacaggacaagattcatgttttttcttgccaaggaccagcctaagcttggagagggcttctgatgaaaagatgtctaactggggaggagtttatcctgaaggtcagaagcttaagccattgcctatgtgacttctagccatgcttctcttgtgggggctgtggggaatggtaacttaggcaggagccagagttccaggagcatgagggaatgcctaccgtgtcatgtaggtgaattatcacccttcgaggttcagacctcagctcaactggagaccagcctgtctccatagcccaattccccacaggtatctgagagcagcaaaggaacaactcaaagccaaattgtgggttacaaactgatagcctactgcccgagacagctgtcagacagccctttgatcaaggcagctttctctagcaattctaaaaagctcatctcttacagacccaaagcccagtcttttatttacatatcagttcagtcattaccccaggttccctcttgattaccctatgaataagcatcccataacccctccattcttagaaacagacaccaagcacattttttttaacattacaaatgaattcagagatctatggccttcataagcagtgacaatgagatatatgggtgggatccagtcctgagattaccatttccattatgcatgggcccaacctatgtttgtttcaggtatctgcctttgtaattttctgacaagctggttcagagtgcagctgcctctgtttagt

SEQ ID NO: 542 - DNA, 1200 bp, mus musculus
ggttatttttctatttcttttataaacttcaaataaaatgtcagaaaggggttggggcaggcggaagaaagacacctaagtgcccaccccagtcacaccagcttgaggcagcctgaagaaaaccactcaagcacccaccctggtcccactggcccaaaaaggatggaaggaagcaagacatgcacagagctgccataggtacaattttgatgggtgactgtgatgtagagacgggaaagatggagtaaacggtggagagatgccagagaaagcaaagatgaggggttcctctgctatggagaaaggtgaaattggagactcaatggtggtggtgaagaacaagtagatatgaggaaatcatggggaggccctgttctaggctgccacaaagggccatgcctgggtctggtacccctgctgtagctggggttctatacacgtctggcctgagttaccatgaaagcccaaatgcatgtctgtggtctgggctgccagcagagagaccatgaggatatttgagggtcaacatgttgatctgagtggcctgccacataaggccatggggatatccgagtccacattgctggagggctcagggcacaaaacactacagatgaacatggctggttcactggtcctcaagcagttgggttctctagtgatgtccaaggctcatgttaccaccaaaggccatgtagatgtccctgatctggactgctgcctgaggcattgtgtgagggagacatgttctcctctgcttgccccttcatgtgtatgtcaggagggttaaatgactttgaggtcatgagagatggagagttggtcatgcccctcaccagctgcagcactctgaagagtaggccaacacctcagggcagcacagcaaagctgaccttagtggcaaaggtgccaattagcaagtggggtgggggtgtgggggagaagggaggctgaccctaccaccccttgctggctatagcattgggtaaggtagccagggcagtggtaaaaagctcaacctgatatgtgggtgtgggagagctggtgagctgacaaacttaggctactatccaggctcagatccagggctgtgagttagcccatctatatgatctgttggagcactaaaaacaaccagtcctacagatccaaagctgcaggatctccataaaacagggcaacaaaaggatatctgagagg

SEQ ID NO: 543 - DNA, 1000 bp, mus musculus
ggaaaagttctcttcattcttctcgtggcggtacttgatgtgctccttcagcgatgtcaagcgcttgtagccgcggtcgcagtaggggcaggtcagcagttgggcaaaagcatctggagttccaggtggcaggtctgtagccgagaggcgaggggagaggagcgggccaaaaggtcagtaaatcaatggcagctaatgggctggctgcccgggctgctatgacaggaatcgctgcaatctgctcctgcacagcgccatcattgcgccccggcctcctcacaaccagaccccttgaacacccagggcaggcttgtccgaatcagctcacactgcgctcgaaaattaattaattacttgagcttatttgtggggagggggaatttaaacagctgataaatgaagaaattccctttgggtgactgacagtccccctgaaccctagactcacatgtaactcaggaattcacaggagggaaggagattttttttttcaggtgtcagagaacaaaaggtgagggtcggtgatcttaaacttttttttttcctcaaaagtaaaatatctctgaaagattggaatacatttagatatttttatctcttagaaatgggctgtaattgttcttattctgtattggatgtacaaatgacacaaatttgctgacaaaaaaaaatttcacaataccctaaaattacagttctaatctttgctcatgaaattccatgcctctgcagctgttcttcaaattttaaggtaaacacccaggcatgtagtgcatttgtaattctaacagctgcagaggtcagtatcgcggctaaaaatgaattacagccttaccattttcttcttgcccgttggcctctggcgtgccaaggcgagacagctcctcaggggcttctgggtaaataatggccgtgtcgcttcgctgaaggtactcttcgatgctcactgcgtggccatctctttcctccagttttcttttggcaaagtattcctcaaagt

SEQ ID NO: 544 - DNA, 1400 bp, mus musculus
agtttcccttagccctttactctatattgaacctatgctagtctctggattgtagcttggttatcattgatttgactaagttaatatcagcatataaatgaatatgtaccatatttatctttctgtgtctgggttacatcactaaggataattttttttttctatttccacccatttacctctaagtttcatgatttcatttatttcatttttgatagctgagaaatactccattgtgtaaatgtataacatattctttattccttcatctgttgaggcacatctaagttgtttctaatttctggcaattatgaatagagcagcaatgaatatggtagagcaagcatcaaaggtataccattttgaccaagcagatttacgtgccaatgttcatcgcaatgagacgttggtttgacttgagatctctggcttctgctgcacagtcaatgctggatcctcactgggacttctcttggatatcctgctgttaccctgtgtcatggagacactgcaggtctggatctgaaggactgccccatttacacgccagcagttcatagacaggtttgatgttggggtgggacaactctgagctctggatctgggcctgagtggaagctgacttggtcagcccatcaggtctcctgtgactgcaccaacaaggccaactctttgccaagaggtagggtttgttttcctgctatcatgccctctgggccagatttcctgtgcccatgctcccacggccagctctactctgttgcccaggtgagagtaggaccagttctcccaagctgcccacgtaagagccgggtacaactctcccattgaaggcaaaaggacagagccagctcgacacggtgcttgaacatcagcatgacctcaggtggcagcccagaccagggacatctccacggttttggtggttaacatagacctcagataggaccaccaacccagacatggttccctgtgcatgtcatttatatataggagggttactgatttttgtgaattaattttgtattcacctactttgctgaaagtgtttattgcctgcagcagttttctggtggattttagtgtcatacatgtgtacaattttaggagatatgtatatatacatatatatatatatatatacacagatacatatatgcagtcatatcatcaacaaataaaaatactttgacttctttccaatttgtgtctccctgatcacctataacatttatcatttcatgtctttgtcattggctctttactcttcaatagcataaaacctatcttatcggacagtcattacttgatatgcctgttagctatttaaatttaattataattcactaacaaggagatcttttttttcaaatgctattacatggtaatagaacatttta

SEQ ID NO: 545 - DNA, 1400 bp, mus musculus
atattttttgtgacaatgtctttcatggaatctactaaattgactatactgtcaagcagtgtattctggcttatcaatcccattcttatgccccaagactgtattttgagattcttgacaacatagccagctcttatgttaaagttaggaatccatacatattccatcatgctttctaacactggaacagtgtttgaacctaatacatactaatatgtaaatcaaagccagagtgaggtaacccactaatatgtaaagtcagagccagagtgaggtaacccaatcacaaaagaagtcatttgatatgcactcactgataagtggatattagcccagaaacttagaatacccaagatacaatttgcaaaacacaagaaaatcaagaacaaagaccaacatgtggatacttcattcctccttagaatagggaacaaaatacccatggaaggagttacagagacaaagtttggagataagacgaaaggatggaccatccacagactaccctaccaggagattcatcccataatcagccaccaaacacagacactattgcatatgccatcaagattttgctgaaaggaccctgatatagctctctgttgtgaggcaatgccagtgcctggcaaatacagaagtggaggctcacagtcatctattgtatggaacactgggaccccagtggaggagctagagaaagtacccaaggagctgaaggagactgcaaatctatgggtggaacaacaatatgaactaaccagtacccctagagctcatgtctttagctgtatatgtagcagaagatggcctagtcggtcatcattgtgaagagaagccccttggtcttgcaaactttatatgccccagtacaggggaatgccaggaccaagaagtgggagtgagtgggtaggggaacagggcagggagaaggtataggggactttcaggatagcatttgaaatgtaaatgaagaaaatatctaataaaattttgaaaaaaaaataaaaaaaaaacaaagccagaaaagttactaatcttccaagtttcactacacacacacatacatacacacaccccatgtatgtaaatcttcaaaatcaagagatgacccacattccaatgacatattttcgagcctgttgacatttatatttgaaacaatgaatatctttggaaattttactatgactttctcactgagtttattttttattataaaaatataattatgaccataatgtcactgcattttcaatctcatagcataaatactgtggcccaaacttaaaaagcctcttcattctgcccatgacttttactttctttgttgactttttaaagtgattttcttgtctcaattgctacttacatctctgatactcatgtaacccttgaattat

SEQ ID NO: 546 - DNA, 1000 bp, mus musculus
cttggttctcttgatcagaatgatgtatacttttatcttctcaaagatgtttggttctgtgattctttcccaaggacaggttgcagctacacctgggaagtgcttatccatttatcagtgagaatgccaggaggcaaggaaggctgctcctgtttgtccattctaaagcccacctgggaggaggggtggggttcatcaggatgtgccactatggaaacagggatagatactctggtgccagtcagggtcctctttgaaaatccagggaggggaaggaagcctcatgctacttgcttcacagaagaaggttgcctgggtcatttcactatcatcgggttggggggggggaagcacacataatactgtgtattcaacaaaaacggattcttttcattttaacaattttctattaatactttgagaattctatttaattgtagtttgaacacattcatctccttccaccaacatcatccctaacctccgtatatcacccaaaatccatatcattgaggaagaagatataaatatgcattacataatataaaaaccaaattctttatatgtgtagagaaatattttcacaatgctgtcaaaggttataccaaataaatgtgtagaatagagtaaatgttaaatatggtcatgaattttgagaactaactagaaaattttcatggagaaattattttacttaaggaaataaaactaaccgtgttttaaatttaaggcaagtccatgtttatgaataagaatgggacatttagcttcctatgaaaactgaaaataaaagtgtaggaacacagatgtaaaggagtgctcagataagaggaagactaggaaattgctacgggttcgaaactgctatacaaacccaataggcctcaaatcaggaatgaattctagacaatgttcatcactccacttcttccttaccaaatgacatgttcttgaggaatgctttagctgtctggcagccaaggagaactgggaataccta

SEQ ID NO: 547 - DNA, 1000 bp, mus musculus
gagtgactcaggcaggaggaaactaacttcccagacactactcttatctccatatacaccatggcacaagcttcacacacatcatgcaggaacacacagaaaacacacacagacacactcacacattcacatcctcaacaaatacataaaagataaatttttaaccatttttagttttaactacagaagttttgaaagcttggcatatttggttctaaaactcagctattaccttaacttgaactgaaatatagctacaattcactgtaattttgtacaacataaatctgctcttaaaaaaatgataaatactccttcgggtcagtgccagccccttgtcaccttgggggcaatctcaaccgagggtcccaagttcatcagaggaatctccttgccacaggttccctagcacacccaggatcttgggctcactggtgagtggaatgcgacatctgttccaaagcatccaaagggggcttgtgccagcagtaacagggacaaaggaaacccaaacgaccagtggctgggttttattcctgttggatccagccttgcaccaccttggttgtgaaatcaagacagagcttgttggacaggatcccttttgggtcttcattctcagccaggaggcagacctgagacccagacctatgggcatctcaactataagatgagagcttgcctgaggagaatgctttgattactgggactaaggaaatagttcgactcccaggagtgctaacagaggctaacagaatcacaagaggaaaaagctccagccagagacagctagaacatctaacaccagagattaccaggtggtgaaaggcaaacataagaatcttactaacagaaacctagaccacttggcatcatcagaacctagtatgccaaccacagcgagttctggataccccaacacacccaaaaagcaagattcagatttaaaatcatatttcatgatgctggagatgattttaagaagggcattaataactca

SEQ ID NO: 548 - DNA, 1200 bp, mus musculus
tatagagaatctagtaagcatcacctgccaataaaaaccctatggtcaatgaatgaaattaggcaggattagaaggagggacatctagcaaagaaatattgtaatttttgtatagagtcaggcaggagatctacccaaacatggaaggagatgtttacatgaatctgaaaagtggttaggaactacatggtaggacctagaatagacgggtaattaagttatgagctagtctgggaacaaaccaaaacttttggcctatttattcatgaaatattaagtctcagaattgttattttggggaacaaagagtccagtccatgtagaaaagcccatgaatacaaatggtgtccattgtcaggcacaaaatcccagcttagaaagaatcaggcttagagtctgagaagtttgagatggaagacaggaacaagcaccttcagaaacagaacaggttcctagattgatacaggaaactgaaaaaatgaattccccaagggcatctcctttaagagaaaccatcactttgcagcaaacctggcagaaggcagaaagcagaggccagagtactaactcagtaaaggggctgctctacagtctccatggaactggatgctgaagacatagcagttgtaacttcttccaagcacagcatggttctagagcaaggttaaatgcctgctagagagagctagacatcccaattcaggatcatatggggtgggatttgggggaggctacatttgcccagaatctggctgaaaggaactcatcggagtggttagagccaggagcagcctgtgtggcatactagctgagcagcagagaaacattggctacaggtaaaactgaaaagtcaacagacttgataagatacttaagaagtccttaagaagagaattagaagttaaaaagaaggggctgttaagatggtgcaagctgttaagagcactgagttcaaatcccagaaacctaatgggaaacaaacaaataacaacaaaacaaacaaacaaacaaaaaaccaaaggagtgagtggtgcctgagcaagaggaaaaataaaacaggaaaaaatgttaaaaagaaaatatgttctatatttaaaatgcaatgacagagaccacatggaccttctatacttttgttccaattatcagcatgacaattagtgtatgttcaataatgattacagttttgtataaccactt

SEQ ID NO: 549 - DNA, 1000 bp, mus musculus
ttatgggttatggagaaaagggtcattttctttgaaatagaatctcactattgttgagatataacagattatagctgttgttggtccagaactggttgtgtataccagggtggtctcagactcagagagatccacctagctctgtcttccaagtgatgcccttgatagcacacgaggcttacagatggttgttttaatagaaggatgtactgttgaaatgtacagtgtaattaaatagtgtgttaccagcatactttttaatgcagcttttatttaacctagacaacttgtacaaatttttagagaacttgtagagaccatatctagaggttaggcatggaccctggttgaggcatcccacccttctcaaatttttaacccagagttctcctgtctaaaggaaatacagcgacagagttgagcagagactgaaagaaaggccatccagagactgccccacctggggatccatcccacatgcaaacactattgctgatgccaagaagcgcttgctgacaggaacctgataagcatgtctcctgagaggcttggccagagcctgatagatacagatgaggatgcttgcagtgaaccatcagactgagcagggagaccccaatggagaagttaggggaagatctgaaggagctgaaggggttcccacaggaagaacaacaatatcaaccaaccagacccaccagagctccagaagactaaattactaatgatagaatacacatggagggacccatggcaccagctgcatatgtagaagaaggtggccttgtatagcatcaaagggagggaagccctttgtcctgtgaaggtttgattccttagcataggggaatgctagggtggtgggagcacactcatggaggcagagggtgggatgggggtggggttcggagaagaaatcgggaaggggggtaacatttgaaattaaaaaaaaaaaccaaatcaatacaaaatgttaaaaaaaaatagaatcatattcaga

SEQ ID NO: 550 - DNA, 1200 bp, mus musculus
ataaagtgtaggcaggattatcacatatagcatggcatgtgctttggagctggttgttatcagtgtgacactgtagtcagttaaaatcacattgcatggctccatgtattgatttactgggcttttgcttcccagattaagttttcattccctagaaaaagggaaagagtactcaacataagatttgagatcctgttgctgaacaaagcccactcttcaggaacagacctgggaggaatagtaatggcactgacttggaagtctcttatctgatgtctacctctcatagtataagaaggtgccatgcaagcttccaagaaagaaagtaatcagtagtactacctagatgttaaacctgacaatcacagtaatcaacccagtaagatgtcaccaatttgggtcaccttgggcacggagtcgtgggacacccccaaggtcccctagagaactctccatgagatcttaggaccacctgtgagtggaacaaaacttctgttcaaatccaaacatgcaggacctgagacaacattagagaagcagaaaaccttgcctgaagagggtcatgagtcccttctgattggcaccagcacttcgtcacctgggcgcagagtcagagaacacccctaaggtccctagaggacagcttctgagacagaccccatttcgggatccagacactcggacaccttccctgctagaggaaggattttgcaggagcacctgggggagccatcttggttcccggatccctccaagaatagtctgtgtaggtgagagtgtggactacagaagctaacagcttctgtgacaggccaaagcaacacagcttctggggcaggtcctgtttcgggccttcatcttctcccaggagggaggtccaaatgccagatatcggtgcaccttgcctgtaagaggagagcttgcctgcagagagtgctctgaacactgaaactcagaggagagagctagtctcccaagtttgctcatagaggctaacagaatcatgacaggaacaatctctaaccagagacaactataacaactaactccagagattaccagatggcaaaaggcaaacgtaagaatcttactaacagaaaccaagaacactcaccatcatcagaacacagcactcccaccttgcccagccctgggcacatcaacacaactgaaaagctagacccagatttaaaagcatat

SEQ ID NO: 551 - DNA, 1000 bp, mus musculus
ctgcaggtctccaggagatttgccataaccagtgacatgggtgagaatcttgaccaaataaccactccagctcagacctcccatggagcccaacagatatgtgatcccctcccatctgcacaaaacccatctcacttctggtctacacctccaccaggccacataactatgcttgcctctcttcccaccccacagtgtgcaggcctgccaggagatctgccataactagaaatataggtggctacctctgtcacagtagatcagtatagcttctcctttcccacatcccacaacctgctgggctcccaggtggtctagcataaccagggacacagcctgcctgtctctcaggacatctgtcataaccaagtcatggaagcattgccctaactcagggactcaagatgcctgttataaccagaaacgtaggaggtctccccaaaccagatgcagcacaggctgccttccagaaggcctgctctaacccatgtcacagagctctacctaccatcaaggaggcagacttaggagttaacaccagagataatgatatgccaagaggccagcacaaggacataaacaacagaagccaatgtaattgggcctcatcagaaaccagatctcctatcacagcaagccctggataccctaacaaacctgaaaagaaagatgttgacctaaaagctcatcttgtgaggacaatacaggcctttaaggagggtaaaaataactcatttaaggaaatagaggaacacataggcaaacaggtaggccttaaagaagaaacaaagaaaccccttaaagaaatacaggaaaacatgatcaaacaggtgaaggaactgaacaaaagtggtccaagaccaaaaatcagaaatagaaataatacagaaatcaaatgttgaggcaactctggagatggaaaacctggcacaaatacagactcaagcatctgttgggagccgcgcccacattcgccgttacaagatggcgctgacagctg

SEQ ID NO: 552 - DNA, 1000 bp, mus musculus
ctctcccccgctgcctttatgaaaatgatgcccaaccccccagcccatttctgcctcagtgctctagaatttccctacctttggtcattgagcatccacaggaccaagaggctccccttccagtgactctcaataaggcatcctcagctgcatatgcagctggtgccatgggtccctccaagtgtattccttggttggagttttagtctttgggagctcaggagggagggggtgtctggttggttgatattattcttcttcctatggggttacaaaccccttcagctcccacagtccttgtcatactttctcccattggggtcctggcactcagtatgatggttggctatgagcattcgcatccgtattggtcaggctctaggtagagcctctcaggggacagctataccaggctcctgtcacattgctgacatttctagaagacacagtttcatagcaaatgctatcatcctatcatcttcctgccctgtcttctgcaatgatccccgagcttaaggtacaggagttgtgttatagatatattgtaatggtcagaaaattgctgcaggaagaccccaggctcagatagtatgcaaaaacaaagagcatttattctgcagaaacaaccagcatatgggggtcaaccattctctaaaatggccacctcagacaaagacatgcataccttcttatatggaacaggcgtaactctctagaaagattgggcaacctaaaaattcattggtgggtgctaggggcatcatacgtggtcagtggtctgcattcctatatcatgaacatgtaactatatgatgaaataggactgcccagcatagatggcccattcagagatatttcacaatttttgtagttacctcaggctgttctttgggaagggattttatgatcttggtctggattttattgtctgtccctagagctggtatcttatagcttagtttctgggacttatggtctattcctgaagctggtgccttat

SEQ ID NO: 553 - DNA, 1000 bp, mus musculus
taatggtagaccattgcccagaatgactgagacccttggtttaatctacaaaagtacaagaaaaaaagtaaagtttagttttagagtctaattaacaaggcaacattattgaaaacttttacacatacaaaaacttaaaatgtgcatatttttggtgtgtgtgtgatcaagcccactcagtcaacaggttctccagcacgggagtgaggattaaaaagaaaaaaaaaaaaaaaaaacagacaacattatagcatgaccccagtcaattctgagactgaagacaaatttaatttttccaaactgctttttataccaatttaattgcatgcaagtattttgggcaagcagtacaataaggaactaacaagacagtaagcaaagtcccatgacagttgtttaaaagagcttgtcatgatgaccaaaatacttgaggccacttccttgtccaagccaaaatcttacctgaagcctacttttgttccaccctaagatttaaattcctgccttaccctactttcctaacatagcctaaagttagattcttgtggaaacttacttccttgtcatgccctaatgtcggattcctccctgagcctacttccttttcatggacaatgtcagattcctgtctgaagcttatttccttgtccttggccaatgtcagactcctgccaagtggcaccccaaaaggctttccacatgtgtatgtatgtgtgtgcatgttacacaccttggggtaaacatgtagatggatgtcagaagacaacctctgtggagtaggtaccaccttccaccttcgctctgagttccagggattgggctccagtacttgggtttgtgtggcagatactttactgctgagccgtctttgtcagcccgttgagacatagttcagatacataaagttcatactaataaaatcaaaccatctttacagatgatggaccagtaattagaatattattgttgtttgttttgatagttcttttgctagtttcat

SEQ ID NO: 554 - DNA, 1000 bp, mus musculus
atttttaattagtttatttaattttttacactccagattttattccccaccaccacccggtcaacccaccgaatgctccacatcccacacttcctccccacctccttgtctccacatggatgtccctacctcccaccccacctggcctctaaactccatggggtctcaagtctattgagggttaggtgtatcatctctgattgaacacagacttgacagtcctctgctgtaattgtgctgggggcctcatatcagctgatgtatgttgcctgtttggtggtccagtgtttgagagatctctggggttcagattaattgagactgctggtcttcctacaggttcgcctacctccccagcttctttcagcctttccctaattcaatcataggggtcaccagcttctgtccatgggttgggtgcaaatatctacatctgactctttcagggctgcttgttgggtcttccagactacagtcatgctaggtccattcttatgaacgctctatagcctgagtaataatcaggctgtgggacctccacttaagctggatcccactttgggcctgttactggacgttcttttcctcaggcttctctccatttccatccttgtagttctttcagactgaacaattatgggtcagagatgtgactgtggaatggcaaccccacccctcacttgatgtcctgtcttcctgctggaggtgggctctataagttccctctccctactgtggggcatttcatctaaggtccctccaattgagtcctgagagtctctcacctcccattctggtgcattccgtaggattccccaacctcctatttcttaaggatggctgtttcccttctttctgctgcccttcaggacttcagtccttttcccttacccaatgccagatcaggttcccctctctcccccatctcttccctcccatgttcctctctctctcctcccctgtggtttctttcttctctttcccaaatgggactgaggca

SEQ ID NO: 555 - DNA, 1000 bp, mus musculus
acttcctcaggatccctaatgtgaataaaataaataactatgaattattagtgtaaatccttacatgctgggtaacgggatgcaaagagatgtacaataaagctgtacccatgctcactgctgtctgctgcctcagtagttatcctgaaatcctgactgctgggctgcctggccagtgcacctctgttccagcacagaccttggccctgccccgatggagccatagacatagaatgcacacactgctttctagactcctcacagtaaactgggctcgtgcaagggagactccagatattcagcagggagaggaaagtcagtatttctaatgcaggcctctcttgcatttttccttggttcccagtgctcccacccttcatcatcttcatacacttgaagctggagccagaaacttctggccagttatggtatgactgtgtcttcctttgatcagaagaagttccaacctcctcagaacccccaacttctctactgcttcccttcctccatccaggcagaatggcgtttcctctctaagcacttggctactccgacaccaaagcccttcctttcaggactttgtctttgcactgagcgtcccaaaaggccgctcactcactctgcccttgtctgtctcactctcctgtcttttcatctgtgactttttgtcttaatcacctgaatcccgtttgtcttgctccactgttagggtgactcttcattgtctccccttgtgacacctagtcacaagcaaattatcttgcgtatccccaagatgctcacacagctacttgttcccagtggaaatggatcatactgtgcgggagggcagaccagatgtggctgtcagcttagcccctgagactgtgacactgagtcttattgatggcatgcagggatcctccagacaggtgcagcccacctcttgaaccaccataccattcatggtgctgctctaaaaccctagccattggtaactggatgattgcacggttcatca

SEQ ID NO: 556 - DNA, 1400 bp, mus musculus
cacacagtattgtttgacagttcatcacttcaccagccacggaagaagtacgtccatcacgaagaagtgtgcctctaaaaatgaatgtcattttgtcggctgccgacacagccgagattcggaacacacggtaaagattatgcttgcttggaattaactttcccagatttcatggggggatggtggtaagttacgtgtcatgggagaacctagaaggagaagccatatgttaggtttgtttgtactctgacataaagactctacttcagtgccagtgaggagagcagacaattgaagatattctgtcttcaaaaagaaataatggtgccaagaatgagtgttagtttccagagctctagagataaattctgaacttgaacagcctgaagcccatgctggaagctcaagaatcacccacccttcagagagtaaggagcactggaatctggatgatgtgtgactctgatcatgcaagggccacatgggcagcaccgctgaggtgagctggtgaggctggacaggagcaccctaaactaattgaaatggaacttcacatagaggtcttaggaatcaagatctctagaaggtatccatggtgagcacagcggctcacttctgtaatcccagtattctagagcctgaggcaggaggattgcgagtatgaagccaacttgagctacatagcaagatttggaaaggaaaataaaaacttccccctgggtcaatctgatgggcagctggctgcatagtcatttgtggctgtgcttgaagctgctgctttctgctgcccccattggcctgggaacatgcatgagtggccagttcatgaagacatggctttgggtcaggcatgcatcactgttgtggtcacaggttgcttcccttgaatgtactcttaagaatgggcactttattttatttttttattttagcaaattatcactgccatcataacaggactcaggtgagggcacagacaataatagcaggtcacagttatcacctaacaaataatactaagaaagagaaccaataaatccagaaggttcctgactttcaggtcattgtttttggttccattgtcttctaataaatcttttaagatctggaaactgagcagtctaactcagtctcccatctttgcctcagttttgcttgggtttgacacagatgcttcaagagttaggatgagaactctcacggtagtctttgtttagctgggggaagggtacccaaaggtcaggacaatgcacaggctggactatcagctccagtgcctgtcttgtcccatcttcctccctgcttctcactccaattcctctttcctccttgtacccaggagtgtaggtcttgctgtgaaggaatgatctgcaacgtagagttgcccaccaaccacacaa

SEQ ID NO: 557 - DNA, 1000 bp, mus musculus
tgagggtgatcatagtttagggcataacattttcacccactgttatgtggagcacatacccatgggtgggacatgccaggggcacagcctgagacaagtaaaagccctggtatgcttacttgagtgtcttcttgcttagtcccattgtccagtctgctggaacatttaatagtccctccctgcaagaatgatctgcctggaaagccactgtgctctgttctcccacaaggagattatgtttgtcatggcaggagtgagacaaaatgaaggaccctcaactgcaaacagtgtctatccaatctgccaatggcaagctttatctggtgagagacgagtaaggactctgtaaggctgaggatgacagagccttgaaagccaccaaggcacccacggtggaaatgaatctgcccgtgtgtggtgctgtgtgctctctgtgaaacctgggcttgctgcagtgggatcctgctgagaacacagccaaagcaacccggaagactggagagtggacttgtttaggttcagacttcaaagtataagcttcttattacattttaatgaccagagtcatattttattcatatagctcaagctgcgtaccccggagtcagtaaaacacaaggtttccatttcatacttacacaatccctgaaaagtttgaaactggaaaaaaattctggaattggatatccttattaaaactgaatatgaagggttggctgagcactatcatacatatgtagggaaatagactcatgaagctttgatggctcctgttgaatacatgagtaagtcacagctcatttgctggagaactactctttctttaacctgcattcctgaaccttgcaatacacctccaggagaaatacaattctccttgcaattcctctccgacttggaaagttctagaacattctctatttgtgttttacattttgctggagggggaggaagtggtattgttgtcttctgcttctacgtataatgtggagaagacaaa

SEQ ID NO: 558 - DNA, 1000 bp, mus musculus
tactttaggtttactgcaacctagactctgggcttcagctgataatccagagttctactgcagaagaggttaacactggacaaattgtgtatatcaggtcagaaatgtacagagaaggtcacactaaggacgtaaggtttaagtattaaaggatttctggaatctggaagtatcagagaagagacatatggcttgaaaaggagctcaaaactagggctcagcaaaggctgagaagtgtgtctgtcatgacaacatgcatggacaggctttgaggagtgctctgtaacaaaggccaggcagggtaacaggacacctaatgacaaaggtgtgcccatgtggctttgccaaaggaactaccaagtgtattttttgttttgttttgttttgctacagagcatcaaggtacattgctgactttagtgtattttatgtttcaagccaaatgctctgcattgtttgggtaaggttaatttctaacccactagaaacgccagtggttttcacttggctcacgttcctctcctgcaataggtttttgtttgtttgttttgtttttcgagacagggtttctctgtgcagtcctggctgtcctggaactcactctgtagaccaggctggcttcaaactcagaaatccacctgcctctgcctcccaagtgctgggattacaggcatgctccaccctgcccggactcctgcaatagttttaaccattgacacttactctgttacaaggcatggtggttttttagtgtctgttgtcctgttttgagtcagtctttggttctgtgaagcatagaccaccagtctacattcccctgtatctttctaaacaagcagtgggcacacatatacttccatttcttatttacatctcaaaaagttggatttctttttcccccagaactatagaaacagctgggtctctgaccataatcagaagtatcaggtaattatcaaactctgagagtagccctcaacttgggcccaggaggtgtaat

SEQ ID NO: 559 - DNA, 1000 bp, mus musculus
cctggatgggaaaggctacagggaggggaagaggggaacatgatagggtattggggggagaaaaggactgaagccctgaaagccagcagaaagagtggaaacaggcaacctcaagaggtaggaggtgcagggatcctctagaatgtaccagagacctgggaggtgagagactcttaggattcaaagggagggatcttagatgaaatgtccaacaatggggagagggaacttgtagagtccacctctagtaaaaaagacagggcatcaagtggagggatggggttgccatcccacagtcaagaactctgacccagaattgttcctgtctgaaggaactacaggagcaaaaatggagaagaaccttaggaaaaggaggtccagtgacaggcccaaattgagatccagctcagggggaggcctcaagccctgacactactactgctgatgttatggtatgcttacaaaaaagaggcctatcataatggccctctgcaaagcccaaccagcacctgaaagagccagatgcagatacttacacccaaccaatggtcagaaactagtgaaccctgtggttgaattagggaaaggctggaagaagctgaggaggagggtgaccctatagaagggccagcagtctcaactaacctggatcccccggatctctcagacactgatccaccagccaggcagcatacatcagctgattcgaggccctctgacatatatatagtagaggactgccaggtctggactcagtcagagataatgcacctaactcttgagagacttggggccccatggagtggggaggtctaggggttggggggaggggacatcctcttgcagacaggggggtaagtgtgggattttggaacagttgggagggggataaactaaagaataaaaataaataaattaaattaaaataaaagaaacaatatgagtttaatatttcatccctacaacctaaagacgttgcctctattaaaacctgaaacct

SEQ ID NO: 560 - DNA, 1600 bp, mus musculus
gtctctattggtagtagaccaccatgtatacaagtgtcgccctcatcgaagcctgggccatggacgccattagctcttggcagcagcacaggctaaagacatcaacatgatctctaaggcaacatggaccaaggacaccaatatggtccctggtggcagacccacccatgaatatcagcgtggcttcaggacacggcacagaccaaggatatctgcatgtctttgatggcaacagggctcacatcagcacagcccctgaccgtagctgcatgaaagactccaacatagcctcaggcagcagtacaagctattcacattcgaatgaccccagcagcaagccctaccacagacactaatacagcctcctgcggtagctcagactatggcggacttcttacatggccctctctggaagcccagtccaaaacttcaagcttcaacacagcaatctggaacagcggaccacagataccaacacggcctccaggagcagcacggagttcttttgagggggtccaagccaagaaattgcaccactctttagttcacataccctgtcattgcagggaaccagggttatcctgttgctgggcagcgtgttccaggctgattgagtaggctccagtctgctgctgcacaacctgccaaccctactctgcaatgacttgttccctgtctcctgcagccttctctcccgtgtgtctccactatatccaattctgcctttctctaccctgcgtgcacggctccgttcctccctctttctcacctctccatctcatgcacattcacttgtcacgatggctttggaaactgccagacttgtcacacaggatacccaagcagctttgcatgcagatattcatggcaaagagtcattgatctggtttaaggtttctggtttggggcacactgtaactactggaccatcacagagacttgtctcatttatactgcagttatccagagtcagggtgatcttgtagctaagcagggtgtcaggggcagcatccttgcctgagctccaggctgctgtaaacttcctcttcagtatctgctaccctgaggttccgtgagcttgaccttcgtacttgtagcctccgggcagcacttctgccccatgttctctatctcctggtggagaaggcagcgcaggctgcagctgtagcagctccatgctagggaccggccaccaggcctagaaccagccctactccctgtaacaaacatttggttctggcagagcagctcctcagtgcgtttcagcaatcatagacagaatagatgttggggtggaccgacccaccaagctggatctgggcccgcgtgggcctctcctggggtaaaaacaaatttttataattaattttagagggcagctgcacatatgcacacacacaatcttttacattcccttggtcttaacttttttcacacccagcctattgctcacaatatggattccagatgaagggtggactcaaagaagccaagctgcaaagaatgtgcatgcgtagcccatgagaattctcactgcactttcaaacagtgttgaaaattatgttaaggaagctcaaatggagaatgcttttccctgtag

SEQ ID NO: 561 - DNA, 1200 bp, mus musculus
gacttaagagatgtgttcatcctgctatacaggtggtatggtgtcaattgtcaaatttatttatttttcttattagggtaccatgaaagctttacttaaaacttggtcagaattgtatagagcatttactcgctgtgcttctttggtggcaacagcagaagagaatctgtgctgtgaagaactttcttctaaaataatgtgcagtttggaagatgaagtcctttcagtgagtcgccccccccccaccttttttaaaaattggagatagacggtttattgacacttctgtatgagataagcacaagtcttaataaccttggaatgcctctttctcttaatgctaatcctagtctaagcttttcttaacagtaccttccttgtgctacatagagctcagctttcatgcagcctagttgccagttgttgagaagcacattgctgagtgtgtaactaggaagtacttatgaccatgtatttgtagcataaacagtaaaaatattatttgtgtgtcttgactgtagtactgtggctgtagtaaagttttctaagtataatattaaatttcttcctaggatttgctattcttggacaggatctctcatattattattgtaatggttgattgtatcgacttttcaccatataataagaaataccagccaaaaatcaaatgtaagtattgtctttacctttgttaatatggtatttcatagctgaaatttcagggaaaattcttacagctggcttttcttagtttactttataaacttaccagattattttgctaattaagcaaattttcaatgtagagaaatactgttagaattgtctacacatcttttggttagattctccaatgacagttatggctgggcgcactcctaaattctggcagttggcttggaggttggcctccattccagggctaggatcgggtagtgaatgagtaatgggtcagtcttggttggctacataaccggactcaatctcacaggcacaaaaccccaagcttgtttttgttttagtatattttccaaggcataggttttttttttttttctttcattcttttgtgtgtgtgtgtgtgtgtgtgtgtgtgtgtgtgtttgtgtgtgtgtgtatgtgtgtgtctgtgtgtgtctgtgtgtgtgtgtgtgtgtgtttgtgtgtgtgtgtatgtgtgtgtctgtgtgtgtctgt

SEQ ID NO: 562 - DNA, 1000 bp, mus musculus
tttaacaggcaattcataacagctttaaaaacagttctttaagaacttcctacaatgcactttgatcatattcacatttttctacatctccttcccgatctattcctcttttgctaccaacctttgtgtcctcttttaaagaacaaaacccagtggaatcaaaattgtagtgtccctgtatccttggacttgttgtggctttctgctagcacatgtttgatctagcaggaaacacactcttaaagaaaactgaccaatcatgccctgcagttatcaattgtcaataactcctcagctaggggtgagtccttgcacccacctccaccctccatgctgggacttcatctggcttgagctggcacaggtcttgtgcatgtttacacgattgtgagttcttatgtgcatcggtggtggtggtgcacacctttaatcccagcacttgggagacagaggcaggcgtatttctgagttccaggccagcctggtctacaaagtgagttccaggacagctagaactatacagagaaaccctcttgaaaaaaaccaaccaaccaaccaaccaaccaaccaaccaaccaaccaaccaaaaccccccaaaaaaacaaaacaacccccaccccccaacaacaacaacaaaaacctgttgtaagctggcccgcagcctacatgaaccgggtatttctggaaggcaggctggggctgaaagagacttagactgcgcgaaaagataatgaagtcaagacaaatgttctgatcaaggcccatgattttactcagagactgtgcctaaaaaggggaaagcccatccctgccaatccattcttggtgcctggagccagcctgcaggcgaagtgcaggataggatgtgtcttccgggatgtctaaagggtctctcagcaggtagcagagtatctgagaagggcagtggtagttgacataacaatatagccatctaagtggaaagctacaccccagttgatctcatattcactggcagcaa

SEQ ID NO: 563 - DNA, 1000 bp, mus musculus
cttcccttcccttccctttctttcttactgaatattttatgtgtttgcatttcaaatgttatcccccacctgttccccatctccctgctttggagagtgttccccctcccacctactcacttccacatcactgccctggcactgccccacactggggaatcgagccttcacaggaccaagggcctttcctcctattgattccagacaatgtcatactctgctacatatgcggctggagccatgggtccctcatgtgtactctttggttggtggtttagtccctgggagcttgcgggggaggtggttctggttggttgatgatgttcttcctatggggttgcaaactctttcagttccttgggtcctttctctaactcctacactgcagcttgtgctcagtcaaacggttggctggagcaccctcctctgtatttgtcaggctctggcaaagtctctcaggagtcagctatattaggatcctgccagcaagcacttctttacatccacaatcgtgtctgggaaaggacccccatttgggtcagtctctggatggcctttccttcagtctctgctccatactttgtctctgtatttcgtttagacaggagccattctgggttaaaaatttggagatgagtgggtggtcccattccccaatggaggctttgcctaacctctggatatagtctctacaggttctccctcccctttgttggttgggcatttcagctaatttcatccctgtcaggtcctgggagtctcttgctttcctgtcatctgggatatgctggtggttaacatcagttccccatcccccattactataaatctgtccagctccatctcctcctataccagatcctgctctcattccccccctttcttcctcccaagtccctccaaccctctacctcccatgactattttgttaccccttctcagaagcactgaaacatccacactttggtctgtttagctctgtaccccattttaaaatttg

SEQ ID NO: 564 - DNA, 1000 bp, mus musculus
ttttgccttgctttcatgcattcccaggtataatcaatattgcatgttaggcaattgtgtttaaattggtctgcttgagaacgttctgggaagtggctactgtcaaaatttagtatgtgcttactggcatttatttacatgtgtttctgatcctgtttttctgaactcaaacacccttacttggatcattgctctcttttcttcagtcatgaataaaagcacattgaaactgaaatagagttgtctacaacattagtctgtagttacccaattcttccaggttctcagataccaggtccagccggcaagatctgcaaaggccagataagaagagtggaccagagactgaaggaaaggtcatccagagactgccccacctggggacccatctcacatgcagacaccaaacccagacacgattgctgatgccaagcagtgcttgctgagaggagcctgttatagctgtttcctgagaggctttgctagatcctgagcaatacagatgcggatgctctcagccacccattgaacagcacagggagaccaatggaggagttaggggaaggactgaaggagctgaaggggtcttatctgggatcaatgggaggggaggaccttagtcctgtaaaaccttgatgccccagtgtagaagaattctaggtcggtgaggcgggagtgggtgggtggaaggcggagcaccctcacagaagcaggatcagagggataggataaggggtttgcagacgggaagccgagaaaggggataatgcttgaaatgcaaacaagtaaaatatctaatttaaaaagttcgctttaaaaaagttgacaagtggcacctgaatcagctactggaatgaaaagttgaaaatgaaaaccagcaccatatattgagttgttacaccatttcttaaaaagaagggtgctgcgaggtcaaagcccagctcaagtatgttgggttttaataacagaatataatccttgggttcctgaaaagggcagt

SEQ ID NO: 565 - DNA, 1000 bp, mus musculus
cagaagacatattcttgttttcagttttttagcaaggagaaaagtaattagaattatgcaaatgaaatgtcaggatacccatcctatgctatcaagggggaggtaaagtgtataattattaaataaagatagaacagttagtaaggcatagttgtcttttaagggaaaactataactttcattttggaaagactaaaatgcagtgttaactgaatagagaagatgtggtgacactacttaaaaactgaccaatatgatgacaatggctaatagggtgtatccaacggcagtaagtgtcacaaacgaggtgtgctatatcagaaacaagtaaataatttaattttctgttcattttgtcagttcctaccattagaacagaagatagtgcctatctaaaaatgctctcttagcattaatattttaatgatgaattaatatatggtatggtctgatttaaactatgttctcatggtcgtagaatttgtgtgatcatttctttataatttaaagaaatgaatgaattatttcatagaaagaggctttgaatttgttgttactcagcctggctttatttttttgatatttttattagatattttctttatttgcatttcctatgttataccttttcctcctttcccctctgaaaacccccctatcccatcccccacccccctgctcactaactcacccactcctgcttctctgtcctggcattcccctgcactgggaagatcaggggcttctcctctcattgatgtcctacaaggccattctctgctacatatgcagctggagccttgagtccctccatgtgtactctttggttgatggtttagtctgtgggtcctctgggggttggttcatattgtttttcctcctgaggggctgcaaaccccttcagctccttgggttctttctctaactcctccattgggaaccacatgcttactccagtggttggctgagagtatttgtcaggcactggccgagcctctca

SEQ ID NO: 566 - DNA, 1000 bp, mus musculus
gaaacaactttttttttctccttttttagttttttattattagatattttcttcatttacatttcaaatgctatccggaaaaccccctataccctttcccccacccctgccctgcttgccaacccacacactcccgctttctggctctggaattcccctgtactgtggcatataatcttcccaagacaagggcctctcctccagtgatggccgattaggtcatcttctgctacatatgcagctagagacacaagttctgggggtactggttagttcatattgttgttcctcctatcgggttgcagaccccttctgctccttgggtactttctctagctcctccattgggggccctgtgttccattcaatagatgactgtgagcatccacttctgtatttgccaggcactggcatagcctcacaaaagacagctatatcagggtcctgtaagcaaaatcttgctggcatatgtaatagtgtctaggtttggtgactgtttatgggatggattcccgggtggggcagtctctggatggtcctttgtttcatcccagatccaaactttgtctctgtatctccctccatgggtattttgttcccctcttcggcagatggatagatctggaagatatcatcctgagtgaggtaacctaatcacaaaagaaatcacatgatatgcactcactgataagtggatattagcccagaaacttcgaatacccaaggtacaatttgcaaaacacatgaaaatcaagaagacataagaccaaagtggatacttcgttcctccttacaatggggaacaaaatgcccatggaaggagtatggatagaaacaacttttgaaatctaatgtccttgttttgaagcccagcgttaccactgagaagcaagttgtgtactagttttcacattaagttacttagttaacaaataggagttctgtatcaagaacaggatcaggattatcagatcagttgcccacaaatcactagaaaagg

SEQ ID NO: 567 - DNA, 1400 bp, mus musculus
gcaaaaatgttaacagaactgtttaaaagtctgtcacaagcacaccgattttctcagaatgctaagttgattttctgatctaatattctgaatgtcacttaagcaaaattaaatatccttatgtaattattaactaaaaagtacaattttatgtatttaaaataattgttaaaatattctgtcattattaagtgattctgataggcttgtcaaagtgcagtagctcccatcaataaatgttctgagttaaaagttgaaagcaatgtccaaagtgaatttccactattttaaaatgaaaacttgtgaggaacagtgacatcagctcactaggaaaagatgctctagtatcactccagatcattttaaaatggttttgctgattacaaagtagtacatgttcagagtacaaacgataaaatgattatgaaagatagattgcttttgttgtaaattatgatcaagagagaaggggcattaagggaggtttctagttatagtaatacttgttttaaggaagatatgaaagcaacattgtaaaaaaatatttatttcatttcccttacacattgggtgtatagtttattttcttcaattttgatttttttttaatttaaaataaaatgtttgtttagttcatattgttgttcctcctatagggttgcagacccctttagctccttgggtactttctctagctcctccattgggggccctgtgttccatccaatagctgactgtgagcatccacttctgtgtttgtcaggccccggcatagcctcacaagagatggctatatcagggtcctttcagcaaaatcttgctgttgtgtgcaatggtgtcagcatttggaggctgattatgggatggattcccaggtatgacagtctctagatggttcatcctttcgtctcagctccaaactgtgcctctgtaattccttccatgggtgttttgaaccagtagccccggagcttgtgtctctagctgcatatctatcagaagatggcctagtcggccatcattgggaagagaggtcccttggtcttgcaaactttatatgcctcagtatgggggaacgccagggccaagaaatgggagtaggtgggtaggagagtggggcagggagagggtctaggtgacttttgggatagcatttgaaatgtaaatgaagaaaatacctaattaaaaaaataaattaaaaaaaatgtttggaacatctataaacctagtccgttcattccaaggtctagactgctatatgaatattagaatgcatattttattaaagtttagagttataaatttgatgttttcctttgaacactgtataatacatatctcatttatagtttataaaatatatttttgtcttctagatcacaaaattctataagtattag

SEQ ID NO: 568 - DNA, 1600 bp, mus musculus
gctgggattttcataatatggaatttttttttgacttttgattgtatgcggttctagttatcctcttcctatagttgctttctatcacattgaaaaagtgttccctaccataccatattctcttctttgcacattagtcttatttctatatgtagctcaagtagttctcatttctacaccaagtgtgtctatatttgtatgctcagttaaaatattcttccagtagaacatgtaactattatgtgaaatgaatgtttttacacttttattattaaattaacttactatgttccacagattggtgttacacccttcatgctcctgcatcagtcttttgagtgctagagttttaggtacgtggcaccatttagtaattttgcaacagtgaatatctgggagaaaagaatttgtttcattttcagacatatttggttcttgctattatctaaggtggaaatttcttgttttgttggagactcgggttataataatgttttgctggggcacataggtgaaagaatttttgctgaagccgacacaggtgaaaggatgtttttctatagcaaacacatgaaaggatgcatgatgtttagaaggaatataaatatgacccaacagacagtgggagctcaagtattggttcacattgctctgcctcactggacttcactgatgacaggtatggcttgatttgccttatattgcagagctttgcttgtggcaacttcatagagagaaacccaccaaaaacttcttgtgagattcctgtggcttcttgcctcttccattgactctctccgattggcgagcctcaggtttcttctggattaaactacccttgctgattcatgtgtggtgtctgctgagtggactagactgcaatggctgattcgtgtgtggtgtctgctgagtgggttgaactgcaggtgctgttcatgtttggtgtttgctagtggactgcgttgagaacaacaaagattggatttgcccccaaagaactatttctaaacaggtcctaattctttcccactaccttaagtaggtgctgggctaaaagagaggttgaactcttattaaagtaggttgtgaaaaacatatgcctacaattatcactcttaaaatgtaagtagatgtaaacgaaattatttagtttttgttttttaatcattatgcaaaatggataaacttacaatatatatgattctgtagtttttaccctattcactgttatccaaatctttttcgtacttcactctttattctcacagccttaaaggtgcatttcaatttgctctgttggaatgagaaagggctgcatgtgcaaagaaatagcttgccttatccaaatatttattctgtttatcattcaacaactgatttcttactctcttcaagagactaactggcttcattaaggcttaaacaagagtttcaaaaatctctataaaagtgggattgattagtcaaaacaaggaaaagaaaattagccttactcttttaaacattaacatctgagaaaattacttaataactccacatcaaaattttaatttacataatcaaactatggcagcattccacgagctattcatttacattt

SEQ ID NO: 569 - DNA, 1000 bp, mus musculus
ctttttttgaaaaattaaacaattttatttatgcacattccagtcattgccccctcagttgctactcacagttcttcactccattccttctcctccttgcctcctatagggcgcttccccccaccacaaggcctaccccttccctggggtctcaaggctcttgaggattaaatgcatcttctcccactgaggccagaccaggtagacatttgctacatatgttccagggaccttggaccagccagtgtatgttcctggttggtggctcagtctctaggagctcctggggtctgggttagttgagtctgctgggcttcctatggagtctctctccctttcagcttcttcaactcttcccctaatttaatcataggggtccccgacttcattccaatggttgagtaaaagtatctgcttctgtctcagtcagctgctagtaggatctctctgaggacagtcataccagactccaatctgtaagcacatcatagcatcatagtgttggggcttggtatcctccctgtgagatgtatcccaagttggacgggtcattggaccacctttccttcagtttttactccagttttgcccctgcatttcttttagacaggagccattctgggtcaggaattttgactgtgggttagtaaccccatccctccacttgaggacttatctttctattggaagtggacttttctattttcctttccccaatgatacatattttggctgaggtcactctcaatgcgtccagagagtgtctcactccccaggtctctggtattctctatagtgtgtagcccacctcccactccccaaggctgcttatttctaaattatcttgaccctctggggttctctcttgtctcacacccccatatatgatcccatttcccttttcccttcacccttccctctttcacccaggtccctccttcccttagcttacctctatcactctgtcacctttctaggtggggttgaaacctccttaggt

SEQ ID NO: 570 - DNA, 1400 bp, mus musculus
agtgtgagagagagacgacaggtacataagtgttgcctctccagttaccaaaattaccttctgtgtataatccacactaagcccttgtttgacagggcattttgttaatactgaacattctctgtgccagtcactttaataagcatgatagataaactctttcttttaatacttccctaagtccaatgagaccctcttatcctagaaatccattgtaaagatgttgaaaaccgtatctttggtaaatgaaacgacttactcaactcacagagatgtgctagcaattaaatccactgcatctgtttttagacatccagatacacaaactcttattttaatgttgacaacttctcattaacagaaccaattactaaaagggatcatactcatgtaaatatttgctaatgaccacaatttgttagtacttttaaagttcaatgctgttgcactgttagcaaccacatgctttgttgttctttattcatttatttatttatttattcattgctttccaatgctaaacaaagtattgtgaatgtgtaaaattcagacctttggatttaagacacattttccatgccaaactaaaaggaaaaaaaccactttattccttttcaaaaagagatgaaagagaataaatgtaatgggtgcctactgtctcctgcaggttcccatggcagcatagcaggctcaagagccatcagatgttggggatggggggggggcaggagaatgagagacagagaatggagggggttgatgctggttttcttgcatggaatcacatcagagagtatgtaggagctgaggcaatgtgatggaagggaactgaagcagaggaacaggtcgggtgggggctaggctttcatggtgtgtcctgatattcttacttctcatctccttgaccctgttttgatgatcagggacacgcctgtcctctgtcacatagtagctgagtttgttttcaatttcttccacgatgtttttcctgacttctttccttccttcatagctatgtaaacacttagggaatcaaaggcacacaaatctgctcatcccctctcatcttattgtaccttctcattgcttcctcttaaacagctgagaaaacccgtaacatagtactagcatgccattattataatggcaaaaactcgatcagatttctcagactggaggtttatactgagaatgtaattaagttgggaatagaaagggagactcttgtttcaaattgtttgaaataatagacaaatatatttgtgtacattgatacttctctttctgattttcttagtttacttattgattacataagtcataaaaacctggctataaacaaacactgtgacaaatgactctatttttaagtgctgatcaaaatcatatactgtttaaat

SEQ ID NO: 571 - DNA, 1400 bp, mus musculus
aatgttttacttaccaaagtaactacttaagcacataattattatttagtaaatatatataatacatcaatatgaattcaatttgttttagataatttcaggtatataacacataaatgtgtataaaacatacctatgccaccttttaataccaacaatgaattccaagtatttcattatttatattttgtatatattaccctagtacatagattcaaatgttttaatcttctttatttttctccgtttaatgaatgcgaatgtattttaaaagtttgtagcatccatttttccttttttattaattattttatttatttgcatgtcatatgtcgtccacctttctggttccccctccatgatatctctgccccattgctactcccctttgccttaaagagtaagcttactttcccccagagtccataatgatatttaagattgcatcgactctcacctcagccctctagcatcctacttctctaggcatcaattctccacaggactaagggtatcccttcccattgaggtcatataagacaatcctctgctacatatgtagcaggggaccatggaccagcctatgcatgctcattggttggtgacttagtctcttggagctgcgagggatccagttagttgatactgttgttctttctattgggttgcaattcccttcagctccttctgtccttctcctaactcttcataggtgtccctgagctcagtccaatagttggttgtaagtatcttcatctgtctcagtcaggtgctgatacagcttcctggaggacagctttgctagactcctgtctacaaacacagcatggcatcagcaattgtgtctgggtttggtgcctgtgcatgggatggatcccaagttggggtggtctctggatgacctttctttcagtctctgcttcatttttaaagataagtacattacttaatttagaatactgttcattttttctttgtgaaattataaagcttcatgtaaacattcacttttaaattattaatttgtaaaatatttactgactgttagcttcagacactggatagcaatgtagacagggatatagacgtgtactcggtccacttctaatcaagttcattattttccgccagagtccataattgacattcaagaacaatcaacagcacccatgcctaatgttgtatcttatttataacctgacaccattccttctttgttgtcacttttgattttgctgatgacccgtatcaactatattccttgtttttacccagtaaagttctgaatatcattgctttttataatgcccagattttgtttgcatgcagatatcattatagtgtgaaagtttataattttaagcttccataattggactttctgttgcatagctagtaag

SEQ ID NO: 572 - DNA, 1400 bp, mus musculus
ctgcttattaactatgtgtaagcaaatgaaagaatgcatgagtacatgatgttgtgcctggctctcagctgagcgcttcactttgcttctcaagtcatctaaataaccctgtaatttagattagattagattagattagattagattagattagattagattagattagattagattctgccatatctcagcacactaccaggtacattttctagagtatttgcaaactatgaggttcattctgtatagtgcaacagaaaatcatgagtttagacttataatttaaccattaaaaagcaaacatatccttgcagccccacagctcctgggctaatttgtgccacacacatcaatacaggactctgcatgtagcaggactatagactgagacatgagcctcagcagcagccttggcccaggaccaaggcctttgttggcatcacaagccacccagatcagattgtccactggtatcagtacagtctctggtcatgaacatggtctcaggaagctttgcagactattgacatccagaaggtctactgttacagtagaggccacagacaccagtatacaaccacattgggttttggtcctctgcaacatcaccatgtccccaggtggttgcagagattcctcatagctgcctgttcctcactgctgtccagtgtgtccagttctgtctctctccaaagtacataaaccactaggctttgcttcctctcccatctctccaccatttactccaccaatcccttctcttcatcatgaattgttcatcatagtggcacctgccatggggctaggctgggcacttggatgtctctcttctgggctgcccagaatatgtttgctttttaattgctttttaattcctgtgttcctgtcattgggggccagctctcccacaccacaccaccagattcagttctcccatgtcattcagacaagaggtatgaccaactctcctgagtaaggtagccagtgaggggcagggacagatcagtatactgcttatacctaaaacatggcctcaggtggtagccaagaccagggacatctgcgtggtaacatgggccacagatatcaatatagattctgtgttcaattggatcatggacccagatatgacccttggtggcagcatgggcccaaatgtcatggttgccttaagtggaaattcaggccactcagattactatggccctgtgagacaacatggtcctcagacatccacatggtttctgctggtactccagactatcgacatcagcatttgctaggctcctcatctgctgtgcagtgaccattggcaagggactacctttcccctgcagcccttcactgtgacagatgggagagctagccctgcctctcattagacatagagcacaagacag

SEQ ID NO: 573 - DNA, 1600 bp, mus musculus
aggcaattctttctttaccatgatagactattgctacttgccaggtctgtggttacaaaaataagacaagtcactaacccagctcatagtcagtactttcgggaaacaaagtaattgatgaaagtttatgccagctttcttctcctttgtattcagtccaacacctggaatcacattgcccatatttaagtaggttttcttaaatcaattaacacaatttagaaactctctcacaaacatattcagaggtttgtagcccaggttctgtcaaggtgacaatcagtgttaactatcacagcagctaaagagttgaaacaagtcaacaggaccccagctactgtttcttttgttaattttgttggctttctaaggccattggcatgtggagaagctgcgtacatgtgaagttgtccctcttctgataaaaagattggtcattgccatgaatttccttcttgagcccaagtagatatcctgataaagggtcttgtattttgcaatccgtttcttatgagagtgcttttaaaatagtttctcattcacactcatagttcagttaaaacatgagtttaccttacttcatgttttaagaaatagcatctgtattcagtcaccaaacccagacactattgtggatgccaacaattgcttgctgacaggagcctgatatagctgtctccagagaggctctgccagagcctgacaaaatatagaggtgattgctctcagccaactattggactgagcacagggtccccaatggaggagctagagaaaggaccaaaggagctgaaggtgtttgcagccccataggaggaacaacagtatgaacccccaaagctcccagggactaaaccaccaaccaaagagtatacatggagggacccatggctccagtggcatatgtagcaaaggatggccttgttggacatcagtggaggagaggtccttggtcctcagaaggctcaatgccccagtttagggaaatgccaggacagggaagcaggaatgggtgggttggtcaacgaggagtggtggtgggggtgctggggggatgtagtgggggggttggaggggaaacgagggaagaggataacatttgaaatgtatatttaaaataatctaataaaaaatggagataaaacaagatgcctaaaaataaaaacaagattgctgagctccctggaagaggttcaaatgaagtgaatcaggaagggaactataacatttggctctgtctgtatttggtgcagttgcttcaagtttcaagcttttgttatctgtcatacatgctgggggtgagttttgaaaatacagctatctttgaattatgtaagttacctctcatcatatagtcctataattattcccaaaccaaacaaaaatagacatatgtggtatccattctttgtttagttgtcagtctccttgcttggtgtggagacatttttttccacatcccctaaaaataaagtcacacaacagtccagtctcccactagatctccactagatctcccactaggtatcctagatctcccactctttatattttttaataagaattttaagctatgttctaagttaagtttaaatttaat

SEQ ID NO: 574 - DNA, 1600 bp, mus musculus
ttaagagcttattcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcacgcgactcagctggcaaggtagcccggggctcgagtctcgagtcgagcggaagggacttgtgccccagatcaggcccgggtagcctgcttccctatgtaccgcagtctcaagttccgcgcgattggattggggcaggcgctgtgttccactcaccagaggtcttagggtcccgtggggagtcccgtgtgggcccttgcgggtgttgggcaagactctgctggcaaggtagcccgggggtcgagtcgagtggaagggacttgtgccccagatcaggcctgggtagcctgcttccctatgtactgcagtctcaagttccgcgcgattggattggggcaggcgcttgttccactcaccagaggtcttagggtcccgtggggagtcccgtgtgggcccttgcgggtgttgggcaagactctgctggcaaggtagcccggggctcgagtctcgagtcgagcggaagctttccaactgtttttattcagaatttacaacttgtgtagtgtctgctgctgctgctgctgctgctgctgctgctgctgctgctgctgtttgtttaaattcagttctttgaacatctacctcatttggcgagcctctcaaagcatttcttcatcaatcctacaaggagtacacaggctatcatgacaggggcctaaatttatatatcacttaagctgtgtacttgtgtgtatgtgtgcatgtccatatccatgaatgtgtgtgtgagtgtgtgtgtatatgtgtatgaaatcttagacattgtacctaaactgagtctttcttcaaccttaatatatatatatttgccttgacatatgttatatatgtaaaatataacatacataatatttgccatcacacggcgatgagaaataccctgctcagtagctcaaatagccttccttcattattcttcttccttcctttttttcttccttttttatttccattttctttcctcgtaatttttttcttttattcagtatagttttttgattactaggtccgagcaccttagacacaaaatgtttttccaacttgaacatggacttagaattgaatattctcaagactgtagttctgaaacaaaatgctgattgaaccacatcaataaggatattctaattactacttatttgactgttatagaaaattcttgtcatttaatgttactgttttcagaattaatagtggtgacagaaattaatgctgccttgttttataccagaaaaccaagttttgtgtgggctgcttcctagtttaagcattaattcaatttctgaacaatgaaagcgttatgttataataatagaaaaaagtaatctatatcatgtaaaatcaaagtggaaattaacttccagagaacaat

SEQ ID NO: 575 - DNA, 1200 bp, mus musculus
tcctagttccttaagtagggtttctgtttgttcattttgatgttttgttttgtttttgcatgtctcttttctccttgtgtcagtctcagagttcacttactgctttgaacaacagttttctctcgtgccattgtaacagaatacctcgatgaaagcaacttagggagaaagaattctggcacacaattcaaggggacagtcaatctgagtggagcggtcaaggcaggagcttgaaacagctggtcacatgacatccccaatcaggaagcagagatcagcagatgcatgtgactgctcggctcccttcctccacttgaacaatccaagatcccagccggaaacagtgccgccacaggctcagagaatatgccaaggcaatctcccacaggcccgcccagaggcccatctactaagggctcctagagtctgccaagctgacaattaacacaccacactgattcatttggaaatatctcataagtcctcctacctttatttggttatcttttccttttcatctgaccaggcaattcttactgacctctctttacttccttgactcctgcttctgcttggctcaatgtctgttgacactttatttcattgtctttttttttcactcagtgcaatctttagcctagtaagttgattcttctttatgatgtctatctcttggtgagttctctttgttcctttattgtcttttatgatcttttattgttgttcttgttgtctgtgttcacttaaacatctgcgaggtcttgaaagccattatttcgcattattctgcttggttgtatgtggggtatagaactgtacatgtgtgtgtacgtacatgcgtgttgagttgagagactaatatctggtgtcactcttaatcatgtttcactttatatttctgagggtctctcactgaacctggggtcagccatccagctggactagctggccagggaaaactagggactgtcctgtctgtctccccagagctggcacatttctcttaagatagaaaccacttgacatgttgaaatcttatttttttatttgcctctttcatcattattttgattatacacattcatgtgttactgtgtgacaatttgatatgtgcttgtaatacatgatgatccgacgagagtagtcaacatttagagatgttatttttaaagaagaaaaattccaatactttaccccaaa

SEQ ID NO: 576 - DNA, 1000 bp, mus musculus
agaatagattccaacaagtaagttttaagaggaggattaggaatttggattcaagacaggtggggattttcatttaggagacaagacttaaattaacctttaaagagaaaagaagggggctggagagttggctgagcagttaagaaggctgactgttcttgaagaagatctgaaatttggatcacaacatccacatcagaaatgcttataactcaagttccaggggatgtatgacatcctctgacttctgtggatacatgttctcacatgcacaccccctacatacataattaaaaataaaataactcactaaaaaggaaagtaaggaaggaaagaagggctggcaagatggttcagtgggtaagactgaatgctgccaagcctgacaacctgagttccaatcccagaatctacatgttggaagtaaagaattaagctttttgacctacaacacacacacacacacacacacacacacacacacacacacacacacaccacattcctgtgaacaactgatttttgataaagaagcctaggcactaggaaaaggtcaccatcttcaacaaatggtgctggtctaactggatgtctgcatgtagaagaatgcaaataggtctgcacttatctccctgcacaaaactcactatctaatgatcaaagtgtcctaccccttagtcacacctccagcctatgaccttctaaacatttcacatatatttatttcagaaaagtatttttctaatttaacctttttaggaaattttccttcattttaattttggttgcttccaatgatgagtttgtttcctctttttttctggcaaaatattattctattttgtctgtatgcctatattaatacacgtcatatgcacatatcactatatatttctgtttctacaaccatggatacgttagttatttctgtatattggttactgtcaatatactgcagtgaacatgggcatccaggggatcttggattgttcatgaaaga

SEQ ID NO: 577 - DNA, 1000 bp, mus musculus
caatagaaagatgcacatgagaaagatgcatggtgcgtaggatttctaggtagtgaataggataaatggtcatcaactttgtattcttttttcctaaatatagggacacttttcttaaatatatacattcatatttattttacagatatatttcatcaagaacagatagtttttacattgccttttttgataataatgcaactaaaatctttaacctccgtgaaatatactcgggtggatttttttttttgctgtttttgttgagttagtgtgtgtgttcacacatatatgtgtttacatatgtatgtgtacattaacatgtggaagccagaagttgatatttgaagtttgtctcaatcacttttcaatatataaaaaaatatatatatatatcacatataaaatatattttcctatatacttatattccaatatatattatctcatcataatatatagttcttttttacagttttacattttaattttgaatgtgtgtgcaactgtgcatgtacatgtttgtgtgtgtgtgtgatttaatgacttagacttaaaatgatgtcagaagaaaagcaatttaaaatcaataagagggaaattgaaggtataattgtaatggtttaatggttttacatgtatgagagggccgtgtgtgtttgtgtgcgctcgcgcatgcgcacataagccaaggggggcgggatttgcaggtgtcagcattccatcacgcagatctagatattgaactaggtttttcaagtttgatctgctgagccttctcactggttcttctaccatatttttcatgtcttttactgaatctggagctcaacaaaccctctggatggccagaaatccataagggtcctcctgtctctgctctcctatcacaggggttacaggagtgtcctggttcacctggtttctctgtggatgctggagacctgacaagcttgtaaagtcatcttcccacccgctctgtggctacaattacagattaaag

SEQ ID NO: 578 - DNA, 1200 bp, mus musculus
gcacagtttacagaaacatggtcaatttatcagtgtattttctactgagaaaatggcagcctttccttcagtactctttaactgcccattgaccttatgttaggagttgggccccatgagcccttctctggtgagtaataaaatggtattggtttcggttttgtacagatttttgatttctgactggtcttggcaagaacccatggatgaggaaatcataggccctaagggagtatctactattgttgttttgctaaatgtcaaactgtctgttgattattttgtacccacgtgttagtataacactcagcctccaccagaagaattttgtccagtggtcagcagttaatacagagactcagaacttcctgaggggcagagaataattgattgtggtaagattccacattaacctgaaatctataccactccccttccccaaggctttagatatcccagagaagagaaaaattataaaactcagaaactggggaagagtattctgaaatggtacctttgcatatagactctagaatgttactggtgatatcagatcctgtgcaatttctatttgttattgtttgaggaagcactatactggtttgtactagctctgcaactaataaacgtcctccttatccctacttatcaatgcatcacatccactgagagtaccgagtctcctagtatcatatatgtgtataagggctcctcacagcctcttattagccttgcctgaaacccattaagaatgtgtgctggggctccccatctcctttcattatgtttcttaccaactgagcatgtatagggggcccctccccatctcccctcacccttgcatcctactcacaaagagtatataggggtcctccctgtcttccctcaccatcacatcctatatgctaagaataagacaataggatgaggtcctcctcatctcctctcactctcgcatacaatccactaagtgtataaaagaaagctgccatgttctctcaccatgacatccaagatactgcttattgcttgctgtcttgacaataataattttgaattgtgtgagatgggaccctattttagctttaatttgaatttctctcttcagctttataaatatatttattggctatttttatatcttttttaaaattaccattcattcagcctatttcccacttattggttggattttcttct

SEQ ID NO: 579 - DNA, 1200 bp, mus musculus
gaaaaacatttggaaacatattaccaaaaacaacctatgtgatgtaattcaaaatttaaatatttaaagcccaatgacccaatgtgcaagggaatacataaagatgtatatgtgagccaaatatcatattaagaaacataaatatcatcattcagtatgtccaattttgagctatatttatttatataaaactgttttgcttatgatatttaatttagagcttgttagttctttctcagttaatttgaaaatgaaaaccttcagttatcaattaatttaaagaataccaaatcccagtgacctatagctattgagccctttaaggtcctaaaatgaaaaatattgaaaaccactgcctccagtcatatacttatttaaattttatattcagtattatcatttgtgcatatgtgtgtgacaactttgtgaagaggattctatctaaatttacaaggcttatcaggcttggcatgcaacaagtctttttcctgttgaacaatttctatacttttcattagctggtatttgaagaaatatattgtatcaatcagagtaagaaaagacaattgtactgcacaaagagtgctaattatgtatgagacacgatcactagcactttcttcaaattgacttatttgctctactgtgtagttttaggaaggatgtactattatacttcataggctttgccagcactctaaagtgaatcaaaggctctttctgaactagaaaacatggaagacagatttaagccaaataaatctgccatcaatatttttgctatctcattcattgtgattgtgtgaatgttgatcatatagtgtctggttgccaagtcttgtaatccaagctgctagggggacaatggccataagaactcagggccagtctggattacagcgtgagttcagtaacacctgggctgagatccttcctcaaaataaagagtagaatgtagtcaacagttccctggcctaccatatgcagagaacgttgtatgttccatctcaagtactaataagaaaagcactgaatacagctatattcttaggatatcatgagtttagattctctactacttctaaggagacaactctcttattctttgtctcttgtaatcttactgtcccttctcctatgtccagggaccttagattttagggttgtattgatgcattcatttgggctggaatccacaag

SEQ ID NO: 580 - DNA, 1000 bp, mus musculus
tgttttatcatgttatattgttatttttttttttatccctaagaagccagtttgttttccttttgtaaattgattaattaattaattacatcccaaatgttgccccctcccagtaccactcacaaaagttcctccctccatctgagaggacagcacctcatctccccaacctggtgcatcaagtctttgcaggattaggcaaatcttttcccactgaggtctgtcatagtagtgctctattacatataagttgagggtctttgaccagcccatgtgtgctcatttgttgatggctcagtctctgggggctcctagaggtccaggttagctgactgttggtctttctgtgaagttgctatctcaatgagggcctttgatctcttttataactcttccatgggggtcctgacctctgtccaatgtttttctgtgggtatttgcatctgtatcaatcatctgctgggtagagcctttcagagggctgctatgctaggctgctgtctgcaagcatagcatagcatcattaatagtgtgaaaggctggtgcctgcccatggtatgggtctcaaattagtcagccactccttcagtctctggtccatctttgtccctgaatttcttctagacaggaccaatttggggtaaaaagttttttatgtgggttggtgttcccatccctccactgggggttctgcctggatacaagggatggtctcttcaggttccatattccatctgttggaaatttctgctaaggtcgccagcattgactcctgggagcttctacaatcccatgtctctgggacttcttaaagaatacccccatcactgacccctgacagctacatatttccatgtattcttctggccctgtaggactctctcctgtctctccacatgcctgatccttcccctccactcacccagacctcccatcacctactcagattcctctgtctctctacctcccatgattattttgttcccccttttaagtggaa

SEQ ID NO: 581 - DNA, 1400 bp, mus musculus
tacaaatcacaggccacatgaagctcaagaagaaggaagaccaaactgtggatgctgcagtccttagagggggggacaatatactcacaggaggtagagggtaggagggacttgggaggaagagaggagagggagggggaaaagtggggaaggctcagttatgggaggagacagggatgatatacagagagtcaggaaattggacagaagtgtatagccatgagggagagcaaactgagggtagccaccagaaaatcccagataccaagaaggcaagaggctcccaggacccaaaggggatgaaattagctgaaatgtcgaacaaaggggagggagaacctgtagagaccatatcataggttaagcaatgcccccagttgagagatggagctacccactcatctccaattttttaacccagaattgatcctgtctaaaggaaacatgggaacaacttgtgaagcagtaacagaaggaaaggccgtccagagacttccccacctggggatccatctcatatacaaataccaaacccagacactattgaggattccaagaagtgcttgctgttaggagcctaatacagctgtctcctgagaggctctgccagagccttacgaatacagatgtggatgctcacaaccatccattggactgagcatggggacccaaatgaaggtgttagggaaaggactgaaggagctgagggggtttccaaccccatagaaagaacaacaatatcaaccaaccagaacccttagatctcccagggactaaaccaccaaccaaagagtacacatggagaggcccatggctccagctgcatatgtagcagaggatggcctttgatctggcatcaatgggaggagaagcccttggtcctgtgaagactcgataccccaatgtaggggaatgccagggtggtcaggtgggagtgggtaggtgggtgggggaacaccctcagaggaacagggagaggaggggatgggataggagtttttgtggaatgtaaaccgggaaaggggataacatttgaaatgtaaataaataaaatattgaatttagaaaaaaataaagtcagccattattgtaatgggcctgtctttatgctatttagtctttttctcttgaaggtcttagcctttgtttgttgtatatatttagtggtttggttactatgttacataaggagtttattttctagtgctgactatttgtgttcattatgcctttattacttctgctggtgagaagatataaataatggagatggtattgtgggggtggcacggtgctcaagagggtgaggagcaataaatcctggcatgctctgcatagtccagtatggatgagggcaaagggtgactacctgtgtcccacccagctgtgtacatctatac

SEQ ID NO: 582 - DNA, 1600 bp, mus musculus
gtcaggtaggattgggagtgggggcatccatgtggagacagggggtagggaggaggtgtgggatgtggaacagttgtagggtggatcaggggtggggcaggaaatggaatatggtgtgtaaaaatgaatttaatttttttaaatgaagtgatttaagatagaaatgagagaaccgagcagaacatctttatgctcctctcttcatcttcacttctctcctagacatagggaagaacacttccaggagactgcacaacagagcaatggccccagggcactactccagctgcttcagcaaaaaacatcccatacatcttccttctgagcccagcagaggccactaaggactccagagtgctctccatgctgcaggacctcgggatcacctcaggaacacgggtgagtggaatgcaacatcagctccaaagaatcgtggagggtcttgtgccggcaggaacagggaaaaaggaaccccaccccgaccagaggctgggatctgttctcgttggggtcacccaccccatccccaccaccatcttccttctcagcccagcggaggccactaagggctccagagtgctctctacactggagatcacgggtgagtggaacgcaacatcagctccaaagaatcacagagggtcttgtgccagcaggaacagggacagaggaactctgcccaaccagagactgtgatccattccagttgaggccagcccctccatcttccttctgagcccagaggagggtgctaagggctccagagtgctctccacgctgcaggacctcgggatcacctcaggaacactggtgagtggaacggaataccagctccaaagaatcgagaagggtcttgtgccagcaggaacagggacaaaggaaccccgcccgaccagaggctgggatacattcaggtcagggccagcccaccatttgctgcgtgaaaccagccgagggcatctagggcaccagagtactctccacgccacaggacccctagcacaccaaggacctcctgatcatctgagagcacatgggtgatagaagcaacagagcttcttggtcacggtcccctcggaccttcatcctcagccaggaggcattgctgagacccagatccctgggcacattccttgccagaggagagttggcctacagggagggttctgaccccagaactcaggaggtggatcagagctccagactgctgggacacctgccctgcaagagaagagtttacctgcagagagtgctctgaacactggaactcaggtgagagttggacttccaggagctctgacagaggctaacaaaatcacaggaggatcaagctccaaccagagacagcttgatcattaacaccagagatttccagatggtgaaaggcaaatgtaagaatcttactaacagaaaccaaaaacactgggcatcatcagaacccagtatgtccaccacaacgagtcctggataccacagcacacccaaaaaacaagacacggatttaaaatcatatctcatgatggtggtagaagatttaaagaagggcattaataactcacttaaagaaatacaggagaacagtgctaaagaggtagaaacc

SEQ ID NO: 583 - DNA, 1600 bp, mus musculus
cactagcaagattttatcgaaaggacccagatgtagctgtctcttgtgagactatgccggggcctagcaaacacagaagtggatgctcacagtcagctattggatggatcacagggcccccaatggaggagctagagaaagtacccaaggagctaaagggatctgcaaccctataggtggaacaacattatgaactaaccagtaccccggagctcttgactctagctgcaaatgtatcaaaagatggcctagttggccatcactggaaagagaggcccattggtcatgcaaactgtatatgccccaatacaggggaatgccagagccaaaaaaaaaaaaatgggaatgagtgggcagggaagtgggcgggagggtatgggggacttttggcatagcattggaaatgtaattgaggaaaatatgtaatatttaaaataaataaataaataaataaataaataaataaataaataaatagaaccatatacttgctgttttatgaataaggctttgtaaacaatatatcatgaaaggagttatgtatacccagggctatgaatccctgaaaatattaccttccccacttgaaaaaaagttacttttatgaatactttaagatgtagatacacgtacagtagccatttgtattcccttctaagagtttcatttaaaagcgtgtgctttggttttccagctgtactggctagttttgtgtcaacttgacacaggctggagttatcacagagaaaggagcttcagttggggaaatgcctccatgagatccagctgtaaggcattttttcaattagtcatcaaggagggaggtccctttgtgggtggttccatctctgggctgatagtcttggttctataagagagcaggctgagcaagccaggggaagcaagccagtaagtaatatcccaccatggcctctgcatcagctcctgctccctgacctgcttgagttccagtcctgacttccttggtggtgaacaacagtacgaaagtgtaagctgaatataccctttcctccctaactggcttcttggtcatgatgttttgtccagaaatagaaaccctgactaagacaccagctctccataaactcatactatagctcacaaatgcaataatatccttaaggaactggatgttgttttcattcgttcttccaggcataatcaagaacgtaatcgaaactgtgcactgagccacttgctcccatctaaagtagagttttcatccattccaaagtgttccaacaagtttgtgtgaaggcaaaactcaaagtgtaaagagaaacatagactgaagaaaaaaattcccagttatcggtatctttcagaccaaaatttacaaaagggttttgtagttatttaatagtacaaagtgatatgctgattgcacagagtatgagctttcaaataataattgaacagaaataataaccattattaataataaagaaaagtatactgtgaccttctagcttcaatttaaactttaaatcattatttaaacatttaaaatgaaaatcaatatgtgtgtatacatagtataagtatatgctatatgtaatgtaaaacaacctatcctaca

SEQ ID NO: 584 - DNA, 1000 bp, mus musculus
gagggctccctattttgattcaaagattctttcaacctctgttttatggtatctaatctctcatctaatttctcagtgtcttctttctccaagtctgtctttttctgatttctcccgaagaggacatacaaaactgtaatcattgtcaaaatagccatttgtatgctgataaatgaaccaaaatcatatagagtccagatgcagagcgtcattgtgcttccctccatcatatatatgtgtgtgtgtgtgtgtgtgtgtgtgtgtgtgtgtatactaatcatgtatatatactcatcatatatactcatcatatgtatatatacatatatatgtatgtgtatatgtgtgtgtgtgtgtgtgtgtgtgtatacacacacttcaaattttctccataaggactttattttcttatattgcttccattttcttttattgttctttaaattcaataccttatctattaggctcttgggacctttcagtttgtactttgtgctgcattagccccaacccagctgttcagccagctcaggtctccttgttcagccttttgccagttctggccaggcctctccaattttccctacttctaagaagcttcaggacttcatccccggacatccccaatagtttctggcccttgtgtcctgccatgcttggttgtgccagaatctctcaccagacagagggctggagactcagtagacccagactaggctgctgttctccatcggcctcaatataagctgtgctttccagaatagcttgcagctcttgggagaaccgcagcccctgtttctatcagcactgagtgagtgtgccttcacaagccctagaaacttgaaagccatgttttgggggacagttttgggttatatctctacccggtaacttatcacagatagtttggttttatgcctcatgtaaggtgaggcaaaatgaagtacaaccaatttaagcttattcctaactagcttaaaaataaatgagactcagccta

SEQ ID NO: 585 - DNA, 1400 bp, mus musculus
gagttgatatagataagatcattcatgaaatgcaaatagctgtaactacaagaagaaacatatagtcaaaatagtcttttactttactgggcatattttggttgttcaaaacctgtgtttcctttatctgtaatcttcattccactaagctgatgctcttgatttattttaattttttttttggtatatcactgttaacatatgtcaaatacaaaggattaaatactaaaaaattctgatccagatcataaagcctaatagattttaacgtgatccagaaagctgtcccttaatggctttaccaggtattcgtatcttctgaagagtgttgtcctatctactacccagcttcagccacattggatccttggaagcatctcctagcagtgtgggaggttagtgatatttaataaatgatatttatttattattctgtggtcctttcgtgcacagaacatgctggggtttggccaacaggaagaagcatggaccagagttcagcttcagctaacccttctgcaaggttgattaacggattagattggcagtgaccacggaatttataatgtttcagtcccagagactaattaccatttttcttggacttatcccccttaactgccattccttgcccacctctttatctgatcttgtgactcacaagcaaaactttttaagttgcactaacataatagaccactggctctcatcaaccaagagacaaagagttaaacacctagggctagagcagcgattttctcattttaacccacctgcctacagtttctacgaatgtatttgaaaagtgtctataactttctttgttctgttacgataaaaaaaaaaaaaaccatcaaactgttactacattggaacatgactttggagtagcctaagtcagtgttgtgaggtaaagacacaagcagaaccaaggttagacttgagagtctgcatcaagccactcagagactgcctggcaagaaacacatcttacagagcagttcccaagaaatattacagggagtttttaaagaaaaagaaaacagaaaatgacatcctggttggcaggggaagcaaggaagcagtttaacaagagccaagaacattagctgttagctggggcatttcgacctaaggtttgtcactggacttttcagggtgggggtaaaaaaagcaaagatggcctcagctgagatacgttgccctgttacaactgtgttcctagtgtgatttttgggtcaggattaaactatctcttaactctttagaggtgagagttgcattttcacattgacagtttggatcaccattacccacattaaaacccagcagcaaggaggcagacacagacacagacacagacacagacacagacacagacacagacacagacacagaca

SEQ ID NO: 586 - DNA, 1200 bp, mus musculus
tacagagaccacagagggatgctccttgtggactcattactcagcttcctgctgctcatctggcttccactcattcatacacacacacacacacacacacacacacacacacacacacacacacacacacactgcccacggccaccttcccagggagtgggtacctccagtgggctggactacctatgtcagtaacaatcaagatgatttcccacaaacatagcaacaggccagttgatctgggcagtcccagaactgaggttcccatctcaggtgactcgaagcttggtgaagttgacagttaaaactaaggagtacaggtggcattaacaatgatgtatgaggacagagaggaaaaactgtcaatcctgtttggtgttctgagttcatataagtttgccagtcccatgtaatttgctagttgtaaaggagatcatcctatgataactgtataagaagccattttagtcacatagatggttgtgtaagaaaaattgtttttagagacagaaagtatccagggactgcgggggtggcagagtgggtaagtgcactgtacaagctgagagctgactgcccagcactgtcaaagctgggtgggcatggctctgcctgcctgtgtgctcactgaccagactgtctagctgaaacagtgagcttctgcttcattgagtgcccagtgtcatggggataaggtgcagacgatagagcaagtcccaagtccctgtgctgccacccacagctgcatgctcgtgtacacaccacccacaaaagggatacatggaataatagtagtattcctattagacttgacttttttttgttttttgtttttgttttttgttttttgtttgtttttttcgagacagggtttctctgtgtagccctggctgtcctggaactcactttgtagaccaggctggcctcgaactcagaaatccgcctgcctctgcctcccgagtgctgggattaaaggcgtgcgccaccacacccagctacgaataggaattcgtaagaaccaatgtgtaatttaaatggaatttaaatttaatgcatctaactaataaaagtggaaaattgaaaatgagttgacttacttctgctaatttctttaaatttgaggtattttctcctgattatatactaagctgttctgttttatttttaatttttttattgcttgccaacagtcttaaaata

SEQ ID NO: 587 - DNA, 1000 bp, mus musculus
ggtttgtggttttagtttatttacttatctgctcactgtttcttttttgatcttgtgtgtctcagattggtctcaaactcactgtgttgttgagaatgtcccaaacagtgggttcccctgctccatttcctgagtgctgggattatgggtgtgggccactactcccagtttatgtgaaagcacccacaggacctcttccatagcttcccagtgggtcagggtagatgaacccatttaagaaggatccatctgttcctttcctaggggctaaagcccaggaagactcagcacatactctgttgggcatagtagcaggagttgtgatactcaaaggatattttctcaagtatcttttatacccttaagtttcctgataaaccacgctgaagaaaagatgacacattttggttactctgtataaaaaaatatatcaaattgaagaaaaaatgtatctaataaatataaagaaaatagtatggaaaagttatgtccaatggttaataatgttacattgttttcctttcattttgaggtttttgttttgcattgtttctttgagacagcatcgcatgttaaccaagaaagccttgaagtcctgtttatatcccaagcactggaagtacaggcatgtgccaccacaccttgcttatattgttgattttattgtttgctgtgtttgccaatgtgctgaccagttttatgccaacttgaaataagctgagatcatttaggaacatagagcttcaattgagaaagtgtccctaccagagtggcctttaggcaagtctgtagggtattttcttgattgaagattgccataggaggacctaagcctactgtgggtggtgtcagtcccaaacaagttatccctggtgctgcaagaaagcagactgagcaagccatggagaagtgaaccagtaagcatcatttctctatggcctctgcttcagtttttgcctctagatacctatgctgagttcctgccctgacttcctttgat

SEQ ID NO: 588 - DNA, 1000 bp, mus musculus
tctgcctctgctcttggaatatagaactcttcagctctaggctttaaatagcaacggcccagctgcagtgactggcatgacatctctgcgctaagggtgttgggaccctgtgcccctagtgctatctaactccttacagccagccttctggaactccacgactagtgtctggagtgctcaccagccttgtgccagctgcagttgcagctccccacccctctcatctttcaacttttcaactgtggagtccttctagtatctgctgtccctactctccccagcatcaaccatagactctgcggttgcctactccctggggctctagctcctgtctagttgacagtgcctggagctgggctgggggaggggagtctaagatgtcccccagtaaccagctcaaacctgacccccccccccgatataaagactatggacagtagacaccaaagggggtttattggaacctaggtgacacaagctaaacaacgcactggatgaggcccggatgaaggtatcatacccttcacctactcaacgaatgagaagagggctacttatatgacttctagaaatcagtctttctgcttagctatgcagtctgcagtcgaaattctagacccgcccactccaggtgtcgtgagtgaatggggccctcctccctgactaggctgaagactgcacagacctcccgttgtaactgtgggtggaagaaattgttatggtgaaagtgaggcctcttggcagctttttggggtacctgaatctgctgccactgaagcaaaaacccttagaggtcagcagcctccatgatgtcatgtctttggttcttcccactgaactgaaatctctttggcagaagggtgggggtgcggtgggctcaggcttgagaggtgggggctgtcaccattgatggtttggaggctctcccagggggatcctccccctacagtggagaagactgttgcccctggcctgttctccaagagcagacaaagtcctt

SEQ ID NO: 589 - DNA, 1000 bp, mus musculus
accatgtgtgtgcctgatacccacagagttcagaaaagggtgctggatcccttggaactggaatggcggatagttgtgacccaccatgtgggtgctgggaaccaaacctagtctcctgcaagagcagcaagtactctgaactgtgacgccatctctccagcttcatttaacagcaacagagcaggcaggaaaggttcctttcctttgggcctggattcccatgcgttggctcagggactcagtgttgggagatcaggaagactggggtcagacaggggctgtggatggtggcggcagcgcttggctggatgctttgagcggtgatttgtgcactgaaggtgagctggcactctgcttccctgcgttcctcgtgacagcacttaactcttccaggacctttccttggcacaggctcaggttcacgtttgcctcagtctcttgtttcattttcacactctctcagtgtagttgcataagagtattaatacacacctcctatcacccctcttttggtaatctcttaaaacagtcttagaaagtgccctgagtattttatataatccactacatccattatcatgttgactgcaaagcaaaggctattcatcagatctagccatgacacctgacctagattgcctgccaacctctagtgacatgccacctcttacagccccatgttttcttcagactgccaggaatcacctcttgttctacacatgccacatagttgtatggctagaaagctagtctgttgccagaaggttaagtaaagaaaattaggaaatgtggtgtgtgtgtgtgtgtgtgtgtgtgtgtgtgtgtgtgtgtgtagatatgctcatttggaggtctgaggacaactttggatgtcagtctttaccttataccttgtttgaggcaaagtctctttgtttttgctactgggtgagccaagctagctggcctgcagtcctgcctctgcctccatcttgcctcagaagctctgggattgtcagta

SEQ ID NO: 590 - DNA, 1600 bp, mus musculus
ggttcatactgctgccatagcagagcccaggcacagaatcacaagagaaattctgtccatctctagagctgtctgaggagagaggcttcctggctgcctgcatgcttcttttgggagggtgtgtgtgtgcagcgaactttattgatgatattcaagagagtagggagggccccctaagtgcctcctgttattatgggggtctgggatggaatttgtgagggagattctcagtgttgggggctgagttgggacagggactcctcagcaactgagggcctctctcttgctctcagtgtccttgctggggtgggtggtccagggtttcttactccttggaggccacgtaggccatgaggtccaccaccctgttgctgtagccgtattcattgtcataccaggaaatgagcttgtcaaagttgtcattgagagcaatgtcagccccagcatcaaaggtggaagagtgggagttgctgttgaagtcacaggagacaacctgatcctcagtgtatcccaggatgcctttcagtgggcccttagatgcctacttcaccaccttcttgatgtcatcatacttggcaggtttctccaggcggcatgtgagatccgtaacagatacattggaggccggaaggccatgccagtgagcttcccattcagctctgggatgactttgcccacagccttggcagcacaagtggatgcagggatgatgttctgggcagccccatggccatcacaccacagctttccagaggggctatccacagtcttctgagtggcagcaatgacatggactgtggtcatgagcccttccacaatgccaaagttgtcattgatgaccttggcctggggtgggggtggggtctaagcagttggtggaaaagaatgcattgctgacaatcttgagtgagttgtcatatttcttgtggttcatacccatcacaaacatggggacatcggcagaaggggcagagaggatgacccttttggccccacccttcaagtgggccccggccttctccatggtggtgaagatacccatagactccattacatactcagcaccagcatcaccccatttgatgttagcagaatcttgctcttggaagatggtcatgggcttcccgttgatgacaagcttcccattctcagcgttgaatttgctaagggtggagtcagactggaacatatagactatgtagttgaggtcaataaaagggttgttgatggcaacagtctccactttgccatgtggagagcagacctcagccctggtaaccaggcacccagtacggccaaatctgttcacaccgaccttcacctcatctacgggacaaggctggcactgcacaaaatgatgtggctgcctctggaacagggaggagcagagagccctcatatgtttcttaaaatttaaaaacctagcatattgccctctatttaacttgtcctttatgttttaaaaaaccttttttgtagacaaatctgaccagaatatacatttatatataaaattccttactaataatgataaaaaataatagcaataaaaaataatagtgacgacaaccatgctgtgaatttgcacggagcacttggc

SEQ ID NO: 591 - DNA, 1000 bp, mus musculus
gtaaatcctgttggaaacgatggaaggctcagagtaaagtgaatgtaagctggggaatgagccgaggcctcgaaggaaacacatgcgtgtttggaagtcagggagcttggatgcgactgcgatagagccgcagatagcattggcgctgagagcagtcgtcaggcagcctttcaggagagagtggctgtgtgttctcagcacgtgcttagtctaggtatgcacagggaagactcttttattcaagtgtttatggaatcacatggaggacgcttcattggagtattgaattggaaaaaaagtggaaacaacatagctgtctgttaatcagaatggaaaagggttgctttagaaccatgcagcggaatgatggctcataactggtcaggtgagtgagtcagatacgcatgcgccctcaggatccacagccgtatgcctgagagacaaacagctgacgtcaaaaggcaatgcgccggaggatacacactctcagaacgcattcacgggaacttttaaagttcactaaatagttctattttttgttatgggcgtatatgtatacacacagctataaagttaggaaaaataattttctagctattggtgcctgggttagaaagcagggaggttaattagctctacgcagttttattttactttttaaaggtgtaaagcaagggagataaaaggcctggatagtgatatagggatctgtctattattttctgttgttttcagggtgttaaggatattccagagttgaagagaagggaccaaactcgaaccattagttattttaaatgtttcctaaaatggaaatttcacattctaaaacaatcctttgaaaataagaaagataggagtatttatttagctgggtggggttggcacacagctgtaatctcagaactcgggaggcagaggcaggtggatctctgagtctggggccagtctggtctacagtgtgagttccagaatagccatgactacacagagaaaccct

SEQ ID NO: 592 - DNA, 1200 bp, mus musculus
gtaagctactggtgtttatagtcttcatgaaatgatataagccattgagatccttttctttttatgcgtctttaggagctaagtccttacatatgtcaacagtcaggtcctgttggtgtgacattttagttagtgagttgagttgactctccaccttctctttcttaaacagagatgtgctcctgcatctatccgcctcatggacaaccagcagttccagtttggtgagtaaagtacagcagtttggaaatgtgctgttagcccagggtttccagaggacagtggcgcatgccatggcactgcccgtcacaggctcccagcctaaggagaactcagccttgtaagcgagggcagcaggggaggagggctgtgggcagcgcagggactgggcttgtggggatgctaggcttcattcacggagcttttccaaggtggaagaggaacgaacacaaggaaatgcttctgtaagaggctgcacgtgatctgcatctaaggggagatggaggtctgtgggagccgtctgccttaccaggcttgatcccctgttggcagagctggacttgtgagagcacagtagcatgacttagagcttttcagatgtttgtgtggtaattaacctgtctgcagtaggctttctctgtggagggggcgtcagtcatctttgcctcagaaagctctttctgacggtcttactcagggtgagttaggaggagctggactggaggtgaagcttcaggtggtgtaacatgagcgtggtgagtctgaagtgccctgagcagagtgacagccgaggaaaaggggcaggtcttcaggaccgccatccgcctgctgggtggcaagcttatcgaagactgagaacatctccaggcattaattggttgattggcagtggggttttggagttacagtggatttggggtgttgctggaatatttgtaaccatgccctggggtcggctatgatgtttttgtttgctttctttattggtatatagttattatgcattatattggctttcatactgagaatgtctttcaactatatcatattttgatcatatgccatatatccctcccctttggccatccccttttccccttaggctatagcatttttaattccttggtatccattgaagattctgtttgtatattctctaatggcttcatgattaagcaattaaaagagggattcttagca

SEQ ID NO: 593 - DNA, 1200 bp, mus musculus
taaaaaagttatcggctgccatgatttctggtgaaataattaataataattaaaataattaaattaaattaattaataacaaaataattaagaacaaaggactggcagatgctgccctctctgtcttgcaggtgtcctgttcacatagcacactttgagccagccatgactttgagctaacttatccatgcacttcattgcatttaattccaggctggcaaatttcactttggggcttttgttgagtcctctgaaagtcaacaatgtcacttcattttacaaaaatgtattgctaaagaactttcagagtcaccttgggatcataaggcgcatcttcccagcacttactgctaagggttagtatgcattctttattcctggctgtactttgagctgctatcaggacagtgtccctataattgacaaaaggcaaagataaaaaaaaaaaggggaaaagaaggctggtaaggaagggagattttccatttatcttgtgatacattctgcagcatgaaacacctctatctcttaaataaactttttgaaggcaggaaaagaaaacgttgcaagagaaagctttatgatcgggagcctggcctcccgctgtaggtgactctgtccttttggtgagcctgcatgccctttctttgtattaaatagaaggagagtgtaaggagcgatgatttgatttggtgtgttggttacagaaatggctctggcatctgttacttccactctgtgatccattacttctcttcagctaatggcaggagacatttgattaactgccgagatgtggacatgcaggggatccgaggcaggctgcgaagtctatcacacagctaaagctccgttacgtcttcatgtcacctgcttctctatctccagatagctggtggacgggcagctgcaaacctcacctcaggggcaggagaggctccacgtgttccaagaataactgagtgtttgtgcatctgggatatctacattataatagcccatcaataaagattttaaaccaaaaggtagtattccattttaggaactaattaagaataaatctctcctccaatgagaaaacatgcagttttagataaactgaaaaaggaagttaagaaatttcctttcttaattaaaagaaattattaaaataaatacttttatcatttctaaatactaatacaatatatagtttatgca

SEQ ID NO: 594 - DNA, 1000 bp, mus musculus
gccctccacattccctaggagaagaataagacatttacagccttttacctcgtcaattctaagataagacttaattcatactatgtctttgcaaagccagatcccattggacagatagctccacctttaagaaacaaagactctattctagctataattgtatcacattaacttgccagcctaccaattaatatccagccaaattaaagcttggtgtgtttctggcaggtttgtgacaccgtggcacaaacctacaattttaactaattatagaaattctgggcaggaagactttagaaatgatgctcagcttcatcctccttttaaatggtgaaaccaccctaaacccacagttctatcttccacttgatctggcagagaagggacagtttcccccaaggatgattattctctgtgcagttggagtatgaggtctctcatgtgtttcttccttttgcttgtgctagggtggaaacggaagaccttcatcacactaggcaagtgctctaccattgagctgtatccccagccctaactctttgtatctttgtgtaggaaaaaaaaaatgactgtctccattctacagagggggactaaggatcagtaaaaataaattgatctaggacaaagaaagtacattctagatttgggatctcacacacaaggtcttatctgattccagaaagtacggtttctgttatttccccaagctgatcagcagagctggctctgcaggctcaaagccctgacttacacacttctctttcgaattctacatttactgatactccaagaacaagttgaaattggacaaatcatggatttttagcatatcagctaagtcacagtaaatttcagccattctttctcttgtatcttgtgtgtgtgtgtgtgtgtgtgcgcacgcgcgcgcatgcgtccacacattttgctggtagaagaacctaggacccatgcatttcagaacagtgcgatccctgggttgtattacttactattc

SEQ ID NO: 595 - DNA, 1000 bp, mus musculus; identical to SEQ ID NO: 594

SEQ ID NO: 596 - DNA, 1000 bp, mus musculus
ctgaaatgtaaacctaaggggtgactgagtgtttttgatgataaagcaatttcaaacgagggagggataggtgaaaagatgacgctcatgctcagaaggctttgtgtatttgttatgacgtggctcttgggtcacattgcttggattcctcttgatcaccacagtgactgggatcttactctggatggcccctccccccttggctctttgtgcttgggatgctatctgaagtaattcagattgcacatacagcctatagtgtagaagatgggtagcagttttagcttgtttagaggaaaatgcattctcaaggggtcaaagggattaattattgttctgatgtatattttaggcaggctttatataacttgcaacatctccagagcagacaacgtatgacgggggtttccagactaggtgattgatggatgcatttgaatccactcttcaaagtatacaatggcatgcccttgtcctttgtcagaaaatctcttgctagacagagagtttgtaaggtttagagatcttataacctggtttggatagttaacaactaatactttccaggaggttcagtataacatgcttcctcccaaggccaggttatacccttctgaccagcaatttgcttcccagtattctagttcatggttttatgaattgatgattatgatggaggagcataactgaaatgtcttcaaattctcaaaatgtctaaataactacccaacatcaacagggtagagactgacttctttaaccctgggcctcaattttatcatgtgcggtgggtttaaaacaagtgacagattcagtgcaatccccatcaaaattccaactcaattcttcaaggaattagaaggagcaatttgcaaattcatctggaataacaagaaacctaggataacaaaaactcttctcaaggataaaagaacctctggtggaatcaccatgcctgacctaaagctttactacagagcaattgtgattaaaactgcat

SEQ ID NO: 597 - DNA, 1200 bp, mus musculus
atttttattatacacaactatttttttcctttggaagtgtagctttgtgctcaaaggaagtgttagtaatgtctagcagttctgatagcttcctgtgctctaaaatatatagtgaacatatcctgtgttccttctagaggtttgctcatagatattagggaaagaagagggtgggcagctttgcaagctgtagagccaattaggggcagtgtctgattctcacactgacattagctgggcctttgctgttcacagatcaggaaaagaagacctacaccagcatcccttgtgattctcaatgaacataattccccaggtaaagaggcatgatgtctttcctattgatgagatggagcggggctgtctaaagaggtccaaagagtatggcattgatgataagttccagattacggtttcagttagctaaagggataataaacaaaatcatgaatatatagtataagaattgcctccaccaacagccttccttttcttctagaccagtggttctcaacctttctaatgcagccacattttagtagagctcctcatgttgtggtgaccccaaccataaaattattttcattgctttttcacaactggaattttgcttctcttatgaatcataatgtaaatatctatgtcttatgatggtcttaggcaacccctgtgatcttgttttctgatcaaaagggtggagacccacagattgaaaaccattgttctagaatgacacactgctaagcacatagtgtgcaatgctttatcagcattggtttccatgtgtttctatggaatcttgttcaggccttattgataaagttagtaaaagttgcttaattaggttttgaggttcaagtttcagccctggagatgatcatgtaattgcagaatgtgattttatttatggtatgggaagggcgacatgccagcattggctgcagccttgctcctgatgtcatctctgaataatgcaattgaaaaggaaccagatcaattttcagtgctgcccatttgagagccattctgaacagttgcatccatttgtcgaggttttagtttccatttcctgtaaaaagtaaaactgtattattagtctcgataaagagctatggtctgtaatagacaaacattgtttacttactgagtggagtgattttcatcttacatttaatggcagccctggaaatataagtcaac

SEQ ID NO: 598 - DNA, 1400 bp, mus musculus
ccactggcatatttttgaaatatactttgtataagaactcatgtatttttgcaattgaattactatccttttatttccttaaaacaaactaatctgtgggcaagcaagacagctcaataggttaaggcacttgccaccaagtctgacacctctagtttgatctctggggcctacattgtagaaggaaagaagcaactctacaaattctcctctgacctacacacatgcaccacaaaatgtgtacacccacaagtatacacgcacaacaaacaaataagttcaataaaattacatacactgtgaaactaatgttagtaatgaaatttttaaaaaattaaaaatcgtaatatgtgtaaacttgatgatgaaacataccctctggtttatatagcttggtggtctatggtatcaccaaacatgcccattactcattacagctacagcgctacttccagacaggaagtagcctcacaaagccctttgagatacagctctttgtctacttcacaggtctgacagcaatgtacttttatgcacgtctaatgctttcgatttccttgtccacagtcgcagaatgcatcgcctaagcaaaggaagcagagtgtgtacacaccaccggccatgaaaggtactgctaggtaccacttcggggtgtcatgagtaatgggtgtagggactggcgggccattggtctgctgattatatgtgcttgtctctgctttgcttccagttaagggtggaggtcaggaagattttacctctctgaagctttgtttcatcatggaataaataggtacttgaagaattggtgacttggagagtctcagaatcttagaatgggaaaaaaaatcaattttcaaaataacgacgattttttttcttttacctttgtttatttttctcctttgaaaaaattatcctcaaatctctaattgttcttgttgattggcatgtgattattagtttgtttttttcccttaaggtaagcaaagcagaagtgcttggtctgcgtggaaatgtaatgtcaagaatcacctctctgccttgtgtcaggagcagatctactgaacccaattgagcaccaatttgctgtactcctaacggctgcccagatcacatcagagaatgctggctcagaggctggcgtcttcccagaacttctccccaaaattagaactgccaagtaacatttaagtgtatcagtatttcgacaaatactagttccaagaaaggcttcttttctttttcacacaaaaatgttcctgacacaaggcagtgactgttcaggccagtatctcccttccagcttggctccctggttgttggctcaaggttcatcacactgccctccagctctgattcagtgtggaagaagctggtggggaagcttagaggtccag

SEQ ID NO: 599 - DNA, 1200 bp, mus musculus
acagtaggtacttaattaaatcagttctcttggtgacatacaaaggttccctgaagtgggtcttttcttcaatacgatgaaaggtttagactgtgtggaaaaaaattaaagatatacacattaaaagaatccctcggtttgcttacaaagagaaataggaaatgctggctatggtggtgcatatctggaatgacagcattccggaggctgaagcagaagaatcacaagtcttagactagcctgggctacactgcggtttctagaccagcctgagatagaaggaaataaaatataacgatgtgcatgaccagttcagacctatagaaattaaggctttccagagagcagagggaaaatacattcctgcctccgatgccaccagtttgctctgcagcatctcttgctccagcatgtttagttgtggttcctgttaatttttagaaagcctcttctctagctttaaggctttgtcaaaacatctaatgtaggaaattagaaagcctagacccaggacattcagcagaaaaggcgttcgctatgcagatctgctcaccaaattcgatccctgaagcccactcaaagatggaagtagagaaatgacttcacaaagttgcttcctccatgtacataccttggcatgttcacacacccacaccataacaataaatagataaaagaaaatttaaagtagaaaattttttaaaagtttagagcattcaaagtgaggatcaagaagatagaatcttcttcccttcaagagtagtggcaagccaagcgtggtggtcctttcctgtggtccctgcacttaggtatctaaagcaggagaatgtgaggtcaaggccaacctggcctacggcccgagaaggggatggtttccagacaagcaaagtcaaggtaaattcccagaaatcaatgaataagtaactgcattgcatccaggacaaaacatctgggccatgagctgagtatttaacactggcttgctgccaaggagaaaaggaagagggctggctactgaacacctcctgaaatccctcccacagccttcaatccagttccatgttttacttgtagacctctctaaggagaaagaatgtgcaatgtaaggaaggatctgttagccaagtatccccaaagctttgctgttctcaagaacaatttgctagtccagtctgggaaagttacaaccccatttctgcc

SEQ ID NO: 600 - DNA, 1200 bp, mus musculus; identical to SEQ ID NO: 599

SEQ ID NO: 601 - DNA, 1000 bp, mus musculus
ttccctacccacacattcccatttttttggccctggcgttcctctgtactggggcatataaagtttgggtgtccaatgggcctctccagtgatggccaactaggccatcttttgatacatatgtagctagagtcaagagctccggggtactggttaattcataatgttgttgcacctacagggttgcagatctctttagctccttggatactttctctagctcctccattgggggccctgtgatccatccaatagctgactgtgagcatccacttatgtgtttgctaggccccggcctagtctcacaagagacagctatatctgggtcctttcagcaaaatcttgctagtgtatgcaatggtgtcagcgtttggaagctgattatggggtggatctctagatatggcagcctctagatggcccatccttttgtcacagctccaaactttgtctctgtaactccttccatgggtgttttgttcccaattctaagaaggggcacagtgtccacactttggtcttcattcttctagagtttcatgcatttggcaaattgtatcttatatcttgggtatcctaagttttgggctaatatctacttatcagtgagtacatactgtgtaagttcctttgtgattgagttacctcgctcaggatgatgccctccaggcccatccatttccctaggaatttcacaaattcattctttttaatagctgagtagtactccattgtgtaaatgtaccacattttctgtatccattcctctgttgaagggcatctgggttctttccagcttctggctattataaacaaggctgctatgaacatagtggagcatgtgttcttcttaccggttgggacatcttctggatatatgcccagaagaagtattgctggatcctccagtagtactatgtccaattttctaaggaaccgccagactgatttccagagtggttgtacaagcttgcaatcccaccaacaatgaaggagtgtt

SEQ ID NO: 602 - DNA, 1000 bp, mus musculus
gacatgtgctataggagagtgattgtagggaaggagaggtaggtggggaaaatctattcagttttactataagggaaaaaaaaaataacagtacagaatattagtggcttggcttcctctgcactaactacccaagactcatcttctcttatcattatcatttagatagtgtgtgtgtgtgtgtgtgtgtgtgtgtgtgtgtgtgtgtgtgtgtctgtgtttgtgtttccttgaacacactctcttgctgtgaatggatacagaaaatgtagtgcatttatacaatggagtaatactaaaaacaatgacttcatgaaattcttagcaaatggacagaagtagaaaatatcctgaatgaggtaaccaagtcacaaaagaacacacatggtacgcactcactaataagtggatattagttcaaaagttcagaatacccaagctacaattcacagactacatgaagctcaagaagaaggaagaccgaagtatggatgcttcttagaagggggaacaaaatactctagagaggaaatatggagacaaagtgtgaagcagagactgaaggaaaggccatccagagactgccccacctggggatacatcccatatacagctaccaaactcagacaatattgaggatgccaggaagtgattgctgacaggaacctgatagagctatctcctgagaagtggatacagatgtggatgtttgcagccaaccattggactgagtactgggtccccagtagaggaattagagaaaggactgaaggagctgaagggctttgcaatccatagagagaacaaaaatatcaatcaaccagacctcacagagctcccagggactaaaccgccaaccaaagagtgcacatggagggtcccatggctccagctgcatatgtagcagaggatggccttgtcaatggagagacatcaatgggagagtagggccttagtcctgtgatgacttgatgccagggcagtgaggtgggagtgggag

SEQ ID NO: 603 - DNA, 1600 bp, mus musculus
tctttggttacataatgacagagagttcaagggcagtctaaactacatgacttagtcctcagtgtctctctttctttctccctctctctctctctctctgtctctctctgagagagagagcgagagagagaacacacagagagaacacacacatagactaattcttcccttcgtttggtagaataccacacagatccttgagcttctcagcctcttacatgttaaagaagcatcacatatgtatgatgtttatttatatatgcatgcttatttgtatgtataagcatatatatatatatgtgtatgtgtatatatatatatatatacacacacacacacacacacacacatatatatatatgtgtgtgtgtatatatatatatataatcaaataaatccactcagtctaatatgaaacaaaactcctccagtgtcccaaatcaatcatgtctgacccaaggctaaaatcctgaggaaagaagatgccatgctacaaggctgcccctttctcctttctcgtttctcgtttctcgtttctcgtttctcgtttctcgtttctcgtttctcctttctcctttctcctttctcctttctcctttctcctttctcctttcctttctccttctctgtgaagggtcaggacttaagaagcgaataaggggaaagagagaagtcagtgccacatgtgagcgtccctcacaggatgctggataaatgctctgtgctttgacatcagccaaagcaaatacattccatggaggggaaaacaagaagctttggcaggcatgtcagagagccctacagtattcagacagcagctgtgcattcacagtggcacactgtgtccttcctgaacactctggttctctaatatatgcccaagacaccccccttcaggaatcaaaattttattttccccatgtgggtcaaactgcccaatagtcttcttgggcagtatagtttttaagaagtttctgaggctggagacatatcagctggtatggaaggcaagcttgaacttgaatttggatcctcaacatccaagggtatagtaacaaaacacctctaacccctgtgttggagaaatagacaggaggctccctggagctcactagccagctaaccttgctgagcacaggaaattcaggtgcagtaagaggacctgtctcaaagaaacagtgtggagaacaataaaggaaggcatctcacaccaacctttttttttccttgtatacaaccagagagagagagagagggatgaggagaggagaggagaggagaggagaggagagaagagaagagaggagaagagaggagaagagaggagaagagaggagaagagaggagaagagaggagaagagagaagagaggagaagagaggagaagaaaggagagaggaaggggcttcctggccagcggagttgcctgacaccctcaagggcccacacaggattctccacgggatcctaagacctctggtgagtggaacacagcaccggccacaatccaatcgcacagaacctgagactgcagtacatagggaagcagactacccgggcctgacccggggcaatggccccttccgctccactcgagccc

SEQ ID NO: 604 - DNA, 1000 bp, mus musculus
agactagtattcttttgcaagggcatcatcctcaatactcaaagaatatgctgtgctgggtctgacctattatcattccgatgttccagtttagccacttggaggtcaaactcatagtagatgaaggaaagagccacatttaagaaaacacataatctgatttaaaaacctcaatggggcctgagcatcggaggcagacatcttggttcctggactccaccgagagtattctgcacaggtgagagtgtggactacagaagctaacagcttatgggacaggcgggagccacagagctgctgaggcagccccctcttcgggctacagacatccggccaccttcccggccagaggataggtgtccacctggccagggagggctttacctgagcattggctgcagacatcttggttccgggactttgtggagactattctgcacaggtgagagtgtggactacagaagctaacagcttctgggacaggccgaagcaacacagcttctgggacagatcctgttttgggccttcatctttggccaggagatatctgtgcaccttccctgtaagaggaaagcttgcctgcagagagtactctgaccactgaaactcagaggaaagatctagtctcccaggtctgctgatagaggctaacagaatcacgagaggaacaatctctaaccagagacaactaaatcaactaaatccagagattaccagatggcaaaaggtaaatatagactcttactaacagaaaccaagaccactcaccatcatcagaacccagcactccgacctcgctcagttcagggcaccccaacacgcccgaaaagctagacccagatttaaaagcttatctcatgatgatggtagaggacatcaagaaggactttaataactcactcaaagaattacaggagaacactgctaaacaggtagaagaccttaaagaggaagcacaaaaatcccgtaaagaattggagaaaaacatgaccaaacaggt

SEQ ID NO: 605 - DNA, 1400 bp, mus musculus
ggttcattttttcctatgcatgtagagaaggttgagagtagtcatgaagacagccagaatgcaaaatggaattccatctataattttaaagaaatatttacaggaatggaaattcccatttgctaagagtatcatatatgtttggaagacacttacattaaggttaaggtttctgggttaagatgaacgattagaaagctttgtaggacactagtgctgaggacaacagcacactataaatataaagaatatataaagaatataaagaagaacctagggttgaagcgactcagtctcattttaaaattcggcaagagttcctctgagaatttagctggattataactcaaagaaactctggtccagacctgaggaatctgttgtacattaaatatatgtatgactaaatttaaagaccttgcctacattgttgattattatacatacatatatggtatttctaaagctgactgtgcatttatttagggtcagaccgaagagatggaatacaggccagccacagcaccagcatcccatccatgtcagagaaacagcaatggtgagagaaggccagaagccaggaaagtaagattaccaggaaaggcacacgtcagatccagaagttatagtggcagtgctataagataacctcagtgctagacagaaccttctggatagtgtttgcctctctcaagtgtttgctaaagcggctgatctcaaaagtcacagatattaaacatgaagggaatgagggagctgaaggggtttgcagccccatggaggaagcaacagtgtcaacaggccagaccctccagagctcccagagactggaccaccaaccaaagaatccatatggagggactcatggcactagttacatatgtggcagaggatggccttgttggccaacagtgggaggagaggcccttgagcccgaggatgttcaatgccccaatgtaggggaagtacaaggcagaaagactggaatgggggggtgggctaccctcacagagacacggggagggaagatgggataggggttttctgaagggaagacatggaaaggagaaaacatttgaaatgtaaagaaaatatatatccaatttaaaaaaagaaaagaaatgaattttttttccattttttattaggtatttagctcatttacatttccaatgctataccaaaagtcccccttacccacccacccccactcccctacccacccactccccccctttggccctggcgttcccctgtaccggggaacacaaagtctgcgtgtccaatgggcctctctttccagtgatggccgactaggccatcttttgatacatatgcagctagagtcaagagctcaggggtactggttagttcataatgttgttccacctatagggttg

SEQ ID NO: 606 - DNA, 1200 bp, mus musculus
ggatacccaaaccatgtattataaacacacacacacacacacacacacacacacacacacacacacacacacacacacacacaaacacacacacacaaatgaaattaaataataaatcctaaaagcaaaagtgatttaaagctaaatgtaattttataaaaattagtatattgcccttccagtcggcaccagtaccggatcacatgggcatggagccctcggacacccccaaggtccctagaggacttgccactcgatcttaggaccaccagtgagtagaacacaacttctgttccattccaattgcttgggacctgagacagcattagggaagcagaaaaccccgcctgacctgggtcacaagtcccttccggtccacaccagcaccgggtcaccttgggctcagagtcagaggacacccccaagggccctagaggacagcttctaaggcagaccccctttcgggattcagatatcaggcaccttccatgccagaggagaggtgtctgcccttcccgggagggctttgccagagcacctgggggagccatcttggttcccagatccccccaagactagtctgcgcaggtgagagtgtgaacaacagaagctaacagcttctgggataggcctaagtgacacatcttctgggtcaggccctgtttaggaccttcaccttctgccaggaggcaggtccgaacaccatatatctgtgcaccttccctgcaagaggagagcttacctgcagagaatactttgaccactgaaactcaggagaaaactagtctcctaggtgtgctgatagaggctaacggaatcactggaagaacaagctctaaccagagacaactataacaactaactccagagattaccagatgctgaaaggcaaatgtaagaatcttacaaacagaaaccaagaccactcaccatcatcagaacgcagcactctcacctcagccagtcctgggcacaccaacacacctgaaaagctagacgcggatttaaaagcacatctcttgatgatggtagaggacatcaaaaaggactttaataactcacttaaagaaatagaggagaacactgctaaagagttacaagtccttacagaaaaacaggaaaacacaaccaatcaggtgatggaaatgaacaaaaccatactagacctaaaaagggaagtagacacaataaagaacaccc

SEQ ID NO: 607 - DNA, 3600 bp, mus musculus
gttgaatttctttttcataattgcttaattgttttgtcatgaatttattattaacctaggcccatcagtggtatatctatgcaaaatagttgctcatgcttaaattaatatcagctataatataaaatcagctcctgaaaatagcagaatcagatctcaatcatgcaaatcaaaactaaatatatcattgtaaaaaatgtgaatattaaaaaatgcatggaaaaaaaatgccaggtatggtggcacatgcctttaatcccagcactcgggaggcggatttctgagtttgaggccagccttgtttacaaagtgagttccaggacagccaggagggctatacagagaaaccctgtctccaaaaaaccaaaaaaaaaaaaaaaacaaaaaaaaaaattaatggaaattcaggcaattcctagagcttaagtttgacccaaatgaactaccatttgccaatgtattaaaaccagcttcaatttacacatgtcttttcaactggaaagatagtttattaaatacacttttaaatttattccttacaaatttatacatgttcacaatgtgttttgattggtactccaccagattctttcttaatcatatcaccatgtctctccatcagcatcatgtttcttttattatttttattttagtattgaaattttagttttgaattagtgttgatctttgcttgttttaactttgatagtttgaattaatctagaaatttcctcctctacctttcttacctagaaaccctcacacataccctccttgttctctttcaaattcacaatctatcatttcatcaattggtgttataagcatatgtatacacacacacacacattcctaaatataacctgctttgtccacatgttacttgtatgtctatgttttcagtgctgaccattttggcattggatagccagtcagtttgcttttccctgggaaagaatatttttcctgctcctagcatttcttagttgtcttagttgtttcaagttctttgtgtagggatgaggccttatagtgtttccctcagccactttggatgtctgtcgttgttccccttgttcagcttatgcttaggcagtcctgatcaaaatgcaaacttgcgtatccaatggatacatgtataagacaactctgatacctaaggctcaggtaaaaaagtacaaaaaggggtacatagattgtgacagagaatttactgtaaaattgttcttcaaagtaatgttaaaagctgcatccacaaacttttatgaaattttttagtccactcagtccacttactgtcatgtaaggttctgtttcagtcttaaggctattaatatgaagttattttccttaagcctcaagctaataggtttataagtcttaacatttattattatcacattattttgtttgtaagcaccactgacttagagttgcttcaaaatttctaagtacatctgcttgacaacccacaatagttgtttatcactatttcttaatcataattaagcctgttacaagtgatataatgatattactaaatatttacttatcttttagaaaatataactatttttacaaaaaacaaagcagtttgcagatggtgttacacatggacgtccagatgaagaaaataaaacttttatgagttatgaatatttgcaagatgtagcagagaatataaagtttagtaatttgggtgccaattgttgaaccaatttgcatagaacagattttcaccgaagcatgaaagtacattggctgatttccaatgtgaactgatgtaaaatttacagctacatgttatttcaaatatataaaataacaagctactctgtgtgtaaatgtaacatagatataactcagtttcatatatgctataaatgttattatctgtgtagttttcatttaatattttatagacttcagtaatttattatgagtaaagataaatataattacagtttctttttgtcattttgtctttaacaatgtaactacagaggctttttttagcagaaagatcaacaagctacctttaaaccttccccaataaggccggagtacttttaataagtatacaccaatctatcttaatttttataagagtagaattaccttttaattaaatttatattaaatatgtatgagaggaattaaatttttgataggagaaaggcaatacatgtgaaggacattctaattgccaatgttttcaatgcaatagttattagaaaatataactaaaatgaaaaaagcttattaagaaacaagctgattaaaagtaataggattttgtataccttttcttaagatattttcctctaccactttatgatgagaatagattttgtatatgtaaatatatatgtatttttaagccttcagttttgaaacaaattattttattaaattccctgtaaaattccttccagtagtccaacagtgtcatgtttatcaggtcatgatccagaatgtactcttaggagaacagctgaaagtcacagatttattgaacttgagttacagaatgaccccttgttgtgttttacaataattattgaatccataaaaacacagtgtttagagactaagagcttctgacatttattttctgagaaaatttatggaaaaatcatttcattgattagtttataatgatgcagattgctaatgctaaatgggtgcatagaaaaacaatacaggaaaaaaacaagagaggactttaattacagagacacatggaacattaaaagtttagaataatttgcaaaagaaatatcatgctagtgtcagtgagttttacttgctttgggttaaggtagagacttacaaaaaaggatgagctctctagaaaggatgccgcacgatgctctgcagtggctgttccttgcctggcacaccaggatccctgtgagaagtagtggtgcccattttttatttactagcatcacagctgctctagtaataaccatttcaagactatatatatatatatatatatatatatatatatatatatatatatatatatatatatggagatatgctcatattgagactagatataacagtatagaaatggaaggtttactatttcatagaatttgaagtagaaattagtcaaagtggatttcctaaggctgggaacttggctgagtgatgagtatctgcttagcatgagcaagagcaaggccctggggagaaaggctgagtgacaagcaaaatgagattgaaagggagaatgagtgtgtgtgtgtgtgtgtgtgtgtgtgtgtgtgtgtgtgtgtaagagcgagagagagcgagagcaagagcgagagagagagagagagagagagagagagagagagagagagcgcttgaggtctttattcactcctaacttcctttaagcctgataataaaccacagacccattgccgtatttaatattaatttattgaaagttgaatgttaaccaataaaccatacaatacatagaatatattatgaaattaggacatataagtatatggattagtcaaatacgtttaatcggttccttcaccttgtattattactctatcattattactgaggttatgtttattatatact

SEQ ID NO: 608 - DNA, 1600 bp, mus musculus
taaagtgcaaaaccctgaacggtaagtcctggatgaaaaagtgtgcatgacacatttgattatttaaatgttcctgtactgacccagcacacatggctaagtgactactgaaagcaatgaatctctgagccggaagaaatctttacactttttaagttgttgctctaagtgatattaccacagatatgtaaaatcagttaaagcagaaagttggtatcaggagtgtggataccattaacacaattttttttgtctgtgtttcataagccatttaaactgttttgaggaataaatatggaaggttttagggatttgagctagtaaatccctgaaatgttataagcagaatataataggaagttctaaggagcatctaagaggtgagtacactaaaagatactcaaagaatgtaaatatttcagattttaatacaacattgcaagtcaaactgaaggccatttatgttatattccagaaaacaactaatccataagtggagtgcttcataattgtgagtaaaagcatttcttttgaactgatgaattaatttgtcaaacataaaaattataatttttaggtatgtgtttgtcaatgtgtgtgaaaaattgaatgccatggaaggagttgcagagacaaagttcggagcagaggctgaaggaaggaccatccagaaactgccccacctggggatccatgccatatacaaccaccaaacccagacactattgcagatgtcaacaagagtttgctgtcaggagcctgatacagctgtctcctgagaggctctgccagtgcctgactaacacagaagtggatgctcacagtcatcctttggatggagcacagagtccccagtgaaggagctagagaaagtagcaaggacctgatggtgtttgcagccccataggatgaacaacagtatgaactaaccagtaaccccagagctccctggaactaaactactaaccaaagaaaatgagtggtgggactcatggttctagctgcatatgtagaagaggatggcctagtttgtcatcaatgagagaagaagcccttggtcctgtgaaggttctatgccccagtatagaggaatgccttggccaggaagtgggagtgggtggattggggagcagggagaggagggagagaacaggggatttttggaggggaaactaggaaagaggataacatttgaaatgtaaataaagaaaatatctaataaaaattttaatttttaggtatgtgtttgtcaatatgtgtgaaaattaatagattagaaaggtacttcctcagacacatgtacttaacatgaaaacataaatgatgccttataatttataagaataaaaaaactatggcttgtttcttgataatataatttactgatgaactatttaatcataatgaattagctaaatgttaaacatagttttaattgaaatcatattaatatttaaattaataattatgttgtaaaattctatactactacgatttttttctcatatactacatcaagtcctaagacaagtaattttaactgtttcgagattaacttcaagttaaaatacttgaaatgtactttctacttatatagtat

SEQ ID NO: 609 - DNA, 1400 bp, mus musculus
tcttatattgggagtggcttacagcatgtatacacctatccttcagtcttgctgagtcgattaatgtttcctgtgtttatatcatttcattttagccttagatatagattttatttctttataactttgacttgatactggcacactatgacatctgctaatttaagtatttttattttcattttcaactccagtcattgcgaatatgtttttcaaatcttctctgtaaatgagaagccattcgaatacaccttttgcaatcacaagattaaaattcaaagggcccttaaactgtaacctttatagccttgggttagaatatatcttagttagggttttattgcggtgaacagacaccatgaccaaggcaagtcttataaaaaaaaaaaaaaacatttaattggggctggcttacagggtcagaggttcagtccattatcatcaaggtgggagcatagcagcatctaggcaggcatggcacaggcagagctgagagtcatttgtcttcatccaaaggctgctagtggaaaactgacttccaggcaatgagggtgagggtcttaagcccacactcacagtgaaacacctactccaaccaggtcacacctattccaacaaggctacacctccaaatggtgccactccctggtccaagaatatacaaaccatgacagtatagctctcaactgtcctcagaaaatctactttcttacaatagatggcaataaataaagaaatacatagttgttcaatattcacataaagtaaatagaaacttgaagaatatgtatatcaaaggaaatatttatgaagatgtaatctaaattttgaacatctatgcctcaaacacaatgacagccacatttgtaaaagaaaccttgctaaaacttaaattaatagtgggagacttcaacaacccatcaaccaattgacaggacatccagacaaaaactaaacagagaaacaaggaaactaatagaatcaagtggacctaacagacatctatagaatattttacccaaacacacaagaatgtaccttctcagcacttaatggatccttctccaaaactgactatatagtcagtcacaaagctagcctcaacagatacaagaaaattaaaataacaacttgtatcttatcataccaccatggattaaagttacacttaacaatagcataaacactggcaagcttacatactcttggaaattaaacaactcaatggtctctttgtcagggaaaaaatacagaaaggaatgaaaatgacagaacaaaatgctaaaattatgggacacaatgaaagcattactaagaggaaagttaatagaactaagttcctccataaagaaattaaaatgttctcatatccagaatttaacagtataccgggaactcta

SEQ ID NO: 610 - DNA, 1200 bp, mus musculus
acccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaaaaaaaaaaaaaaaaaaagaaaacatccccaagggagagaagtatgtcgctgccaaaaacgttgagaagtatgtaaagcatgtttggacttcagacatagaggtatgaaatctggagtttgctctgctggttttcagtatttctttggtccagtattctcacgaagctacctttacttctttttggcatgctaatatatatcttctgctatttgtatgctggaaggatgtgatcagcttttttattttgattttacaggtggatacagttgaaaacttgccatgagtctcagaccagattttgaactttgtactttcaagcagtgttgagatttatagactatggagacttttgaagttggactaaatacgtttttatgggtatagaactatggggacttggtagtggaatgtggtagtttaaataaggatagccctcatccactcatagatttgaatgcttagtcatcagggagtggcactcctttagaaggattaggaagtgaagccttgttgaggtgggggtggtcttttctaaggaagtacgtcattaggggcaggggaggggcagttacactcagaagccctagacaggcccagtacctcattgtttcttcctggtacctacagatccagaggaagaactctcagctccttcttcagtatcatgtctaccagcatgcagtcatgacctctaccatgatgataatggaccaagcctctaaaactataagcaaacctcaaataaatactgtcttttccgagagttgtcatgttcatggtttctcctttccacaatagaacactgactaagacaactaacatacaaaactataaggaatcttgctagtatgagtgtcccaaaactgcagtcagagactttaacctttttttttttcttgcttgctactcctgtgagaggtacagatgtggaagagttttctatgcaccagggaaaatgtgc

SEQ ID NO: 611 - DNA, 1000 bp, mus musculus
aatgttgagcagagactgaaggaaaggtcatccagagactgccccacctgggaatttatcccatatacagtcacttttgtggatgctaacaagtgcttgctaacaggagcctgatatagctgtctcctgagagattttaccagtgcctgactcatacagaggtggatgctctcaacccacttttggactgagcacagggtcctcgatgaaagagctagagaaaggatccaaggagatgcaggggtttgcaaccctataggaggaacaacaatatgaactaaccagtacccctcagagctcccagggactataccaccaaccaaagattacacatggagggacccatggctgcagccacatatgtaacagaggatggccttgtcattcatcaatgtgaggagaggcccttggtcctgtgaaggctcaatgccccagtgtagggagtgccaggacagggaaacagcagtggatgggctggtgaacaaggaaagtggggatgggatagggagtttttggaaggataaccaggaaaggacataacatttgaaatataaataaagaaaatatctaataaaaaacatattaaatcacaactaacttaaattacaaaattcctcatcttcatgaattttatttactctgatagaaatataattttaaaaattcaggcaaaacatttctacaagtattactcaaagcttttgttttctttttaagagcactgggagttgttattcattgatctcacacttcaagaaacctgccaagactaaccacaaaaatctgtcagttgaagctgatattaaagagaataccctgaagttatctgaacttcccttttaatctcttctgggaaagagaggaggcacgcacggagggtagaggccaaacgcttcccacactctgatggtacacggccaatattctgacacaagttaataaatgtaatagcatagctagactgacaagaattggtacctgcaatacctgcccacaaatg

SEQ ID NO: 612 - DNA, 1200 bp, mus musculus
tcaatgaacttctccatgactggatttatgaaaaacaaaacaaacacaggcaagaggttgtcttagtatgggttccaaatgcaatctacattttaaaaatgatatttttatttatatgttgaaaatgcttaatatattgtttcaagcttgtataacaagtcataatcaaaaggcacagatatataaataaacagttttatctaggtagtagatagatggaaggaggggactggatgggagaggggatggagatgggaacagggcagggggatcattgtagggggaactgaggagagacaacagaattcagtgacaggtgagcagatgaacacacaggcgacaggggtggggggatctataggacgtgccagagaccccagcaggggaagctccagggagtttatgggggttactctagctcagactcctagcagtgggggagcctgaagtggcctcctcctataagcagatcagattcccagtagaaggataaagacaccaacccacctgcaaaactttcaacccaaaatgtgtccttctacaaaatgtacagggacaaagatgcagcaaagaggaaggaatggtcaaccaatggctggcccaacttgagacccatcccatggaaaagatccaatccatggtaatattaatgatactctgctatgcttgcatacaagagcctagcatacctgtcctctgagaggctccacccagcagctaatggaaacaaatgcagagtcccacagccagacagagcttggaaagtcttatgggatagttggaagaaggattaaggagatagggactccacaagaagaccaacagtctactagtctgcatccttgggggttcccagagactgaaccaccaactaaacagcatatgtgggttagacctagttgcccccaaagatatgtagcagatgggcagcttggtctttatgagggtgccccaaaaactggagtgggggctgtctctggctctgctgtctgcctcattcccctaacttggctaccttgtctggcctccagaggagagaatatgcctaattctgcagtgacttgatgtgccaaagtgggttgatacccagggagagccttgcccttctcagagtagaagagggaagaacacaggaggggattaggagatggggggttgcaatcaagatgtaaatcaatgaaaaaaaatggaaatttgcca

SEQ ID NO: 613 - DNA, 1000 bp, mus musculus
attccccaaacacaacattctacccgacactgctcttatttttgttgttatctactagatttcagcctcggagctctaaaaaggcatcttagtgagagttatctgagcagttgccaagtcatcttggcggcaataaccaaagaattagtctgcgaatagctccactttctagctttccgtcatcgcgccgtccttagtgatctggaaaacatgctccgagggaaaaggctgcgctttccacttgagtgcctcattcagtggagcaggcagatcaacccctgtctctgtccagattacagaagcaagtttgtgtgataatcatccatctcttagtggacacttgttctctccacaagactcaaccgtatccagtctatggggtcatttaactcatggctgtcacctgctcttacaagcacttctctgagtgtccctgacaatggtcacaagcaatggactggggcaatggagcaatcgctccttttgccctggatcttttaggttagtcatagatggaccatgggtgggtaactagatagcaccatggcaacataactgaaagtcaacctagattgtgtctcatattggtagatgcagttgttaagatgattccaggggaagtacactgacttgtatccctttttatgacattgattcttctcacacttcttctgactgattatcctgcaagtgtttgtttacatctaacccatttaaatgcatgtttttattaaaatgcattccatattaatcaactagtactcttaagcaagtgatctttctgatcttaacttactggcaactgaatgagccactatgaaacacagtaagtagttttctttcaaatttggggatagagcaagtcagtgaagggggttcagcgaagcagtgaaggctcttcctgagtacaatccccacgtgtcctgtggcttgtttgaaagacactcatcaggtttgaagaagctaccatttactctcaacggagtctgtaatcacaacg

SEQ ID NO: 614 - DNA, 1000 bp, mus musculus
gaagggtcatagtttgtgtcactatcaaagcagaaagaaaggcgtctactccagttccaggtctactaggtcaggagtggaagagaagatagagcttttaatagtcacagtgtcctcaaggagaggccaggtctcagtaagaaggtgaaggaaatgctgctggaagatcaacacaaagcaaaatgtactgatgagaaaagttgagtttcagtctccatgaagtgactgaagggaaggggaagagggtgaaagataagctcattacatgtgataaagctgtaccctggcaggattggagagttggtgcacggaagtgatgtactagtcttagatttaagaagatgactgatatggatagggatgaagatcatacatagcctgagatataatctgtgttaagagatgggggcaggaggagacataaagattattttagactcaacgttcactcttcccttagacatagcaagatgaggtaggttggatttaagtaactgtcattgggctgaattcagggctatggctctctactgttgaacaaggctttgtttctgattaagtactttggagaggtttacttctcatttgaaattttctcctcagcattttttgcagctcttctgcaaggcacctgtgattggttctacctagttcccagatcatcatgtcacctgtctaggtaggctcagtataaaagccagctgcaactgagttaaattcctggcttattttacaaccttcttaaccctcttcaccatgtctctttttggcattttctctatcacttaacgacctgtggatggcaaataattttcttctatttatatgtgtggatactaggaagaaaagatagatgttgctgcctagttttcagcatcagatgactcctgcatttgtgagtggatgacctgctggggaactgcaaagtctaaccacaaaggaaaataacttaggccaggagaacctccataggaaaggctttggtttgagtttgcaattc

SEQ ID NO: 615 - DNA, 1200 bp, mus musculus
cttttccatccaagtacatacctcttttggattgcttgcaattttgaaattttatttattgaatgtaattcccatttatttaccataatggatcaagctaaattctaattttatctaatcctaggtgagatttcctagtggaatggaacaatataatgatacagtgactgagttcatcctggtaggattcacaacaaaccctgtcatgcagctggttctgcttgttatttttcttgctgtgtatgcattaactgtgttaggaaacagcaccctcattgtgttgatctgcaatgactctaggctccatacacccatgtatttcttcattggaaatctgtcttttctggatcttggattgtccacagtctatacaccaaagatcttagtgacctgcatctctgaagataaaagcatctccttttctggctgtgtggctcagttcttcttctctgctggacttgggtatactgagtgttatctgttggctgccatggcttatgaccgctatgtcgctatctcaaagccactgctttattcccaagccatgtccttaaagctatgtgcatttttagttggagtctcatatttgggtggtttaattaactctttcataatcaccaaagacacatttgccttgactttctgcaatgataatgtaattgatgactttttctgtgatatcccacccctggtaaagctctcatgtggcaaaaagaagagctttcagtctgtgttattcttccttttgacttccaatgtcatcatccccattgtgttcatcctggccacctatctcttcatcattgccactatcttgaggatccgctccactcagggccgcctcaaggccttctccacctgctcctcccacctcatctctgtgaccttgtactatggctccattctctacatctatgctcggccccggtccagctactctttagatagagacaaaattgtttcaaccttttacacagtggttttccccatgttgaatcccctgatctatagtctgaggaataaggatgtgaaagaggctttgagtaaactgttcaaataatcacaaccgtattctaaaaataaaagaggcaaagatgagtttgattcagagattgtatgtatagtaatgcttcccccattgtccatcatgcttatgaattattatagttttagttattctacgtaaacatttgaggatga

SEQ ID NO: 616 - DNA, 1000 bp, mus musculus
tgttgaaacaactttgtctgaatctaaagaatatctggtacggggacgagagtagatgtagagaatggagccatagtacaaagtcacagagatgaggtgggaggaacaggtagagaaggccttcatgcgaccctgggtggaacggattctcaagatagtggcaattatgaaaatataggaggctaggattagagcaatgggtatcattacattggaggtcagtaggaagtacataagggtctggtatccttccttgccaccacaagccagattcaccaaaggaagcaagtcacaaaaaaagtcatcaatgacattgtcattacagaaatcaaaggtaaaagttttcttggtgatgatggaagagttaataaagccacccatataagacgctgctacaaaaaatgcacataatttcatagaaatggcctgagaataaatcagtggctttgagatggccacatagcggtcataagccatagcagccagcaggtaacactcactgtagtccagtcccgcagagaagaagaactgagccacacagctagcaaaggatatgctcttattttcagagatacatatggctaagatctttggcgtatagacattagacaaccagagatccagaaaagacagatttccaatgaagaaatacatgggtgtgtggagcctggagtcattgcagatcaacacaataagagtaatgtttcctaacacactcaatgtgtacataatgagaaacatcacaaacaggaccaattgtgtggtagggtcagaggtgaatcccaagaggatgaactcagatactgtgtggtttcctctctccatggttgtaaagactcttatcttagaagacaaaacagagaattgttttccaatgattgtgctgaaaaaacatattaaatgggtaaatcagacattctcctggtaatcatgaaagtcttacatgcaacacttgaaagattcatttagaaataaattttatttagtagccaaataaaac

SEQ ID NO: 617 - DNA, 1200 bp, mus musculus
ttaatcacttttaataaagacagttatgtcagagcaaatgcttttgattctgatcttaatatttcaaatttttgtaagaatttgtgtttatcaaaaacctatgagtgtatttccattttttttgttacatttgttagtatttgtatcatctgtactctacattcatagaaattaattcaatgatctaacagttcttgtattccaacacagatggtcaggagtggaaaaggaatccaaaataagaatgccacagaagtgacagaatttatccttttgggtctctcagacaatccagacttgcaaggtgtcctctttgcattattcctgatcatctacacgatgacactggtgggtaatttgggcatgatggccctgattaagattgaccgcagtctgcacacacctatgtacttctttctcagcagcctttcttttgttgatgcctcttattcttcttctgtcacccccaagatgctagtgaacctcatggctgaggataagagcatttctttcaatggatgtgctacccagttctttttcttcggttccttcttgggaactgaatgcttcctgctagccatgatggcctatgaccgctatgcagccatctggaatcccctgctatacccagttctcatgtctgggagaatttgtttcatgttggtgtctacttcattcttagcaggctttggcaatgcagccatccacacagggatgactttcagactgtccttttgtggctctaataagatcaatcatttctattgtgacaccccacccctgctcaaactctcttgctctgacactcacattaatggcattgtgatcatggccttctccagtttcaatgtcatcagttgtgttctgattgttttgatatcttacttgtgcatcctcattgccatactgaagatgccttcagcagagggaagacacaaagccttctccacctgtgcctcccacctcatggctgttaccatcttttttggaacaattcttttcatgtacttgcgccctacctctagctactctatggaacaggacaaagttgtctctgtgttttatacagtagtcattccaatgcttaatcctctcatctatagtttaaaaaataaagatgttaagaaagcagtgaagaaaatcttacataattatgtggtttgaggcaagggtatatattttcaccctatgttagttgta

SEQ ID NO: 618 - DNA, 1200 bp, mus musculus
tttttgactctgaatttaatatctcactattttataagaatgtgtgtttatcaaaactccatgtgtgtatttctgttttattccttacatttgttagtattacatcatctgtactctacattaatagaaattaattcaatgttctaacagttcttgtgttgcagcacagatggtccgaaccatgaaaggaatccaagataagaatgcaacagaagtgacagaatttatccttttgggcctctcagagaatccagacctacaaggtgttctctttgcattattcctgatcatctacacgatgacactggtgggtaatttgggcatgatggccctgattaagattgaccgcagtctgcacacacctatgtacttctttctcagcagcctctcttgttgatgcctcttcctcttctacagtcacccctaaaatgctgctgaaccttgtggctgaggataagagcatttctttcaatggatgtgctacccagtttttcttctttggctccttcttgggaactgaatgcttcctgctagccatgatggcctatgaccgctatgcagccatctggaatcccttgctatacccagttctcatgtctgggagcatttgtttcatgttggtgtctacttcattcctagcaggctttggcaatgcagccatccacacagggatgactttcagactgtccttttgtggctctaataagatcaatcatttctattgtgacaccccacccctgctcaaactctcttgctctgacatccatatcaatggcattgtgatcatggccttctccagttttactgttctcatctgtgttctgattgttctgatttcttacctgtgcatcctcattgccatactgaagatgccttctgcagagggaagacacaaagccttctccacctgcgcctcacacctcatggctgttaccatcttttttggttcaattctctttatgtacttgcgacctactactagctactctatggagcaggacaaaattgtctctgtgttttatacagtagtgattcccatgcttaatcctctcatctacagtttaaaaaatagagatgtgaaagaggcagtaaaaaaaatcttacagaaacacattctataaagctgtgttttccatcctctgttatgctggatataatagatttataaatatgctacttgatttcttaagtttttttcta

SEQ ID NO: 619 - DNA, 1200 bp, mus musculus
tgaagcaatatctcaatttaaactataagaattttgtggagctaaatgcaactattttggaaatatcatatggcagttacaattgtcacatattattacttaatactgaataatgcagtcttcatagattcttaaatactctatgaaaggcattttttacctctttgttccttaaactataaatcaaggggttaagcatggggatcactaaagtataaaacacagatgctgctttgtcatattcaaatgagtgagcagatttaggctgaacatacatgaagagtagagaaccgtagaacacaaccaccactgtcagatgggaaccacaagtggagaaagcttttttcctaccttctgcagaacgcatttgaaatatggttaacaaaattagcatgtaagacaaaagaacaacaacaagagaagagattaaattgaaggctgaaaacaatatagtcaataattctgtctcttctacatgtgaacagatcaaaggtagtaaggggacaacatcacaatagaaatggcttatgatattagcaccacagaagcttaatgtgaaatacctaatagggaacagcagagcctggaagatactgtagagatatggaattccaataagcacttgacagcgtctctgagacattatagcactatagagcagagggttgcagatagccacatagcggtcataggccatggaggacaagattgaaagttcactgacaatgaacagaatgaagcatgccatttgtgtggcacaagcataataggtgatgttgtttttatccacaacaaaattcaccagcatcttggggcagatggcagtggaatttccaagatcaatgaaagcaaggtgtctgatgaaaaagtacataggggtttgtaggcgagagtccagtttggtcaaaatgatcatgccgaggtttcccaccacggtgattgcatagatagtgaggaagactgcaaacagtgggagtttcagctcagcagtctgtgtgactcccatcaggatgaactcagttggcattgttatatttggttgccccattggatgttccaaaattaactcttcttgaagaaacaattaggatttattagatttctttcattgccatataaacttcgtactagtcacagttagatcggttaaatattttattcaaaactagacaacactagtaatttttacatattttaaga

SEQ ID NO: 620 - DNA, 1000 bp, mus musculus
actaaagtataaaacacagatgctgctttgtcatattcaaatgagtgagcagatttaggctgaacatacatgaagagtagagaaccatagaacacaaccaccactgtcagatgggaaccacaagtggagaaagcttttttcctaccttctgcagaacgcattcgaaatatggttaacaaaattagcatgtaagacaaaagaacaacaacaagagaagagattaaattgaaggctgaaaacagtatagtcaataattctgtctcctctacatgtgaacagatcaaaggtagtaaggggacaacatcacaatagaaatggcttataacattagcaccacagaagcttaatgtgaaatacctaatagggaacagcagagcctggaagatactgtagagatatggaattccaatgagcacttgacagcgtctctgagacattatagcactatagagcagagggttgcagatagccacatagcggtcataggccatggaggacaagattgaaagttcactgacaatgaacagaatgaagcatgccatctgtgtggcacaagcataataggtgatggtgtttttatccacaacaaaattcaccagcatcttggggcagatggcagtggaatttccaagatcaatgaaagcaaggtgtctgatgaaaaagtacataggggtttgtaggcgagagtccagtttggtcaaaatgatcatgccgaggtttcccaccacggtgattgcatagatagcaaggaagactgcaaacagtgggagtttcagctcagcactctgtgtgactcccatcaggatgaactcagttggcattgttatatttggttgccccattggatgatctaaaattaactcttcttgaagaaacaattaggatttattagatttctttcattgccatataaacttcgtactattcacagtttgatcagttaaatattttattcaaaactagacaacacaagtaatttttacatattttaagaaaataa

SEQ ID NO: 621 - DNA, 1600 bp, mus musculus
tgtgatttgtgatgcccagcagtgtgaattaggttatcactgtgatttatggctcttcctcttagctaatcagactaattttctacatacaacattgtataatcaatccattacctagtttaccaactattacttggaagttttttttttttataaactaacaggtaacaaaactcttatttttttaatatgtaaaatttcatcttgaatacacatatataacacacttgtacatgacttaataacagaaatagacacagacatacaagaatggctttaaactagatttgtgttacaaaataatattatttaatgtctatagatatgtggttttgccatcttggaggtatatctatcatcatatcaggtgacagcaacacagttaaagtgtgacttattctacttcattaaatattctgacattaaaattaggtagtggatgttttactagtttcaaggttcaataattaatatcctttacaatataatgttaaaattttcacaatgttttgatccataattatatctctgtggcctttcttaacataacaaaagtttggtaagtgtttctgttttaaaaattaatctttcactgacatagaattattattattagatcatatatttatacacaaaatagatcgattttaaagatttaaactgttctagtaaaataggagtgtattaatatttaagggaagaattgtgggaagccgcaaacgccattacaagatggcgctagctaccactggccacagcccatgattatgggtaaacaaccaatgtgcgcatgtgcataagagtttttttgctgagtcactccctggcccaacgcatatgaggtactggtagcataaccaattaggtatggacacgtcactcctaggcctatataagcagcaccatttctgggctcagggtctctttcgcctatgcagtcaatgctctcccaataaacatgtgcagaaggatcttgttgcagcgtccattcttgctggcgagtcgggcgctcacaaagaatattgttttaaattgtacctatattttgagctatcaaatttctctgttaataagaaagtaatgtgtttgcaagacaacatgtgtttcaaagagcttattatcaatgtcaatatttctcattttataagtttgtatgttgtatacaaacaccagagcaagaaaagaaaatgttttaagaagacatttacaatgaatattgggtgtggaaaaacatcttcctgctctactagcacaagatcagtcccttatgatacagaacacagtgcataaaaccttgtgcatggagatagcacttgcggtaatataatagacatcacgatgaaaattttaagaaaacagcagatcaaaatattgaacaatacacttccatgttgttttaatagaaaaagaaaagaaataaaaaacagtggttaagagaggtgaacatattagtctctttagaaagaacaatgaaatctacttgttaacatcttgtttaaaggtgatttcattttatgagtacttttgtggccataaaataaaatttgcaaaatgtaatttctaatatgttgtctatattgtttattaatcttgtggccct

SEQ ID NO: 622 - DNA, 1200 bp, mus musculus
agagagagagagagagagagagagagagagagagagagagagagagagagactattttaaaggagtttggaaatcagatatctttagtcacccaggcagtggactagagttctgcaaagtctagtctaatgaatctccattaatcttgtcatctaggctttctattcagtttacaggatacatctcaagcacttcttccaattttgctgcctagtcggtcaaaccactgcatctccttcaaccagcttactgatatccaacagggcttgttgtgcaggataaagccacaggtatcttccttgtgatttgtaacttctcccaccattcagatctcccacattcttttctgggtctatccagggactcttcttgactttttccatacattcaacttctgtaactgaccatgtctagtgcatgtctcacatgctaaagtatatgttgaagaaaaaaacatttcaaaattttctctctgctaactctctaaggcaggtccactcaggaaatcacagtcctcagaagaggcagagcttctgagacaaggttgtacaggcctacatctgcacccaggaggaatgggctgaaactcagccctctgtgcaccttctccactaaaggagatcttgcctcgaggaagtgtctgaccctggaattcaggagagatcgccattttctctctggtggctctctaagacaagtgcacttaggagagcataggcctcagaagcaacagagcttctgggacagggacctatgcacttacacctacacccaggagctagggctgttctgcagccctctgtgcgctggtcttgccaggagagagctggcgtcccaggagtggcaacacatgcttacactctgacaggaggaacaagctccagccagagacagcaagaacatctaacaccagagattccagattgcaaaaggcaaatacaagaattttgccaacagaaaccaagactacttgccatcattagaacccaatactcccaacacagtgagtcctgaatgccccaacacacctgaaaaataagaattggatttaaaaatcatatctcatgatgcagatagaggatttcgagaaggacattaataattcccttaagaaagtacaggagaacacagtagaagtgcttaaattggaaacacaaaaatcccttaaagtatcacaggaaaacacagtaaacaggtaga

SEQ ID NO: 623 - DNA, 1000 bp, mus musculus
ctgtttagcagtgttctcctgtatttctttaagtgagttattaaagtccttgatgtcctctaccatcatcatgagatatgcttttaaatctgggtcgatctttttgggtgtgttgggatgcccaggtctttgtggggtgggagtgctgcgttctgatgatggtgagtgggtgggtttctgttagtaagattcttacgtttgccttttgccatctggtcatctctggagttagttgttatagttgtctctagttagagcttgttcctcaggtgattaatttagcctctatcagctgacctggaagactagctctctcctgagtttcagtggtctgagtactctctgcaggcaaactctcctccttcaggaaaggtgccctgctatctggtgtttgaacctgcctcctggcagaagttttgttccactcaccagaggtcctaagattccgtggagagtcctctggggaccttgggggtgtccgcagactttgctcccaaggtgcccctgtgctggtgctgactggaatggacttgtgaccctgctcaggccgggttttctgcttccctaattaatgcagtctcgggtccagcaaaattggattgaagcagaagttctgttccactcaccagaggtcctaagatccagtggagagtcctgctgggaccttgggggtgtccggagatgctgtgcccaaggtgccccggtgctctatttactaatcttaactcattgtgaccttcaaaaacaataaagcccatagctcagcatattcacactgttacttataacttactttcactgtctgtctttgtacctttggctctctctatatataatctctatcatctatctattacctatcatctatctatctatctatctatctatctatctatctatctatttatctatctatttatctatctactatctatctatctatctatctatctatctatctatctattatctgtctatgtcatttacttacctgcttttt

SEQ ID NO: 624 - DNA, 1000 bp, mus musculus
ccaacccatcaactctctctttctagccttggcactctcctacactgaggcatataaccttcacaggaccaagggcctctcctcacattgatgatcaactaggccatcctctgctacatatgctgctggagccatgagttctgccatgtgtactctttggttggcgatttggtccctgggagttctgaaggtactggttacttcatattgttgttcctcctacacagctgcaaacctattccattccttgggtcctttctctagctccttcattggggaccctgagctcagtccaatggatggctgtgagcatccacttctaaatttgtgaggcactggcaaatcctctcaggatgtgaggagccggtgtagcagcagtcccaagatggcgctcgggactgcagccaagtcttatgacttgcacctgacttcctcatacacctgaaaataagccacgaccatcctgagaactgcacaggtgcaccatgatgcaagatcggaccatatgaagagtgatgattctggccaatggactgctgttacctggactgggctgatggggcatggttgagagcttataaagcggattgcgattgggggaggagatagatatagagagattcctaaagagattgattcctggagagagatttttcctgcatgcatgttgaaaggttcctgaataaactgctttgagaagaatgctgtgtcgttgttcctttctgctggtcagaatcagaggcgacatcaggagacatctatatcaggctcctgtcagcaagctcttcttggcatccacaatagtgtctgggtttgatgactgtatatgggctagatccccaggtggggcagtctctgtatggtcattccttcagtttctgctcttaactttgtctctgtaactccttccatggatattttgttcccccttttaagaaggaccgaagttttcacactttggtcttccttcctcttgagtttcatgttttgtgaattgtat

SEQ ID NO: 625 - DNA, 1000 bp, mus musculus
agtggctctgggcttccttggtgctggcacccaggaggggacagttgatgacgttctcatggtccactaaatccaggtcccttggtggctcttctgtaaacacatccagtgaagccccagcacactgaccagactgcagggcacgcaacaggaacagggcaccttcatccacaatgcctccttgagcacagttcaccactcacacacctttcttgcactgagcaaagtgctgttattcagcaagcctgtggtggagggcaagagtggggtatggacagtaatgaagtcacagagatgccagatctcctcctgcggcaactgctgaacacaaaaggaggctgtggcttcaggagaaatgatggggtcatagcctacagttttcattccaaaggactgtattcccatggccacctgtcttctgattctacctaggccaagaattcccagtgtcttcccgttcagttctgtccccatgaacttctggtcccatttgccatctttcatcgaagcagtcacctggggaatctgcctggccaggcacatgatcattccacagatgagctccacagcattgatgctgtttccgtgggggtgttcatgactaaaatactcttccttgtggcagcctccagatccacattgtccacgccggtaccagccctgcctaccacctggaacttctctgctacattgatgacaccagcagtgaccttagtagctgactgaacgataagtcttcacagtcctggagttcagctataagttcctcctttgctcgtttggcttctccaccacctgcagccctccatcttgcatgatcatccggcagcaggggtccaggctgtcactgaacagtacattgcacagatttgctaagggcattgctagagtcaggccttagaatcaattgctctgggtggacagaagcacatagttcaggaaactgcaggcatggctggctccggtgactgggccaggaaattttaattgtacaggattt

SEQ ID NO: 626 - DNA, 1000 bp, mus musculus
atgattatccttctgggaaatggcatcatcattctaatcacaaaggttgaacccactctgcaaacccccatgtactttttcatcagcaacttttctttcctagaaatttgttatgtttctgtcactcttcctagaatgcttatggatctcttcacactgaaaggaaatatttcctttcttgcctgtgctacacaaatgtgtctattcctgatcctgggggctactgaatgcttcctcctggctgtgatgtcctatgaccgctatgtggccatctgcaaccctctgctctatcctgtagtcatgagttccaaggtgtgtacccagttagtagttggttcctgggtcattggtgttcccattcaggtggggcagacatatcagattttgtctctgcccttctgtgaatctaaccaaattaaccatttcttctgtgacatacctccactactcaagttggcatgtgggaacatctttgtgaatgaacttgtggtctttatttttgctgtattgatcgtcactatcccattcatgttaatacttgcatcttacagcaggatcatctcaactatcttgaagttaccatcaaacacaggaaggacaaaagccttttctacctgctcttcccaccttatagttgtgtttttattctatggatcagctagtatcacctatttaaaacctaagtccaataagtttgaggggacagacaaacttctctctctgttttacaccattttgactccaatgttcaatcccttgatatatagcctgaggaacaaggatgtcacaggggcactgaaaaaattatttaccagattgttagcattgtgagtcaattaaagccaattaaaatatctaattttttgaacatttaatttgaacacaatttcatctcttaaatgagtaaataaattgataatatattgttttcataatggactctattcttcaaacataactgcaagctcattaacattgatttgcttttaaacatcagtgt

SEQ ID NO: 627 - DNA, 1200 bp, mus musculus
ctgaaagctattttctgaagtatcttggtttctagcagatggatgctttgttggtgttttttatcctgggtcacagagatccttgtgcttagaagcatttttctatcacatctgatgagtaaccattttctaaagaatttaaattcgttataagcaatattgtgaaaggaaacagacatttccacaaataaatatagttaaatagttaaaataaattatacatgggtgacattaatataactacagaaagttcaactgagagcccttgacacaaaagatcagatggaaaagctttgaaatagttttgacaaattttggcctctttaaaaatcaacctgcacctgcacatgcaccacatacttagtaacacacacacagacacccacacagacacacacagacacacacagacacacacagagacatacacacagacacacaaacagacacccacagagacacacacagagacatacacacagacacacacacagacacccacacagacatacacagacacacacagagacatacacacagacacatacacagacacccacacagacacacacagagacatacacacagacacacacacacacacagacacacacaaaaatacattgtacacatacaaaaatataaaatcagagtctgtgtatgtgatcaaattaaattattatcaatatgatgtaaatatggcaaaatccagaaggaaaccaaaggcaaaaaatggcattctttacataagtggcatataagaaagatctattttataccatactgatcaaaccttacaaaaattagtaaaagtgaaagaattgaaaaagaaatttggcccgaggtaccttgccagcagaggtgctcaacacccgcaagggaccacacaggattccccacgggatcctaagacctctggtgagtggaacacagcccctgccccaatccaatctcgcggaacctgagactgcagtaaatagggaagcggactacccgggcctgacctggggcacaagccccttccgctccactcgagccccgaggtaccttgccagcagagactcgcccaacacctgcaaggtcccacacaggattccacacggaatcctaagacctctagtgagtggaacacaactcctgccaagagtccagttcgaacacgagatatctgggtaccttccctgcaagaagagagcttgc

SEQ ID NO: 628 - DNA, 1200 bp, mus musculus
gatgctttaatgaccaaattattatggtgatttattaactaagaaaatatgtaattatagttttaaagcaatgggatttaaagttttcattattacgaagacaaaaatctaaaatgtgtactctcagaaatgcatacaaaaactacatagactaaaagcaaaagtgatatatatttgtgatttaatattttccacagatgaatcatgaagagctagagtccataaacaatgtttccacagtgatacagtttgtgctcataggattttctgacctgcccaacctccaaggatttctatttgcagtgttttctgtagtttatattattatcttgattggaaatttcctcataatcataataatcagtacggaccaagcattacagaaaccaatgtatttttttctggcaaatttttcctctctggaaatctgttatgtatcagtgactgtcccaaggattctgttcaacattgggacacagaaccgaagcatttcactgatgtcctgtgctacacaactgtgcttcttccttgtttttggaactactgaatgtttgttgctagctgtgatgtcctatgaccgatatgtggccatatgcaaccctctgcactatcctctggtcatgaacccaacaaagtgcacacagctggcagcagtctcctggcttggaggcatcccagtccagataggacaaacttgtcagatattctctatgaatttttgtaattcttacaaaatcaaccacttcttttgtgacataccaccaattctcacgctggcttgtggaaacacttcagtgcatgaattgtctgtctatgtggtcgttatggtggtggctgcattcccctttatattggtgcttacatcctacagcaaaatcattgccaccatcctgaggttgccaacagccaaaggtcggggaaaagccttctccacatgttcttcccacctgctggtggtactattgttttatggatctgctacggttacctatttgagaccaaagtccatgcattctcctggaactgacaaactcctgtctctgttctacaccattgtgactcccatgttcaatcccttaatatacagccttaggaacaaggaagtgattgctgcactgagaaagttaatactaaaaaaatagggccatgtgtacacttagaacattcttatgtaccttagctactggtaagtcacttatt

SEQ ID NO: 629 - DNA, 1200 bp, mus musculus
agtagagggatggagtgacctgtaagcaagagaggatggggagggaaaagggggacaggatcaagtattggaaaggataggagagaagtatggaaggtcagaaatagaatagaaatatatagcaatgggagatgaggaaccactacaaaagtaagccactagaaagtcccagatgtcagaaaagtaagagactcccaggatccaacagggatgaattttagccgaaatacttatcaaagcagtgatagaacctgtagagaccacttccagtagatagggatggtctccagatgaaggaactggccactcactcatctcaaatattttaccaaaaatgctcctgcataagataacccagacacaaaagaacacacatggtatacactgactgataaatggatattgcccccaaagctcaaaatagacacaatataacccacaaaccatttggagcttttaagaaaatggaaggccaaactggatgcttcaaatccttcatagaaggggaacaaaataatcacaggaggtagagggaggaagggacctgggccaaaaaaaaatgtagcagatactgaagaaaaggccatccagagaccatccgatctgcattcactaaacacccacactgttgatgatgccaagaaatgcttgctgacaggaacctggtaaggatgctccctgagaagttctactactggcacacaaccattgaactaagcatgggaacctccaatggaagagctaggagaaggactaaaggagctgaagtggtttgcaaccccataggaagaataatatcaactaaccagacaacccatagctctcagagattaactaccaaccaaaaagtttatatacatgaagggatccatggctccagatggatatgtaggagagcatggccttatcagacatcaaagggaggggcaggcgttggtcctgtagaagctgatgcatcagtgatagggaaagtgaggtggtagctgaaggaggcccttcatagaagcaaaggggagagaaaaggggggagaggggggatgggaaaggtgggttgtggaaggctaactgggaagtgggatattatttgaaatgcaaatatagattatcattaaataagtaagtaagtaagtaaataaataaataaataggaaaaatccagccctctgaaccacaatggagggttcaaaccaatatggtatt

SEQ ID NO: 630 - DNA, 1000 bp, mus musculus
cacgggatagagtgagtgtgcttcagcagcccgagagagttgcacggctaagcactgcagtagaaaggctctgcggcatatatgagcctattctagggagacatgtcatctttcaagaaggttgagtgtccaagtgtccttctctccaggcaaaacgacacgggagcaggtcagggttgctctgggtaaaagcctgtgagcctaagagctaatcctgtacatggctcctttacctacacactggggatttgacctctatctccactctcattaatatgggtggcctatttgctcttattaaaaggaaagggggagatgttgggagccgcgcccacattcgccgttacaagatggcgctgacagctgtgttctaagtggtaaacaaataatctgcgcatgtgccgagggtggttctccactccatgtgctctgccttccccgtgacgtcaactcggccgatgggctgcagccaatcagggagtgacacgtcctaggcgaaggagaattctccttaatagggacggggtttcgttttctctctctcttgcttcttacactcttgctcctgaagatgtaagcaataaagttttgccgcagaagattctggtctgtggtgttcttcctggccgggcgtgagaacgcgtctaataacaccagagttccttggaactaaaccaccaatcacaggaaacacattgtgggacatgtggctctaactgtttatgtagatgaggatcatctgtatattggtcatcaataggaggagaggccctaggtcctctgaaggtgctatgccccagtatagggtaatcccaagactgggaataggagtgggtgggttggggagcagggggacaggggaggggataggggattttcgaaggggaaattaggaaagggataaaatttaaatgtaaataaagaaaatatctaataaaaaaaagcttggaaaaatattatttttagagtaaaatcttagttgtcatcatcttttattaat

SEQ ID NO: 631 - DNA, 1400 bp, mus musculus
aaatttcctttcttcttagtgtctcttcattgactggggcaatattatgagttatgtttatattttatatttgtgtgtgtagtgatcatacaaagaagtaagttttgttatattatttattaataaatgttttcttcactgatatcattccttaaactttcttttgtgtacaattgtctacacatgcttgttcccttctctgtaataatcctccttccacatttatgtagaatatattctattaccctaatttgattctgttcctgcctacttaagattgtttgatcttatattactcctttatacattcatgaaaaacaaacaaatacatgttcaaattataaatccttgaatccatgatttatatatgagagaaaatatttaatgtttgtatttcagacctattaatataaacattaattttattcaccttcttttttgattttttaaaattaggtattttcttcatttacatttccaatgctatcccaaaagttacccattccctcccatccccactctcacttctccctgtcatttctctatactgaggcatataaagtttgcaagaccaaggggcctctcttaccaataatggccaactaggccatcttctgctacatatgcagctagacacacgagctccggggttagtggttagttcatattgttgttctacctatagggttgcagatccctttagctccttgggtattttctctagctccttcattgggggccctgtgatccatccaatagctgactgtgagtatccacttctgtgtttgctaggccctggcatagtctcacaagagacagctatatcagggttctttcagcaaagtcttgctggtgtatgcaatggtgtaagcatttggaggctgattatgggatggatcccgggtgtggcagtctctaaatggtccatcctttcgtctcagctccaaactttgtctctataattccttccatgggtttttttgttcccaattctaagaaggggcaaagtgtccacactttggtcttcattcttcttgagtttcatgtgttttgcaaattttatcttgtatcttggatattctaagtttcttggctaatattcacttatcagtgagtacatatcatgtgagttcttttgtgattgggttacctcactcaggatgataccctccaggtccatccatttgcctaggaatttcataaattcattctttttaatagctgagtagtactccattgtgtaaatatgccaccttttctgtgtccattcctctgttgagggacatctgggttatttccagcctttgactcttataaataaggctgctatgaacatagtggaacatgtgtccttcttaccaattagaacatctttggcatatatgcccagttattcacct

SEQ ID NO: 632 - DNA, 1200 bp, mus musculus
ttgttccttttcacatgttatcaagtggttaagatagggcggattctagaggaaattcaggacaagctatcagaagtaaagcggggagagagagtaggagcaaagaggaaatatggtacacaaaataagtatacaggcctttccaagggtcttgaacccgaggaaaagttaaggttaggtaggaatacctggagagagattagaagaaaaagaggaaaaagggaaaagaagaaagatcaattagcggaggtctctaggagatactcgtcactagatgagctcggggagccagctcttagtagttctgaagcagatgaagaattctcctctgaggaaacagactgggaggaagaagcagcccattaccagccagctaattggtcaagaaaaaagccaaaagcggctggcgaaagccagcgtactgttcaacctcagggcagtcggcttcaaggtccgccctatgcggagtccccgccctgcgtagtgcgtcagcaatgcgcagagaggcagtgcgcagactcattcattcccagagaggaacaaaggaaaatacaacaggcatttccggtctttgaaggagccgagggtgggcgtgtccacgctccggtagaatacttacaaattaaagaaattgccgagtcggtccgtaaatacggaaccaatgctaattttaccttggtgcagttagacaggctcgctggcatggcactaactcctgctgactggcaaacggttgtaaaagccgctctccctagtatgggcaaatatatggaatggagagcgctttggcacgaagctgcacaagcgcaggcccgagcaaacgcagctgctttgactccagagcagagagattggacttttgacttgttaacgggtcagggagcttattctgctgatcagacaaactaccattggggagcttatgcccagatttcttccacggctattagggcctggaaggcgctctcccgagcaggtgaaaccactggtcaattaacaaaagttgtccagggacctcaggaatccttctcagattttgtggccagaatgacagaggcagcagagcgtatttttggagagtcagagcaagctgcgcctctgatagaacagctaatctatgagcaagccacaaaggagtgccgagcggccatagccccaagaaagaacaaaggcttacaagactggctcagggtctgtcga

SEQ ID NO: 633 - DNA, 1000 bp, mus musculus
ctgactgttccacatcccatatctcctccccgaccccctttctccaggaagatgccacatctccacctccaccctaccagaacactaacctccctgggagactagtcacttgagaattaggtgtatcttctctgtctaaacccagacccctcagtcctctgctgtatgtgtgatgggggcctcatatcatctggtgtatgctgtctggttggtgttcgagtatttgagagatctttggagtgtccaggttaattgagactgttctgcttcttaggttcttccagctttcccccaattcaacaatattcggcagcttctgtccattggttggatgcaaatatctgctactgactctttcagctgcttgttgggtttttcagaggtcagtcatgataggccccttttttgtgagtgtcaaatatcctccttaataatgtcaggtcttggggcctcccattgagctggatcccaatttgggcttgtcgctagaccttcttttcctcaggaatctctccattttcatccctggagttctttcagaaaggaacaattatgggtcatagttttgactatgagatggcaacactctctctcacataattccctttctcctggtggaggtgggctctacaacttccctctgccccagtatagggcatttcatccaaggtccctttcttttgtcccaagagcctctcaactcccaggtctctgatagattctagacggtacccccaacctcctacattccgaggttgcatgtttctactttctgctggtcctcatggctgagtccttttccttctcccaataccagatcatgttcccgctcccccacccataccatttttttttaatttctattttttattacgtattttcctcaattacatttccaatgctatcccaaaagtcccccacaacctaccccctccccactcgcctacccacccattctcattttttggccctggcattcccctgtactggggcatataaa

SEQ ID NO: 634 - DNA, 1000 bp, mus musculus
aagaacttaaaaaggtcaacaagctgaagtgcccagtccttcttgggaggtagaagaaagcaatcacatgtgggagggagggagggaactgagagggaaaatgcatggggttgggggaggtagtaggggagtacctgatatggtattgggtgagtgaaaagtcctgagggccagcagaaaaatggaaacaggcaacgtcaggacataggagtttggggcgccttccaaaaagcaccagagaccagggaggtgagagattctcaggactcaaagggatggactttaaatgaaatgccagacagtaggaagagtgaacttacagagtccacttccaacaggaaaacagggcatcaaatgagagagaggaggcccatcccacagtcacaactctgacccataattattcttatctgaaagaattacagagatggaaatggagaagtggctgaggaaaagaaggtccagggacaggcccaaagtgagatccagctcaaggggaagtcctaaggccagacattattactgaggctatggagtgctcacaaaagggacctatcatgaccgcactctggataacccaacaagcagctgaaagagtcagatgcagatatttgcacccaatcaattgacagaagcaaatgactgctcttgttgaattaggaatggacgtaagaagctgaggaaaagagcgatccagtaggaagaccagcagtctcaatctggaccccctagatctcccaaacactggtccaccaaacaggcagcatacagcagttgatatgaggtccccatcagtcatacaagcagaggactgcagggtctgtgttcattcagagatcatacacttaaccctcaggaccggggtccacagggagtttagagctcatgtagggtgggggatggggacatccatgtggagacagtcatgtgttgtggaacagtcagaaggtggacaggcgggagaggggagaataaaatattaattaatttttaaaagtct

SEQ ID NO: 635 - DNA, 1200 bp, mus musculus
ctggcacaacactctggaaatcggctttggggttcctcagaaaattggacatagtactacccgaggaaacagcaataccactcctgaacatatacccagaagatgctctaacacgtaataaggacacatgctccactatgctcatagcagccttatttataatatccagaagctggaaagaatgcagatgtcaagagaggaatggatccagaaaatatggtacatttatacattggattactactcagctattaaaaatagtgaatttatgaaattctttggcaaatggatggacctggaggatatcatcgtgagtgaggtaacccaatcataaaagaacacacgtggtaatcactcactgataagtggatattagcccagaagctcagactactcaagatacaattagcaaaacacatgaaactcaagaaggaagacaaaagtgtggatacttcattccttcttagaaggggaaacaaaatatccatggaatgagttacagagacagagtatagagcagagaataaaggaatgaccatccagagattgtgccacctggggatccatcccatatacaatcaccaaacacagacactattgtgaatgccaccaaatgcttgccaataagaatctgaaatagctgtctcttgagagattctgccagtgcctgatcaaaacagaagtggatgctcacaatcaaccatttgactgagcacagggtctccaatggaggagcaagaaaaagtacctaaggagctgaaatggtttgcagcctcataggaggaacaacaatataaactaaccagtaccctcagagctcccaggtactaaaacaccacccaaagggtacacatgctgggtctcatggctccagctgcatatgtagcagaggttggcctagttggtcatcaatgagaggagagaccctgggtcttgtgaaggctctacacccagtgtagggggatgccagagcaaggaagcaggagtgggtgggttgctgagcagggagtggggacataggggaaaggatttttggaggggaaaccaggaaagtggttaatatttgaaatgtaaataaagaaaatatctaatgaaaataaatgaattaaaaaataagtgactgttctctacatttctcaaagatattaaataataattacaattgcatatgttgggtatgtaagagaactggcacatctt

SEQ ID NO: 636 - DNA, 1200 bp, mus musculus
aactcacttagaaaggggaccaaaataatcacaggaggcagagggaatgaggatcctgagtgggagaggggaggggtagaggaaagaaggggtggaccaggtgagagagaggagagaagccccgagggtctgttgaatgaatggaaatatgcagatgctggttgtgggtgttcaaggggatcctctcgaaagtctctgagacctgggatgtgagaggtccccaggactcattgggggtgatcttggtcaaaatgtccaacagtgagaacatgcaacctgaataggccacctccagtagattgtcagggtccccagtggagagatggacaccaacttaacttcatatttttgacacaggattgttcccatctaaaagtaatacagggagaaaaatggagcagagactgaaagaaaggccattcagtgactggccaacttgggatccctcccatggatgggcacctaacattgatattatcactgatgtaatattgtaatattgtgtttgcagacagaagcctagcatggctgtcctctgagaacatctaccaactgactgaggcagatgcagatacagccaggcattggactgaggtcagggatgcctatggaaaagttagggaagccctgaaggagcctaaagtaatagcaaccctgtaggaagaccaacagtgtccaggatcctggactggtgtgagctcccagagaaaagccaccaatcaaagatcatacaagggctgtgtattggttggttttatatgccaacttgacacaagctgaagttgtcccagagaaactagtttcagttagggaaatgcttccatgagatccagctgtggggcattttctcaattagtgatcaagggggaagggccccttgtgggtgggaccatctctggactggtagtcttggttctataagagagcaggcttagcaagccaggggaaacaagccagtaaagaacatcccttccatggcctctgcatcagctcctgcctcctaacctgtttgagttccagtcctgacttcctttggtgatgaacagcaatgtggaagaataagctgaataaaccctttcctcaccaagtgcttcttggtcatgatgtttgtgcaggaatagaaaccctgactaagacaggctggtctgaggtcctggcattatttagaagaggactgccttgtctggtcttagtgagagg

SEQ ID NO: 637 - DNA, 1200 bp, mus musculus
tgtttacttgtttgtttatatcgaatctactaatctttatagcaacccagaaggatgacactgttttatttttgttgttgttgtattttgtattgcataatttatttacttgcatttcaagtgtaatccccattctggtttcccctccacaaataccctacaacatcctgcccctcctgtacttctttgagggtgatccctgactcatccacccactattgcctcactgccctagcatttgcctatgttggggcatcaagtctccacaagaccaaagacctcccctcccattgatgccagataaggcaatcctctgccacttatacagctggagccatgggtccctccatgtatactttttcctcttttgttggagcttaagtttctgagagctctggggtacgggctggttggttgatattgttgatcttcctatgaggttgaaatcctttcagctccttcagtccttctcctaactcttccattagggtccccatgcttaatccagtgattggctgtgagcatcctcatctgtattggtcaggctctgacagtctcttagggaacagctataccaggctcctatcagcaagtacttcttggcttcagcaatagtgtttgggtttagtgtctgcagatgggatggatctccaggtggggcaatatctgaatggacttttcttcactctcagatcaactctttgcactacatttcctttagagaggagcaattctgggttaatatttttgagattggtgggtgaccccatctctcaaccaggggccatgcctaaccactggatttgctctctacaggtcctatctctgctttgtatccccattgtatcatgggaaccttttgtatccctggcatctgaaactttttaggggctacccccatttcccatcccctactgctacacacctcaattctattttctgaccctctgtacttcttccttgtctcctcccacacctgatcatgatccactttaccttcccctcctttcttcctcccagatccttcattctttctaccttctataattattttgttccctcttctaagtaggaccaaagcagctacactttggtctttctttttcttgggcttcatatggtctgtaacttgctctaacatataacaagtatgcatgctccactatgttcatagcagccttatttataatagccagaagc

SEQ ID NO: 638 - DNA, 1200 bp, mus musculus
tccttattataatggtataaagtatattcaattaaaattatctatagataattaaattttattatatgctctgagaacaaaatgatctaaaaagtaaaaattttgtatatataaactatataatttaaatagtaaaggaaataaattctctacatattattaatttttgatgtttcatattattgtaaataaaaataatacaattggagagatttagtaattttaacatatcttttaaaaattaataaaatatcatcttatattatcaatgattaggatatttaaaaaaataataaaaaatctattgaacaaaacaaatatgatttagcagcaactaaataattaatttagtaaattgattaccttctatggtttgttagaaaagtatctatgatttttcagtaatgtttatatggttgtgattcaactgaattgttgcttctgaaattctcttttccatagataagtattcttgcacagagtataataaatggaatgtaagaggaacatatcagaatttcttcttatggggctgtcttctaagcggaacattgaggtgttttgcttccttttcttctcattctgttaccttgccatcttgtgtgggaatctgctgatccttatctccattagatgtagttctctgtttaaccaacccatgtactatttcctcagtcatttatcttctatggacattttctatacctcctgtgtgacacccaaactgattggagatcttctagtgagaagaaaaactatctcttatacaaactgcatgctacaggtctttgccatgcacttctttggaatgattgaaatcttaatcctaacagccatggcctttgaccgctgcgtggccatctgcaagcctctccactacatggtcatcatgagcagaagcaggtgccatatcctgatctgggcttcttgggttggtggtgctgcacactccttgtctcagttttgtttgctaatctgcttgcctttctgtggccccaatgaaatagaccactactactgtgacattttccctttgctgaaagttgcctgtaccgacaccaccatcactggtgtcctggtggttgccaattcaggactgattgctttagtaacctttgttgtcttgttcgggtcatatgtggttatactgttcacattaaggaattactctgcagaaggaagacacaaagccctttctac

SEQ ID NO: 639 - DNA, 1000 bp, mus musculus
tgacatcagccatggagatgcagagttttgaatttgcccagctggattcctgactttctttggagattacagttaagtgattggatgaatctcagaagagaccttgaactttggacttttaacattgctgagactgctatatactatgagaactttgaaagttagactaaatgcattttgcattatgttatgtttaagtatgccccctcccccccgcatagactcatgtgtttgaataagtttatgggggccagggagtgaaatgttatggtttgtatattcttggaccagggagtggcaacatttgtaggtgtggccttattggaataggtgtgacctggtgtgtcactgtcggtgtgggcataagatcctcaccccagttccctggaagtcagtcttccactagcagtctttggatgaagatgtagaactctcagctctgcatgtgccatgcctgcctggttactgccatgcttccaccttgatgataaggaactgagcctctgaacctgtaagccagctccagttaaatgttgttttgtataagacttgccttggtcatggtgtctgttaacagcagtaaaactctaactaagacaccctttttgaagactccctgaccatctttactggaaccctgattcctctgtggatctaaggcccaactgagggcagtctgcagcacacctgctccctttggtcctctttaatattttgtttctttgggtctgtgaattttaccatgcttatgctgtactttatggctaatattcatttataattgagtgcataccatgtgtacctttcttggtctgggttatctcattcaggatgatatttttaggtccttccatttgcatgaaaactgcatgatgtctttgtttttaagagctgagtagtattccattgcataaatgtgccacatttgctttatccattctttgattcaagaacatcatagttgtttccagtttgttgctactttgaatacatctgctaa

SEQ ID NO: 640 - DNA, 1000 bp, mus musculus
tagggcatattctatctctgactcattcggttaaatctttcctgattcatcactttgtctgaacctcaggcattgatttcaaagatggcttcttccttctacaaaataactgtattttcaacgtaagggatcaaaagtatgtactaaaggcctatctgtaggctgtgggccttggtaccagatgttttccacggagatctctggccaggcctggtgcaagggttccagtaaagggaagggagtgcagacagggagaagaagtctctgccatgccttctaggtcactaggtaactctgagctgctctgcactgagttgggtcaggctgggatgacaagaagccgactatccagtgaggagtgcagcagaacctcaggtggcactacgggagagaagatctcttcccaagtgttacagctcttggaacaaataattcagacaagggagtagttctcgcacacctttaatgccctggatagaatttatatacagttttggtggtgattcagtgttcgacagcaggtacaactcattggtttggactgtgagtttagggaaaaccttatttgcatgtgggaaggcttggtgctgcttctatgtgactgatagccacacacctctcttgtgggggctgtgagggcggtaacttcgacagaagccaggggtccaggagacatgatcaaacaccttcagtcccatgtaggtggaaattgggtcctccagggttcaagacctatgcttgactggagaccaagctgtctgtgcgcagcccactgccccactgtagtctagccatatcatactgtaacctcgagcattccggctagattacatagacctagaaggtctttgtttgtgatcctttgccaaaacagccatgatagtggattaaaattcgtctacaatgaaaatttataaagcattcatataataatttcccacttacaacatttatatacacttatctttttgcccatattactagttcatgaagtacaaaa

SEQ ID NO: 641 - DNA, 1200 bp, mus musculus
agaattgtcgagttatagctttcatcagtgctactatgtggtaaatattgtaatgtttgtacataggagttttttttttttaatccaggtccatcaatacagtcacaaagtatatcatccttatcctaactcttcaaggcatttggtaagtgagattcatttacttattgtacttactgatgatacaaaacctatacataaataggtaaattaaatgtacttatcactgcttcacactgacatatgtcttttaacaactaaggctattcataggattgagtaaactgtttagcttaaccaaacaataaaattctcaatatgaatattaagtaaacaaatatttgagctttttattacgagcataaacagagataattcattctgtgttgtgtgataatgaatcttacaaatctctgtgacttctggccatgtagtggtagcatatgcctttaattccagcacttgagagacagagacatgcctgaggctgagttcacagccagcctggtctacgaagtgagttcaaggacagcaagaactacaggcaaaaattctatctaataaaagaagaaaacaagaacatgaatttctgtagattctttcaaagtatcaaaaaggatttctcttatgctcattggaaggttaaatttttctccatattgctgtcaagttattaattatactgtattcatgattaagaaaataaattatagccttgtatctgcttccaaacatgcttctccatcttaaccagttctcatactaaattatccaatgctattcttgatctcattttatacatgatacatgatgaatcagatatgtgaaattacagaattgaacccaaggtgagcaggaagaagaataacaaaaattctcatttggtgtctatctacaatttctgaactgatgtatttgggaattgttgaagcacattgccacagtgtttgccagtgttttgcaacccctactgtataactatatatgagaaagaggaaagatggtctataatcctgactacctatgaatttgtttcaaaagaagttatttcataaatggcactcaactaagtaaatcactaagtcatatctaaaggagtttgtgaaccagcacctttcttatatgacatgagtaataaaattagatgattttaattgcacaatactttaaaacgtggagattaaaaataactaaaagaag

SEQ ID NO: 642 - DNA, 1200 bp, mus musculus
gtattcttaaaagatacaattttatattcattatttctcatttgacagtctcacatatttgaaaatcataacataaatgttcaaaatacatagcaggtgacttcttgtacagctatgtggtacaaaaaaaaggaatatatataagcatggaaaacatttttgaattttttcaatatagtaaacatgaacagattgtgcataatactaacaaggcacattttgttcagaaaattacctactgaattttattactaaaagtaatgcctccttcacaaaatcattgtttgaatgtgcagtctattcagtacgcattaaactgatactttctgaataaattaagcctagacaatggtaagtggtaactcactggaaagataagatcttatagaacttacaaatttagcatggatttcaaacattttttttctttttcagattcgttctggcatgtgagttcctctcttggactgacacaatgcagcagaacagcactgtcaccgagtttatactactaggattgacacaggatcccctgaagcagaaaatggtgtttataatcttcttagttttctatatggggactgtagtggggaatacactcattattgtgacaatcaagttcagtcgaacacttgggggtcccatgtacttcttcctgttttatttgtcctttgctgattcctgcttttcaacgtccacagccccaagactcattgtggatgccctttctaaaaagaacatcatttcctacaatgaatgcatgacacaagtctttgctctccatttatttggctgcatggaggtctttgtcctcattttcatggctgttgaccgttatgtggccatctgtaaacccttgcattacccagtcatcatgaggcggcaggtctgtgtcatcttgattatagttgcctggatagggtcttttctacattccactactcagattgttttggccttgagactgcccttctgtgggcccaatctgattgatcattattgctgtgacttacagcccttattggagcttgcctgcatggatacacacatgataaatctgctgttagtgtttaacagtggtgcaatttgctcaagcagttttttaattttgattatctcatattttgtcatcttatactctctgcgaaaccacagtgctgaagggagaaaaaaggcactctctacctgcacatctcatat

SEQ ID NO: 643 - DNA, 1600 bp, mus musculus
aaaaccaaagaagggtctttgtacctaattgtacttcttcttctctcccactacacaaaattgactcaacaaaactatgtttctaattgtttccttactatatgaacttataatccttatgccccaagaagctagtatattaaacattaactaaaaacaatgttttattgacatctactttattgcaaactatgaaaataacctggagacctcatttactttcgatcatctgagaccactttctttctccataacttcttcatggcatttttcacctctgcattcctcagtgtgtaaatcagaggattgagcaaaggtgtaccaattgaataaaatatagctatcatcttgtccataggaaatgttgttgcagggcgtgtgtatataaagatgcaaggtccaaagaacaggatgaccacaataatgtgggatatgcaggtagatagggctttcctcctcccttcagcactgtggtttcttagagaacgaagaataatgacataagagaccatcagcatgaggaaactcactgtacaaatggctccactgttggacaccagaagcaggttgatcaaatatgtgtctgaacaggcaagcttcaatagtggctgcaagtcacagaaatagtgatcaatttcattggggccacagaagggcaaactcaaggccagaaatatctgaactaaagaatgaacacaggatcccacccaggctatggccaccaacaccccacagacccggcggctcatgatggtcatgtagtgcaggggcttacagatggccacatatcggtccacagccatgaggataaggataaagatctccagacagccaaagaaatgaaatgtaaagacttggattatgcactcagtgaaagatatagaggcttccttaagcaaagagtccacaattgttcttggagctatggttgtagagaagcaggtgtcagacaaggataagtagaacaggaagaagtacatgggactcccaagggtctggcttgtcttgattgtagcaatgataagcaagttacccagtaatgtccccatgtaaaaaagcaaaaacacaacaaataggattttcttcctaaaaggatcctgtgtcaaaccaagtaaaatgaattcagtcacattgttattcagccacattgtttctcattagtgatccaaaattgttaatgtgaaacactttgtctggaaaaaaaaaaagacattgattttgatcttggtatatgatgctatgctaagcaaaatactcattaatgatattctctctgtaattttttaataagtagttcaatacttgttcctgcattttattgacaatatatttgccctgttatgagtcccagaaatggttaggaaagttttaccatagaacctttcaaatacaaatccctgttattacaattatggttaatattacaactagaaggatatagagttacaatatgtgatctgtgatatttttatcattaactttaaaattttttcacattttaagcacatagtcaacttaacttttaatatatatttgattgccttggtgttttatgaacccccccaaaaatgcctaatactaacacaccataaagaatatc

SEQ ID NO: 644 - DNA, 1000 bp, mus musculus
tgaagagaactgcctttttccccagaaggcaccaactccaagcagcttcttggctaagagtaggactctgtatccatgtcctatttagagtatagagtttgcttttaatctgtgtgtgtcacagaatctgatcatcaaagtataagagaatcttatccgcttctaatttttaaactagtagagtaaaatggaaaaacagcatctagtagttattccacagctaaaaactggaacttcttttctcatgacagattggagtccatacctgtacaactagagtcaatataatataaagtcataatgcttgtgatataaaaggcaacaaaatgtttttattattgttttgctgtttttttatttaattaggtattttcttcatttacatttcaaatgctatcccaaaagtctcccttacccccccccccactctcctacccacccactcccacttcttggccctggcgttcccctgtactgaggcatataaagtttgcaagaccaaggggcctctcttcccaatgatggctgactaggccatcttctgatacatatgcagctagagacacgacctctgtgggtactggttagttcatattgttattccacctatagggttacagacccctttagctccttgggtactttctctagctcctctaatgagggccccgtgttccgtccaatagctgactgttagcatccacttctgtgtttgctaggccccagcatagcctcataagagacagctatatcagggtcctttccacagaatcttgctagtgtatgcaatggtgtcagcatttggaggctgattatgggatgaatccccgggcctggcagtctctagatggtccatcctttcgtctcagctccaaactttgtctatgtaattccttccatgggtgttttgttcccaattctaagaaggggcaaagtgtccacactttggtcttcattcttcttgagtttcatgtgttttgcaaattgtgaactcacatga

SEQ ID NO: 645 - DNA, 1400 bp, mus musculus
taataggagggggacaaagaacagattccatagctttgcctttgtagaccttaaacttctcttcagtgtttttttgcaagcttaactggttctgtatacccaatcaactatttcaaattaaactcttagccatcccaaatgacatcctgcctgtgctttaacagaaggtctaaaacacaactcgagttgtcttcatgatctaggaatatttacttccctctcaagaaaaatccttaaataaaatctcatacctcaaatggaattgaaacactcgtttgtttgcttgtttgttgttgttgttttttacttgaccatgtgtacaataatttttttttcaggtaatgtaattgagtaacacacaaactacatggaaattaggagcaatgtgacagagtttgttctcttggggctcaccagaaacccaagcatgcagaaaatcgtgtttgctgtatttgtcgtcatctacatcatctccatggtaggcaatgtgctcattgtggtcactatcactgccagtccatcgctgggctcccctatgtactttttcttagcgtatctctctttcattgatgcctgttattcctctgtcaacactcctaaattgatcatagactcactccatgaaaaaaagacaatactattcaatggatgcatgacccaggtctttggggagcatttctttggaggtgctgagggcatcctgcttactgtgatggcctatgaccgctatgtggcaatctgcaagcccttacactatacaaccatcatgagcagaagggtatgtggcctgctggtaggagtggtatgggtcggaggttttcttcatgcaaccatacagattctgtttatttttaaattacctttctgtggcccaaatgtcatagatcactttatgtgtgatctgaaccctttgcttaaccttgcatgcactgatacccacattctggggctctttgttgctgccaacagtggttttatttgtctgttgaacttcctccttctgttggtctcctatgtggtcattctacgttcattaagaaaccacagtgcagaggggaggcgcaaagccctctccacttgtgtctcccacataacagttgttgtcttgtttttcgtaccctgcatttttgtgtacatgagaccttcagccactttgtctattgataaagcagttgctgtcttctacactatgataactcccttgttaaatcctttaatctacaccttgagaaatgctcagatgaaagatgccattaagaaattgtgtagatggaaagatgatgttatttccatcaacaaataaatgtttctaaagttcaacatttgagacaagtatcaaaaagagaatcatcaaaatgacattgtatttgaagccagcaagaatgttacccaggacttct

SEQ ID NO: 646 - DNA, 1400 bp, mus musculus
cctgttaaaagatgacctatgcatcataaatttaatctcctagcttcacacaaaatgatactactgacaagcatgaccgaaggattaggaaacattcatgtcaaaaattttgaaagttcatctcattgtctgtggtgaaaaaaatatcacaatcaaacagacaaaatagtataaaataggaactattcaccaggagtgactttgcctcaaaggagatctagttctgtctaaaggtcccattgctttacctggctaagaagaaaaattccaatgacattatgaaagtcgataattgccaaccaataacaggcccaacttgatacccatctaataggcaagcactagtccctgacactattaatgatactctgtaatgtttgtacaaaggagtctgtcctcttagaggctccatccattagctgactcagacagatgcagatacccatagccaaacagtggttgaagcttggggacttctggggaagaataaagggaaggattgcatcccaaaaggggatagaaactctacaggaaggccaacaaagtcaacaaacctggacgttggggctttcagagactgaaccatcaaccaaagtacatacatgggctggacctagacctccccacatgtatgtagcagatatgcagctaggtcttcatgtagagccaaacaactggcatacaataaatttcaaaagctgttgcctattcataggatatgttctatctggtctgcattgtcaggcctcagtgaaagaggatgaacctagcccccacagagacttgatgtgccagaaaaaaagggccccacccactcaggggaaaagaagaggggagatggggtaaaaatcatgggaggggataactgggggcagggagtgggatgtaaactgaataaataaaaataaattaattttgaaaaaaaagaaaatagggaacaaggataaagaaacatcttacaaggcataaaaacactcccacataacaaagattagtccaactgaagagctcatagatctgccattgaaatatgctggtatagagaaaaattaatttgctctgaactaataatcattaaaaataccatattggtagattgcataagagtttatgcaatacttcttaagcatgccaacatgtatctgaagtttccggtgatcaaatatctctttttttgatgtttgataagacattttattcaaattaatcttctttttgggggggttatttatttatttttttccattttttattaggtatttagctcatttacatttccaatgctataccaaaagttccccatacccacccacccccactcccctacccacccactccccctttttggccctggcgttcccctgtactgggggatataaagtttgcatgtccaatgggcc

SEQ ID NO: 647 - DNA, 1000 bp, mus musculus
ttagatgctgaaaacgcctttgacaaaatacaatacccctccatgttaaaagtcttagagaactgatcaaaaagaacccgtgcctctggtcaggaagggctctggtgtctttgttcctgctgtcacaggcccatcacaattggattggaaccgatgttgtgttctgctcaccagttatcctaagatctcctggagagtcctctagggaccgtggggatgtccgctgactctgcgccctaggtgacccggtgctggagccgactggaagggactcactcactgataagtggatattagcccagaaacttagaatacccaagatacaatttgcaaaacacataaaactcaagaagatcaaagactgaagtttggacacttcgccccttcttagaattgggaacaaaacacccatggaagaagttacagagacaaagtttggagctgagacgaaaggatggaccatccagagactgctccaccggggggtccatcccataatcaaccaccaaacgcagacactattgcatacaccagcaagattttgctgacaggaccctgatatagctgtctcttgtgaggctatgccagtgcctggcaaacacagaagtggatgctcacagtcatctattggatggaacacagggcccccaatagaggagctagagaaagcacccaaggagctgaaggggtctgcaaccctatcggtggaacaacaatatgaactaaccagtacccccagagcgcatgtctctagctgcatacataagcagaagatggcctagtcggccatcattgagaagagaggccccttggtctagcaaactttatatgccccagtacaggggaacaccagggccaagaagtgagagtgggtgggtaggagagcagggtggggtaagggtataggggactttcaggatagcatttgaaatgtaaatgaagtaaatacctaatagaaaatttgggaaaaaaaagtcttagagagatgacgcaagacaca

SEQ ID NO: 648 - DNA, 1000 bp, mus musculus
tacactagcaagcgtttgttgcaaggaccgtgatatagctgtctcttgtgagactaggccggggcctagcaaacacagaagtggatgcccagtcaaactccccacctggcactgtccccggagcgggtcgcgcccgcccgcacctgcggaaggatcattaactctcgagcgtgcccccaactcgccagcaagaacgacgctgcaacaggatccttctgcacacgtttattcagtcctgtttcttctttctccatatatctcccttgtttatatctcccttgtttatatatctcccttgtttttatatctcccttgtttttatatctccctcgtttatatctcccccgaaccctgggcctctcactcttttatactctcagttcccatccacgcacagcaggccacgccacctcaccaggcacgcagcttcagctaatcagggcagcaggggcaaatctccaccaaattggattcacctgtatcctggtacacctgagcagcactcaagatgtttgtgtcttatatgaggaagtcaggtgcaagtcatatgacttagctgcagtccctggcgcctttgggactgccgccacacccgctccccacactcagagtcaactattggatggatcacagggcccccaatggaggagctagagaaagtatccaaggacctaaagggatctgcaaccctgtaggtgcaacattatgaactaaccagtaccctggagctcttgtctctagctgcatatgtatcaaaagatggcctagtcggccatcactggaaagagaggcccattggacaggcaaactttatatgccccagtacaggggaacgccagggccaaaaaatgggaatgggtgggtaggggaatggggggggggacttttgggatagcattgaaaatgtaattgaggaaaatacgtaataaaaaaaaaaaaaagatgcacctggaagtacctcacaaatctcttagttgaatctatctccagtcaagttgat

SEQ ID NO: 649 - DNA, 1200 bp, mus musculus
atttttactctgaataagttccatctgggttggttgaattcacagctgaatgacacagtgggggtaaaaggagctggctgtatgtcagctccacgtatggaagctaaaagctcgatggtgacacagtttgcatgtagtcacagtttagttatccagtctccaaaagctagctatgcatgtggcttcaaaactgttcaacctccacaaatgatactgacagtatgatttaaatgtactgtgagcgtgtatgaaaatatcaaagaacttgtaataataataaagtagaagacactggagatatatatatatatatatatacccaagagaaatggaaacaaacacagagcttactcatctcttagaggagcttctaaataaacagtcttgtgagaataaacaatgctgagactgagctctgtggctcgtgagcccattccggaactccacatcttgtcttcatgtcaaagactccaacttgagctcaccagatgaagagatatgaccatctgaggcccttgctatgagctggaaaatgttaaacccgtttgcacactcagttggtgttaacggtgactcagaacattttctctactttcaaagaaaaggagactcagcttctagaaagcctgtgatttaagtggatttggttttgtaacttagtgggggaagggaggacagtgcatgtaccctagaatccaaatcctggaatcaatacaaactgttcctagcagtaagcaacccccgtgcacatccccacccagatgacacaaaggcctccgggaagcaaagtgtcattgccatgctcgaaagactcatttactcagaaacgacaccaaagtcccctcaagaaagtaaagctgaggctcctcagaaagcctgcagatatgggcagcaaaagatgctttcctcgtgcatcaaatattagttattctcagtattaatacccattgattttctccgatcaatcttgacttacatttttcaccacaaaatctctgatggtccattctggaagaacgacttctgatgtcatcgccacagttatgtccccgtagtcctgagcctgcttggaaggccagtactcctcacatttggtctagaacacaaggtcagggatcacacatccaccatcatcaaaacctcgcaaggaaaaccatggaactgtcatggggaactaactgctcagtcccttatcggggt

SEQ ID NO: 650 - DNA, 1200 bp, mus musculus; identical to SEQ ID NO: 649

SEQ ID NO: 651 - DNA, 1000 bp, mus musculus
agcctcaacttactcccctgcttctcccttctgagtcctggaagtataagcatataatactacccaagctctctgcctgtttttgtttgtttgtttgtttgttttttaataagatctcactaaccgatggttgtgagccaccatgtggttgctgggatttgaactcaagaccttcggaaaagcagtcagtgctcttaaccgctgagccatctttccagctcatctctgcctgttctattacatgctaacttcatctaaagtctgtccttggtcttctcactgtgcactactctccttcagtgctgttatctattcttttgtcaatgtggttattgacatatcatatgtctctttgatgctccagacttgagttcccaactgctgcctacatcaacacttgtctaatatacatcttaactcagcttgtctagaatccttcttctatcttttaacatgaacttagtaaaggaatatttgagcacttagaatctgacttttctcttaggcatcatctttaatttaaattcttcatgaccttctgattgcttttctgtttttcaaatcattctgtgcatggatttacatacgtgttatatggtttttgattacttttgtttttgagtcaggagttcattcatcctaggctgacctgcaactgtgtgtgtacctgatgatgacctgatctttctgcctctaccttctgaatcacaggtttaccatctgggattgtacagtgcagggacagactccaagactttgtgtgtactatgcaagctttctacccaccaagtcccatctcagaccctcttggaaaatacaagtttggggggctggtgagatggctcaccgactgctcttctgaaggtcctgagttcaaatccaagcaaccgcatggttgctcgcaaccatccataacgagatctgacaccctcttctggagtgtctgaagacagctacagtgtacttacagatattaaataaataaatttgaaaaagaaaa

SEQ ID NO: 652 - DNA, 1000 bp, mus musculus
atcgtggctcacagtttgacaggacacattcccttatggtagggatgccatagcctccgaagaatgaggcagctggccagatcacttctacagtcaggaagcagagagcagacaggaagtaaggccaggctatgaaactttaaggctatcctccagtgacctacttgttctgttaccttttaaagattccacatcttccaaaacagcaccagttgctggggaccaagtgtaaaaatacatgagctggtggggggaacattccacattcaaacccactgacccactttacagatatgcaaacaaaagacccgggtcattgtaccagactcactcatgcaagtcacatgagaccctagaggacagaggtctatgtctggcccttcccttcaaaacatcaaccctacagggaactgcccttgctctcagatgctgggagctggaccagactgtactgccttctttgcggtggtctttctgctcagcttgctcagctctcttgtccttgtctgtaccctggcaaagagggctcacgtgaagtccgtgtgttcctacctaatgcaacaaagtggtagagcaaagactcggaaggacctaacttatgtacaaggtcccttgacatacttaggacagacaagaagtcaggatcaggcagaggcctgaggactgggatcaatgaagatgtctcctagggaggtagcagtgatgtgatagtggtgattattaacttgtcagtttaggctcactgggaggtgtgctttgaggcatgcctatgaaaattatcttgattgctttaactgacagggacaacccatgccgatcgacagtggcagggactctgcctttgagagggagtcacggactccatgacacggaaaaagcacaaggagctctcagtgttcgcttagtcttgagtgtaggcacaatgtgaccttttgtatggcctttcaccatgatggactgtaccctggaacagtgagctagaaaaggccctttctccccg

SEQ ID NO: 653 - DNA, 1200 bp, mus musculus
ccacatacagggaatggaccgagatccctgctgggtgagaaagactactctggtctcctggggcccttgctccagcgcgtcaaaatattttcctaaaacagttctcccaggagaccctgctgatgtaccagaaccacctcaccatgcagtttatgggaaagttattaccatctgacagcggctaatcccaagactgtccatgggctgtactgttctagaacacagtatcttccaggaactcctccatccatctcgtcagccatcacaacacacgtaattaacccaggcaggagctgagccctctacacatctgctttcatccctctccccacacgaccaggacaggaactttcatgattcaaggaggaaacggagggacaaaatgttaaaccaactgccccacccattccacatgtgactgctgtcccctgaagttgttcagtgcacacctcgcacattgcatgtatgatctctgactcctcctcgggcctcacaagagcaccctgttctgtgagtctcacctggattgcaaggtctggttcaaggtctaccctgggtctttggaccccccccccccagagttgagtggctcccggtggcaccagtggtcacctctatccagttgcctgtgtacatctggatgctctagacaaactccagccacaggggctggcctggaattgacttttttcctcctgcttcacctgtcaagatgccaagggctctctataaatatttgttcattggccgacctccaggtggtaagagatgaggcagaaaccccagaaataaatcagacttccagagccagaaaggtctcgaaaagagtgtgccctctctatttggtaaatgggtaaactgaggcatggaggggatctggcttgcccagtatcacactgtctgtgggagctttgactctcattgagagctcttgccatcagccgtgtaaccttggcccttagccctgctatccccctagatagataagagaacccagccttgtctacttgatttctgggaaagtccccagtcacagggtgctataatttggggatggaaaggtctttctacaacttcagtttgagatgaccacccaccatttacagggagctagcctgagatggcctccgaccaaaattgatcttgtctttctcggagtctatcaatccaactattttgagtgatcatgttacatggatc

SEQ ID NO: 654 - DNA, 1400 bp, mus musculus
aagagcaatctgcaaattcatctggaataacaaaaaacctaggatagcaaaaactcttctcaagtataaaagaacctctggtggaatcaccatgcctgacataaagctttactacagagcaattgtgataaaaactgcatggtactggtatagtgacagacaagtagaccaatggaatagaattaaagacccagaaatgtacccacacacctattgttattagacgcgttctcacgaccggccaggaagaacaccacagaccagaatcttctgcggcaaagctttatttcttacatcttcaggagcaagcgtgtaagaagcaagagagcaagaagcaagagagcaagaagcaagagagcaagaagcaagagagagagagaacgaaaccccgtccctattttaggagagttatccctcgcctaggacgtgtcactccctgattggctgcagcccatcggccgagttgacgtcacggggaaggcagagcacatggagtgaagaaccaccctcggcacatgcgcagattatttgtttaccacttagaacacagctgtcagcgccatcttgtaacggcgaatgtgggcgcggctcccaacatctccccctttccttttaataagagcaaataggccacccatattaatgagagtggagatagaggtcaaatccccagtgtgtaggtaaaggagccatgtacaggattagctcttaggcttacaggcttttacccagagcaaccctgacctgctcccgtgtcgttttgcctgggggaagggaactaggacactgaaccttcatgaaagatgacatgtctccctagaataggctcatatatgccgcagagcctttccattgcagtgcttagccttgcaactctctcgggctgctgaagcacactcactctatcccgtgcaatgagtctagcctcgtgagatgtaagagctgagtggccagcgacctattgcctaagcatagataaccatatatcaggggaagctccatgttctagtcctgcaagcgcctgggcaataaccaccttgtctctcctagtttgggccttaagcttacagaccaatcaaagaagcaacactaatccacagcaaagtgtatctccaaataatattaatcccacccaattttttaaagaaggaaaatgctgaggagatccaattgggtaatcctttggtcagggacaggtccaagcgcgtggagttgacctgaagtctcaattcccgaaggatctgttcaaattcagccatccaattctgtaacatatactgaaaaagactttttgacaaattagctgccctagtaaatttagcatactgaatggaaataacacacaatcccggaaacttttgttcacatccctgctgagttatttgtcataatacatctag

SEQ ID NO: 655 - DNA, 1200 bp, mus musculus
tattattgagaatagttttctgaccctcattctggaaccaagcagccctggcaaagagcaagcctgagatgatccctccccatgccaagcaggcgaaacacacctggaacaaaccctgtccagtgccacatggcacaggcagggcataaccctcttgaaacaaccccagataccaaaaaagccctgagtgccactaagatgagtaagtggagaggtagaagtgaaagagctacagaaggatgtatgaacaatgaaaaaagacagaactagaaactcaagagtagtgaggaacagcctgatgagagtagcctgcaatgccactaaagaccatggtgtggtcctggcccatgcagccactgagggccatgtctgagtttgtcaccctgcagctgtagggagtctgttaccatcaaagtccctggcagaagtcccttgtctaggctgctacctggggccatgttgatgtctgagggatgtgcagaactgactccaccctttgccttgcttcttgggagagctggccctgaaggcatgaggtcagtagagatggccctgcgcatagcccaagaagcacagtagcactggccttagttgtgggagttgtgggtaagttggctctgccagttgtgctggcatgggcaagggaaagatgttcttctcttccactccctcacctctttgtcactcaccaccaatgggaggtaggagagcaggatctgggtcatgagagtgggagagctggtcctccctctccccctgctgcagcactcagatgaatatccaagtaccttacccagacaacacaatagagctgactctggagacatgggcataggtgagtcagccccaagggcttggaaggaggagagctggctctgccccttcccagcagcaacattggatgagctaggcagggcagtgctggagagttcactctggtagtgtgagtacagtagaactggagggatgatcagttcagatagcacccagccctgatccagagctttcagttggccagccccaacatctgaactgttgatgtactgctggagtgcatgtaggagcaagtcctacatgtctaaagctgtaggatatcatcatacagaacaacaacaggatatctgagaggagttcaggggaggatcaagtatttatagtgtagcagcagccagaggccttgaatcagaccaatgactcatt

SEQ ID NO: 656 - DNA, 1000 bp, mus musculus
tcccaagttgatgataatggactgaacctctgaacctgtaagccatccccaattaaatgtttttttataagacttgccttggtcatggtgtctgtttacagcagtaaaaccctaactaacacagaaattggtaccagcatattggggtattcctgtgacagcctagccatgttttggggaggactgtggaaggactttggaactttgggtcagaagatccatttggtgttaagagctctgtcgaatggtgtataggagcttggaagataatgttgagaacagtgcagaggatggaggcctgggttgtgaaatttcagagggaagattaaagactcttttcagggccattgctgttttgattgtgaagattctgtagttctggttagctggggctgaagaatcagctgtgattaacaagataccagaactactaaagcaaaaacttcgcattactgggactattcatgctggttagctggagctaagaaattagcggtgattaagaagagaccagcatcactgaggtgacatcttctggaaattgttttctgaaagcacaaagaggctgtgttccagagatagccaaggcagggaaggtgcctggatgtctggagcccgatattgggatctgtctcagaatctgtcctctagggactttgggggtgtctgatgactctatgcccaggtgacccagtgttggcgctgacaggaagggacttgtgaccttggtcaggcagggtttcctgcttctctaatgctgtctcaggtcccgcacgattggattgaaacagaagttgtgttccactcactggtggtcctaaggttgcatggagagttctctaggggaccttgggggtgtctgctgactccatgcccaaggtgaaccggtgctggtgccgactggaagggcttgatttttgtttattgtactcacatgaggatatagggcttttcctgtctctgaaatcatttaggggattctctaatgttaccatacaaa

SEQ ID NO: 657 - DNA, 1400 bp, mus musculus
ttgggttttctttattgtttctacttccctttttagatattggatgattttgttcaattccatcacctgtttggttgtgttttactgtaattctttgagggatttttgtgcttcctctttaatgacctctacctgtttagcagtgttctcctacatttaagtgagttatttaatgcccttcttaaaatcctttaccagcaacaagagatatgattttaaagctcaatcttgcttttcatgtgtgttgggatatccaggactcaatgtggtggcgtactggattctgatgatgccgagtggtcttggtttctgttagtaagattcttacatttgcttttcaccatctgataatctctggtgctatatattctagctgtctctggctggagattgttcctcctgtgattctgttagcctctgtcagcactcctgtgagtccaattctcttctgagtctcagtggtcagagcactctctgtagacaagctcttctgttgcagggaaggtacacagaggtctggagctcagatccacctcctggctgaagatgaaggctctgtccaagaagctctgtttcttctgtggcccatgcattctcctgtggggaatggtctctgagagaccctggatacaagatggagctgtcaaatgatttctggagtcagagcccttcctggaggctgattctcctctggtagggaaggtgcccagatgtctgggattcagctctatctcctggctgaggatgaagtcctgaagggaccttgtccaagaagctctgttgcttctgaggtctgtgtgttctctggtgtggactgatttctgagaaatctgagacacaggatgggactctcaactgagtcctggggtcacagccttctctggaggccgattctcctctatgaacctaaggtcctatgtgtgctagggtgcctgtggcgtggagaatcctttgggaactgtatggctctcagcagagtttgtgcccaagatgggaggggctggtgctaacctgaacaaaccgcagatgctggtcaggcagatttcctgtgtccctgttcctgctgtcacaggctggtttttttggaagagatgtcgtgttctaatcaccagtgatcccaaatcctggttgtgctaggatgcctgcagtacagagggtactccggggaccttgggactgtctgccaagttattgccaaagtggtgctgggctgatgccaaccagagcgaacccacaaaaatatttttaaaagttaagtaaaaattaaattatttggtaaagaatgaaactcagtagacatacagtccaaaactcaaattttggtgaagtcattgacacagctttctggattatctaaagtttgttttggacactccttcctgttaaaagagttagctcct

SEQ ID NO: 658 - DNA, 1400 bp, mus musculus
gcaaaactatttgtattcaactgtagtgattttcccagtattgcttcccagatgggaactcttacattgaaggatgatataagagtcataaatttggcatgaatataaaaatttattctgaaaatttacaagcctttataagtgtaaagaatattgcatagtggactcctatttagccccttggtatacattattctgcctagtgagcatggatgaacataactcagttgatttctttatcttgggctgaaaaatatgaagcaaagagctgtaaaatgttaacaagtgagcttgttcagccactgctctgcctcccttcaggtggcctgctgtcccaggaatgtccagattagatccatcaccactgcccattccctgcctgccaagtcccctggagcttgcttagctaccttgaactgcctgctgctcacagtcccagctccaatgtttgttcacctatcaacccaccttaaccaggactgctacaccaggatcatctatgctaaagccttccctctgcccaaaacgccctgtgtcactgtgtctcctggcttatttccggttgcttcaagatatgcactgctccctgagtacaattgtccagcccaagtctgccctccagacagctaccttaccaggaacatccagagatagccagatgtccaaagaccaccatacaaagacaattaaagagtaagggaactatgacacctttggagcacagctattctactaaaggaagacatcaatatcttagcacaactgacacacaagaaaatgaccttaaattcaatcttataaagatgatagggggagctgatcctgtgccacagtgtccagagctgatcctgtgccacagcaccccttactcaaataccaccaggagagagcctgatctcccaggagtgctgacaagcctgtgagcacaggtaagaccaccacctctgctcagaaggacccacccagagccctcaggacataggaaccaaggcacagtctgggacaggagccttcacttttccatctgcaccaggaactggacctctgccacagcacttcatacccaaatactgtcaatcaatttaaaacaaagataacaattcaaagaatcaaggaaaccaggagctggttctttgagaaaatcaacatcataggcaaacccttagccaaactaactataaggcagagacagtgtccaaattaacaaagtcagaaatgaagagggggacacaagatcagtcttgcaggaaatcaaagaatcactaggtcttacttcagaagactgtacttgacccaattagaaaatctaaatgaaatagatgattttcttgatagatgccactactcaatgttaagccaagatgagataaacaatttaaattgtcctataatccctatgc

SEQ ID NO: 659 - DNA, 1000 bp, mus musculus
ttggaaattatcttcaaacttttataataggaaatataattaccattgaaacaaagggtcttttttagaataatgactcaatttaggtaactagaataaattatttcatattagatataataatactggcttatttgaatggttagtccataagtttcaaaacaacacacaaagaagttcaaatgtttggtcatattatactattaataactgtatttcagaggaagcaaagttctttatattaagccaaattatttaccttgttttgttcctcaagttttaactaaactattagaaagataatttttaaaatatttctgttagttttaataagaatattcttttctggttgaagtgaaaattatttttacttaatttctgaatatatatagaggtttgcttgaccctccccaccacagtgctcctttatgtaaagatttaaatatatataactagaaatactcataggtcaaaatatattgcattttcagaaataatgaaagatgtctgtatttttaaacatcttaccatacagataaacataatttcattgtagcttcgattctgcaattcatacataacagaaatatccaccaaattaaaagaaaatactgatccaaatacaaaacactgcccgctctgaaggaatttttactctttttcagttcaaagtatacaaagagaaaattcttcgaaaaccttgtaaccatgtctactttttatcatcagtgtgacagaatacagtctcctaggagacacagagtttgacaaggttctggaggtatttccagaaaaggtgaagtgaggagggaagccctatccagaatgtgggtggcaccattccatgggctggagagtcttcccaacaggccaacagggtctcagactacaatgaagaaggaggaagaagaggagcgaagaggagcaggaggaggaggaggaggagaagcaggggagagagagagagagagagagagagagagagaaagaactcagtaaa

SEQ ID NO: 660 - DNA, 1000 bp, mus musculus
aaaaaaaaagcttagctgataaaaatgcttcttcgaatgaaaatagaagtcgaggggctagggagttttctgagttagtaaagtgcttgctcgataaacaagaagacctgtgttcacattcccaggtccaggaaagaagcccagcatggcaatgcctggaattgtaacactgggcttagggaaaaggcatgtggctggaacatggtcagcagcaagtcttgttcaactaggtatcgttagagaccccatctcaaaattgatagacagtggcaaaagaagatgtttaatgctgccccgacctgcagaaataatcagcggggacctagcacaggggcgagagagtgggagggacaagaaacacaaagaacgagagcaagacaactggactgatcaagcacagaaaaactttattcaggagtggcaatataagtataagcaagaggagccttcaagggaggcgggaagagcctaggggctctccaaaggtcaggtggcaatctcagctcctggaactaatggtcatagcgtcctctctactcataaacattattactgttatgaccatgaatgttctctcaggatggtttctgtaaggcagaacttttccacaaggccatggctgaggccatggctcctggcataatgccaaaccccaacttgcacattcacttacacattcatatatagggacatatatgcacataattatataaaaactaaaaatgtaaaaatgcatttgagtcagctagcaatcttcggagtcagataggtccctgagttcaagacagcaaggtgtgggttctctcctgtatctttgcgagtcattttcattcaggctttactcatctatgtatagtttaaaaagaaacaagtatctatcattttttaatatttgcacgtatattctatctcttccaatgaaataacactggaaagtgctgtgatttcccaacatctggcatgaagggcacaagttgatttgtttagtggcacctttgaa

SEQ ID NO: 661 - DNA, 1200 bp, mus musculus
tgccttgtcctcaccttacttctctttctatatttctgtgatcataagccagtcatattcctatttgaaatctctgtattattttccctacaacttatataatcttcccatatccttctgggcacaatctctgaaaaagaaaatcttgtctgctatatgattttgtaattcctgctctaggactgtgtttgtgtctgaattcgtgccctaattctgagaaccctattaagtccagtttgactcttttaccaaggcaccaaccaggatccatttagaaaccttgctgaataagcagatgggaagaatgtaaatacatgtagacttatgccataacacagaccctgaatggcctacagatatgcatgggtgctggtgctaaataagagctggcattagtcttagtttagaactggaattttaaactaaatcttatttgagctgcaagattgatgacctttaaccctctcaaaggaatacatgaataaatgtaaaattttattacattctatagtgcaccttgatatgcagattaggggggtcttttgcattggtaggatatttgtgaagactatttctgaaaaattcttaatgaagtaaacaaagtaattgaataattgagataaaagatgcaattattcagatatgaagtggagttctggtatatctgtgttgtaagtcgattactatagattcataagatggaatcgcacttgtcccttctctggtacccacgcatatagtacacatttgtgttgtatgcatcaatgaatttctcagcatttatttctccatgtgtccaaagtgatccagaatttagtgacaaataagttcaaaaattggacacatactactttctcatacccttcttttttcttgttctaattcacttaagcagtgctatacaaagcccttaatctagtcctaactacagtgccctgcctttctctaacatatgacagttttcttatttatcctactttattcagagtgctattaggtaattgtatatttattattaaatgtaatttttgtaaagcagtgattattctcatctaaacacatatttcaacacaaaataataactctattgaacataaaagtgcttatctatattggcttagtaaacagatttagtgacattcatatatatactaactagatagatatgaagtgctatgttagacattaaaaattatatgt

SEQ ID NO: 662 - DNA, 1000 bp, mus musculus
cagtgacccagtagaaaactctacaagggagagaacagtgggccacattcccagagaaggtgcctgaaaccacaaagcccccacctccataattctgtgacaattattcacacagacaacatcccaagctcctgacattctggttagactccaccccaacagttacctgactatagccaggtatgctcttccccatagttacctggttttcagcaagatagtccagctcattataaaagggctgcttggcccctccttgctctctttaagctctcacctttcttactctcttttctagccctgcttctctctctcccttcctcactctcgacacatggtcatggctggcctctctccctcttttaccttctccctttatctctgactttggacaataaatctctaaaaccatagactgtctctgctcatcaagtcttgccatacttgaatgatgggatatactttcccctaaagagcctcatctaaccccccgaaaggccttcctgcactctagtcatgaaccatacatggactggaccaagtactctcacccaagtgggaaccacccagcaccctctctccccctgccctctcctccctttggtcccggggatgaccgaactgccctcaggtcctccatttgttctcagcttttccaaggtgttcagtggtgtctgggatgcctgagactgagaacctgttatctaggactgccccttgtccaccccttgccgagatgatatctggtgacttcccacaggcagacacccaccctgactgcctggatagcttgcagcagtccttcatcgcctgcttgcacagagcactggaactctggtgggacacaggttttttcccactccctttattaccctgtctcccactgcccaacaacagttgtgtctctctttcaatgatttgttaagtggtaagagtgggttgttgaagtctcccactattattatgtgaggttcaatttgtgtgtgttgagctttagtaa

SEQ ID NO: 663 - DNA, 1400 bp, mus musculus
gacaaatagagctaagaaagtaatgtatacatttagtaaaatactcagatctgaaaagatttaaactatccaactggattaaattgtagtctcatagtaaatagcaccattattaatgtcattgaagtagtgtattctttgtgaactaacctatattgatgttaaaatttttgtttcattgcctcaaaattgcatagatttcactaccatagaaacaacagagttgctcaataaatgtttgttcgtcgggtgacaaaagaaacgaagtgtggtaagtttaccaaggataagtatttttttttaagtgagacagaaaaataagggaaaaacatttatttttccaaataatctcagactgactgctttcattagtaattattgtctgttggcaatggtctttcagttcctttgaattggaagggctcagtattgaaccactgagctgttggtctagatgaaattggcacatggcatgggaagacttattttggtataaagactgctcacacacttagagattattttaacatttggttattaataaagttcctctgacaattatacagttttcctcctgtgccttctacttttatctcttgaaacaataccccatgcttaaattctgcacatgataaatgataagtattagttatcaacctatatatatacttatcttttatctgaccaaatgtctgcctgctgcatttaatacacaacccaccatccaatggaagttcagaaggcaagtctcaatggcactggaaaggcttagagatgatagcctcattgtatcaaaatgtttctccataccattttctggagacaattgactttaagaagagttaggtgtttaatacttttgttatttattctactataattccaggtataaattagcttaaataagaacaagtgatatttttagtaatttaaagttgtttcaggtttattcctagctgtaatgctttctgtcattactgttctgtgagatgatactggacatgcatcagcacttacacatttaattaaatatattggatgtggtgacagtgctgtttgagatgtaggctacctaagggcttcagatggtcctctggaaagtgccacaaatgagatttaaacaccatttttgggaatttgagaattgattaggttgattcatcaggaaattttcgaggactctaagactcatatttttttatgaatcacagtaaactagactagtctttccataactgtgtaccttgtgtaacattttaaagtcagaaacttttataaagttttgctttttactgaatagtactttatggtgattggagcattcaagcacaatatgatagtttcccatcttaatgaccaaattatataatccaggatgaatagattacttgtttcttgga

SEQ ID NO: 664 - DNA, 1400 bp, mus musculus
ctatctcattcagaagcgatatcatcttacataattttctcttttattatgtgtactaatcataacttaagaggtatctccagactgactaatatagggatagatcaatgtgagaaagtccacaaggaaacaatggtgctttctgatgcttcctttctgaagctagatgcacaatgtgtgtttgagtaatcctggtttaaatctttgtggttgatgtgggttttcttttgtttagtgttttgttcttaggacaaaaatgcctgaatcttcaatggtgctttcttctgggtaatgagtgagacaaccattcaaccagtgagccagataatgaatagatgttgggcttgattacattttaaatgcatattaaccatttaaccccaattggaagtgctactgaaaaagactttgaataagctgaagccttaaaagcaaagcaacagaagataacttctgggtcttgtatcctggatctctcagtgaccagtgcacacaggagagcacatgggcctcagaagcaacagagcttcttggacagggtcccttcaggccttcatcatcagccaagaggcagagctgagaaccagatctctggccaccttccctgccagaggaaagactgcctccagggagggctttgaccctaggactcaggtgagagcaccatcctgtatccgggtctctcagagaccaatccacacaggagagctcacaggccacagaagcaacagaacgtcttggacagggacacttcagaccttcatcttcagcctggagagagagctgcaatccagatctctgtgcaccttccctacaagaggagacctggctgcagagagtgctctgcccactgggactcaggagagagttggactctcaggagtgctgagagaggctaacataatcacaggaggaacaagctcaagtcagagacagctagaacatctaactccagagattaccagatggcaaaaggcaaatataagaatcttactaacagaagtcaagaccactcagcatcatcagtacccagtactcccaacacagtgagtcctggatatccccatacctgaaaagcaagatttggatttaaaatcatatttcttgatgcaggtaaaggattataagaagagcattaataactcacttaaagaaatacaggagaacactactaaacagatagaagtccttaaagtagaaaaacaaaaaatcccttaaagaattaaaggaaatcaaaaccaaacaggagaagaaattgaacaaaacgatccaaaatctaaaatggaagtagaaacaataaagaaagcccaaaggaaacaactctggaaatagaaatcctaggaaagaaatcaggaaccttagatgtgagcatcagcaacagaatacaagagatttaagag

SEQ ID NO: 665 - DNA, 1600 bp, mus musculus
aagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatatgaaaatccatcaatgtaatccactatataaacaaactcaaagacaaaaaccacatgatcatctcgttagatgcagaaaaagcatttgacaagatccaacacccattcatgataaaagttttggaaacatcaggaattcaaggcccatacctaaacataataaaagcaatctacagcaaaccaggagccaacatcaaagtaaatggagagaagctggaagcaatcccactaaaatcaggtactagacaaggctgcccactttctccctaccttttcaacatagtacttgaagtattagccagagcaatttgacaacaaaaggagatcaaggggatacaaattggaaaggaggaagtcaaaatatcactttttgcagatgatatgatagtatatataagtgaccctaaaaattccaccagagaaatcctaaacctgataaacagcttcggtgaagtagctgggtaggtctctcagagcagaagtgatcttacttgtgctcacaggtgtgtcagcactcctaggatatgagctctctcctgctaggaccagaatatggagagctgtggcacagggtcagctccagggtgcagatggagagcaaaagttctatctagatttcataaattgttacttaaaacataagccactgggtcacaaaatatcaaatgcttatgagctctcccaattataaaaagcagacttgggctgcagagatggctcagcggtaaagagcactgacttctcttccgtaggtcctgagttcaaatcccagcaaccatatggtaactcataaccatccataatgagatctgacgtcctcttctgctatatctgaaaacagctacagtgtacttacacataacaataaatctctctctttttttaaagaagcatacttatcttcagagaaaaatgttcagtaactctggtaacaaaaaaaagaagagaggagattcaaattgttaccaaatccacaatctgaagactttttactaatattgccttttcaagacatagttattttgtgtacccaactgtcctataactagctttgtttaccagatttgcttcaatcctgcattaacatagataatctggaaagctagaaaaaccattactgatgatgttaagacaaactgaaaacaataaatagcaggacaccacttgtaacattggtttttttattgttttcggaccattactttggtgcataaagaacttccttttcactaagctattatttatttttacaacttgtgttgaatgtcaaggaaaactatttgatgttatggatagaaaaagcattcatatcattgtaaacactttggaaatgttcaactggttgctgcccttttgtctaagatcaaatgaagagtctgatgatatgagacacaagaaaaaatctagatttgcaatcaccttccttagctcaacctctactaaattt

SEQ ID NO: 666 - DNA, 1000 bp, mus musculus
ctggccatggcattcctctgtattgggcatatgatcttcacaccaccaagggactttcctcccattgatggctgactaggccatcctttgctacatatgcagctagagacatgagctccgggggtactggttagttcatattgttgttcctcctatagggttacagacaccttcagctccttgggtactttctccagctcctttgatacttttttaacatggattgttattacatataaacaactgtagtttttacagtatttattttgagtttatgtgggttaggttgtttttttttttttttataaaagtattctttaatacaaacagtatattttgcttcttatgttttatattttattgtctatctaagcattatgtatgctgagatgtttgtaattttttattttattttttatttcttaatttatttttacagtctaatgtttatccccctcccagtctgccctctgactgttccacatcccatatctcctcaaccacacacacacaccatgtctccagaaggatgttcccaccgctaccccctattccaaccccatcagacctcccctttcccagggcctcaagactcttgagggttgggtgcaccttttctcactgagtcaagacctcgtagtcctctgctgtatatgtggtgggggcccaatatcagttggtgtatgcttcctggttcttggctcagtgtctgagcaatcttgggaattcaggttagttgaaactgctgttcttcctatagggttgtcctccacctcagtttcttccctaattcaaccacaggggccaccagcttctgtccattattttggtgtaaatattttcatctgagacagtcagctgcttgataggcctttctgagagcagtcatgctagacttctctttgcaagcacaccatattatttattatgtcaggcctttgggccatccctggatatttaacatgatcatatagctataagtagtgatacattaatatat

SEQ ID NO: 667 - DNA, 1200 bp, mus musculus
tgtttgtttgtttaacacacatgttttaattccgaaggcattcactctctgacttatgttcaatgtatcattatcagtttatatacttatgtacctcataactttctaaggcttagataatagaagtagcatgagttccttactgcccacacatctgtgggtcccatgagtagttattttcatctagacaaagcagatccagtttatcttggcttagttatatcctgtttccattgcaacattagccattgcactaatggctagggtcagctgttttgtctgtgatgactacccaaatatgcggggaaatgggctatgtacagacaggctggtctccagtcgagctgaggtgtggaactccagtacccggtggtggtaattcccacctacgttggatgtaagatgttcactcatgtcttctggaatcctggctcctgttgaagttaccacccccacagcccccacagaagtgtggcttttagtcacatacacaatgtcccaagcttctgaccgacaggctagactcctcccagttacctagcaacaccgagataacagcacactataagaggggctgtttggccccaccttgctcttctctctctctctctctctctctctctctctctctctctctctctctctctctctctcctctctttccccctgcctttcttcaataaaggtctaaaaccatagactgcctttgttcatcaaggcccactgtgcttggacgatagcataggctttctcctaatgagcttggcctagtttcctgtcagaaggccttcttgggctccagctatgaaccagactaaggactctccgctgtgtgggaacctctctccctctgccctctctccgataactccaaaggggtttgcatcagggccactagtatcaggggctgccccttgtccaactccagaagagtggggtccagtgtctttacacagccagatgcccacataggggtggagtagaaagcctccggtagccctcactcccacgtctgcctgcccagagcacaggaggaactctggatagatgttggctatttccctcccctctccttccattaacaccccccccttccatgccccacacatatacttgctgtttagctggggtttgaatgggccatactggttactgcactatgtgtttctgattacacaacaaggtagctgaagctacttg

SEQ ID NO: 668 - DNA, 1200 bp, mus musculus
ggaatctattatcacaagctatttcacagataatttttgaaaataatagaataaaggccttacaatgatggagaaatgcattctccaatttcagttaaaagataattaaagaaccaaagaatttttattcttctttattcctctgagttatgctcagtgtctagtgaatcattgaactaatttgtgaaaacgggctttaaaagctttataatttgtgcatgtaaacatacacatgcacaccacacatgtaaataaaattcaggtcatagtattttacacacatgttcctaagggtaacttcatgattaaaaaccaaatttcattacacaatgacagaggaatttagacacaatgctttatttttctgctcttcagggttttatacttaaattatcagtaagtcataaaattgattaaaagaaattatttttaatgagagcatttgtttttttagggttttactgatgtaaacagacaccatgaccaaggctactcttatataggacaacatttaagaggggctgattatagattcagagattcagtctattatcatcatggtgggagcatggcagcatccaggcagatgtggggctcaaggagcagaaagttctaagtcttcatccaaaggcagccaggagaagaatggcttgaaggtgtttaggaggagggcctaatggccaatgcacaccgtggcacatttactccaatgagaccacagtaacttcaactagcctacatcctaacactgccaatccctgatccaagcataatcaaaccaccacagtactataatgaattttatcatttttctaaaattggcttccttttttgtaaaatgaaattatttcctttgtcttttctttttttggttgtcattgtttctttaaaagcatgtaatataacttgtgcaaaagggttacccaaaagtataccttttcttatttttctattcttttatttaatatggtcttcttcagatataaatatgagaacactttgaaaaacataaaagagaacaaaatatatgtatttcaacataattacaagtggattatatcagatctttcttcagcaaaccatgtggaactttgtattgaaaaaatatagagaaactgcatataacaaccatgatatatatatatatatatatatatatatatatatatatatatatgtgtgtgtgtgtgtgtgtgtgtg

SEQ ID NO: 669 - DNA, 6000 bp, mus musculus
attcatttacatagaggtcttttattctcttggacttgggtttctgcagggtgataaaatatggatcaccaaattccagtgtattcctgtcctcacatattttccagagatgattcagttttattttgttcagcaacaaactagattagaggaaggacatatttattgttttcggtttttgtttcaattttataaggatttctgattttttttaaagttgtcatttaacacattacaaaatatgcaaacaaaattgaatagtttacagtgggtgggggatatgtaaatgcctaaatacccatgagaagtattacctaaaaaaaaaaccaaaaaacaaaacaaacaaacaaacagacaaaaaaacactctcaaaacaatcctaagaggcaaatggtcataattaaatcagagtatgtgtaacttagaaataacatcgcttgctaattgaacttatatgtctcacacagacctttatatgtgctgttattttcattcctcacaaatcctggttattttggttcattctgtagatgagagcatccgaattggctttcctggtgtcatttctacatagggaaagataagctgcatgtccttcagtgtgcatttctcatttttcacgttttttagtgatttcgtcatttttcaagtcgtcaagtagatgtttctcattttccatgattttcagttttcttgccatattccacgtcctgcactggacatttctaaattttccacctttttcagttttccttgccatatttcacgtcctaaagtgtgtatttctcattttccgtgattttcagttttctcgccatattccaggttcttcagtgtgcatttcacatttttcacgtatcattttccatgtttttcattgtaactcattgatatacactgttctacaaatcccgtttccaacgaatgtgtttttcagtgtaactcactcatctaatacgttctgcagtgtggtttttatcattttcgatgtttttcattgtaactcattgatatacactgttctacaaatcccgtttccaacgaatgtgtttttcattgtaactcactcatctaatatgttctacagtgtggtttttatcattttccatgttttcattgtaagtcattgatatacactattctacaatgccggtttccaacgtatgtgtttttcagtgtaactcggaaaatttagaaatgtccactgtaggacgtggaatatggcaagaaaattgaaaatcatggaaaatgagaaacatcgacttgacgacttgaaaaatgacgaaatcactaaaatacgtgaaaaatgagaaatgcacactgaaggacctgtaatttaactagaaaactgacacatttttattatttgggatgttaaaaagttatcgtatgtgtgtgtgtgtgtgtgtgtgtgtgtgtgtgtgtgtgtgtgtgtgtatgtgtgtgtgcttccttatgaagctgttttgtttccagtttctgtgaagaattgtgttgaatgtcatggggtttgaattaaatctatagattgcatttgactggatggccatttccacaaaaatctctcatcttctgatatgcttttcaatttctttcttcaatgctttacaggtttattatacaagtctttcactgtcttggttagagttatcccaaaatgtccttttttttgaggttctgtatatcctcccttcagaaggcaggagttacttgagaatgctgagctgggaatgccaagatgcaggaaactagctataaagcttccagcaaatttccagaagggcattctgagctggacctggcttgtacaaagccctggggttcaatccccaagaccactaacaaataaaaacagtactgaaatatgcagagctactgagcgaaagtcctatatcctctatcagttcaaacctctcctcatttataatgaaaccactttgcccatctgtgtagaaagctgttgctctgggcttgggatgtggctcaatggcagagtgccatttctaaattttccacctttttcagttttcctcggcacatttgatttcctaaagtgtgtatttctcattttccgtgattttcagttttctccccatattccaggtcttacagtgtgcacttctatttttcacgtttttgagtgatttcatcattttttcaagtcaagtggatgtttctcattttccatgattttcagttttcttgacatattccatgtcctacagtggacatttctaaatttcccacctttttcagttttcctcgtcatatttcacttcctaaagtgtgtatttctcattttccgtgattttcagttttctcgccatattccaggtcttacagtgtgcatttatcatttttcaggtttttcattgatttcatcatttttctagtcgtcaagtggatatttctcattttccatgattttcagttttcttaccatattcctcaaggtttccggggctagagaaagtttgctggtggtagacgaagccgactgcatggtagctgggtctcagttgtttgtggcctccttagtagacagatggacatggtttgaattttttatattaagaaaaggattgggctacaaatagagctcagtcaatagactgcttgcccagcctgtgtgcagccctgggtcaagcatatgcatcccattatcctggcctcgtggctcttcttatagacccagcactgaataggtagaagctgtatattacttttctgttgctccgataaagcatcatgactaaggcaacatacataaggaagagtctcactaggaaacaaaataaaggagattagattcacggacatttttattctttctcctatctttcttcctcttttatctaatgttagggggacaaaggagtaataaatgttggaaagaaaaggggttttataggaatgatacagaaataaaaggaataaagtgcagattattgaatctactcaaactattagagctactactaggcaaaaatgatacattgggatggatctttgtacattgatgtaaaatcgtggttatatattgctacaacatattttgtactttgctgttgaatttagattttcaggtagttttttgggactggatatcatggacctgcagttggggtatgagaaatgcagccaggcaggtgaaacaggggatgttctaaactaagcttttgtattctgagcccttgagttgctgggctatagggaagtgttgagcatcactaaaggaaaatgataaaaactacactgtagaacatattagatgagtgagttaacctgaaaaacaaattcgttggaaacgggatttgtagaagagtgtatatcaatgacttacaatgaaaaacatcgaaaatgataaaaaccacactgcagaacgtattagatgagtgagatacactgaaaaacacattcgttggaaacgggatttgtagaacagtgtatatcaatgagttacaatgagaaacatggaaaatgataaaaaccacactggagaacagattagatgagtgagttacactgaaaaacacattcgttggaaacgggatttgtagaacagtgtatatcaatgaggaaagtaataaggatattgaagtagaaaagttttaaaagtgaagtgaaaagaaagtagagaagaaaaaaagaaaaagaaaaaaaagggaatttagcgttggatcaatgagtaaagtgcttgctccgataacacgaaaacccaagtctagattcccagcacacattgagtcctgggaggctcccccatcccagatctctgggactttctagaggttctcccatgcccccacccccagcagctgtatatatctactcattctcccataacctcattatgtagtccatcttcattctcctctagttttactctttcctaattccaagtaacacttgtcagaaaacagaagtatgccaaatgtagttatagatccagttagctttaactttcaattcattaacccctgttctatctctctctctctctctctctctctctctctcaatgtgcagtactgggagtcttatttgtcactataaaggtaatatgtaccaatataaataacttgaaaaaccttccaagtgtcaacatctaaaggcgattgtgtttccttttgtttttttctaatccataggcttttaatttttttttaatttatgagagttttcatatatactgaaatatggacatatgtgcaatgtactttaatgttcatgctcatagacctttggtagagccagtgtttttaatctgggtgtcttgatgtctttattagcaatatcttttgataaataatttggcccatttattttttgtgcttgtggccttcatatagctttatgaaaccttagtttaaatttatttactgatttatttgagatggggatctcactatatcacccaaactggcctctaactcctgggctcaagcagtcttgtttcagcttcacaaatgaccctcgggccccttttgaacatgtgtctggctatgtcccagttcttcaaatttccctatattcatagaagcctttccccaatctttctgtttctcccctttcccagtttctttcttttattttgatatacactgttctacaatgccggtttccaacgaatgtgtttttcagtgtaactcacacatctaatatgttctacagtgtggtttttatcattttccatgtttctcattgtaactcattgatatacactgttctaaaaaatcccgtttccaacgaatgtgtttttcagtgtaactcactcatctaatatgttctacagtgttgtttttatcattttccatgtttctcattgtaactcattgatatacactgttctacaatgccggtttccaacgtatgtgttttttttgtgtgtgtacctactttggaaagaaaactgaaaatcatggaaaatgagaaacatccacttgacgacttgaaaaatgacgaaatcactaaaatacgtgaaaaatgagaaatgcacactgaaggacctggaatatggagagaaaactgaaaatcacggaaaatgagaaatacacactttaggacgtgaaatatggcgaggaaaactgaaaaaggtggaatatttagaaatgtccactgtaggacgtggaatattgcaagaaaactgaaaatcatggaaaatgagaaacatctacttgacgacttgaaaaatgacgaaatcactaaaaaacgtgaaaaatgtgaaatgcacactgaaggacctggaatatggcgagaaacctgaaaatcacggaaaatgagaaatacacactttaggacgtgaaatatggcgaggaaaactgaaaaaggtggaaaatttagaaatgtccactgtaggacgtggagtatggcaagaaaactgaaaatcaaagaaaactgaaaatcatggaaaatgagaaacatccacttgactacttgaaaaatgacgaaatcactaaaaaacgtgaaaaatgagaaatgcacactgaaggacctggaatatggcgagaaaactgaaaatcacggaaaatgagaaatacacactttaggacgtgaaatatggcgaggaaaactgaaaaaggtggaatatttagaaatgtccactgtaggacgtgaaatatggcaagaaaactgaaaatcatggaaaatgagaaacatccacttgacgacttgaaaaatgacgaaatcatctgtttccaaagtaggtacacacacaaaaaaaattgtatataacttagttacatgttcctgcacatgtttgctgccatgtatcttgtgcaccctgccaccaaaattccccttccaattccagtaacttctcccagtattttctctttcctttcctaacaccctcaatgtggtccctactgttcccagacctggccacagtctacctgagaaatctattttattttggcttccctgggagagtcttgcatctcactgtaagcccaccttgttccttagctctcaaggtctgtgaactgtagcacaattgtc

SEQ ID NO: 670 - DNA, 1400 bp, mus musculus
ctaccttattttaaaataccaaacatatatgaagaaatcttattgaccaaatcactgctaaatcttgcattttatatttaataaattacattttcaatattgaggtgtgatacaattctatggcttagctatgcatttctataaaaattattaatgataacaaccaggtttttgtgttttaggttgtttttttaaaaaaatatttgtaattaatgttttacaattcatattacatttcccacccttcccctcccaccctccaactgttccacatcccgtacttcctccccaccacacccagtttccacatggatgcctccaccctccaccccatctgaactctaaacaccctggcgcctccagtctcttgagggttaggtacatcatctctgaatgaacatagacctgcaagtcctctactgtatgtgtgttgggggcctcctatcagctggtacatgctgtctgtttggtggtccagtgtttgaaagatctctgtggtccatactgctggtccttctataggatcactcctctcaaattctttcagccttccctaattcaacaacaggagtcaactgattctgtccatttattgggtgcaaatatctgcatttgactctttttgcttgttgagtctttcgacgggtggtcatgagagatccctttctgagagagctccatagcctcagcaatagcgtcaggccttgggacctccctttgagctggatcccactttggttatgtcactggaccttcttttcctcaggttcctctccatttccatcactgtaatcctttcagacagaaacaattatgggtcagaaatgtgactgtagaatggcaaccctatccctcacttgatatcctgtcttcctgctggatgtggactccataagttccctctccctactgttgggcattttatcaaaggtccctctcaatgaattcctgaagtctctcacctcccaggtctctggtgtactctgcggggtccccccaacctcctatttcctgaggttgcctgtttatattctttctgctggacctcagggtttcagtccttttccctcatccagtactagatcacctcacacttgtttggtaatcctgaactttgactggaagaccttgaactccttttcagataattcttcactatgtatttgtcttctttcatcaaatgtctatttgggcttattgccatatctatctatctatctatctatctatctatctatctatctatctatctatctatctatttccttggcttgtataaattggttacttattttgcatgctagccagttaatatacacaacttataaaatacaaatcacatttcttaggagttcaatcatttcactcacactttcttctttctcctttttagatgtggg

SEQ ID NO: 671 - DNA, 1000 bp, mus musculus
tagtagtcttctatatgcctttggatcaagatgtagaacttttggctcctccattcccctgtctagatgatgccatgctctctccttgatgataatgtactgaacctgtgaacctgtaagcctcctcatgttgtggatgggcctgatactgaccaatcacctaatgaataaaggagccaatcactggcaggacttccaggttggaaggaggaagagaggtatgaggaaagagttaggtcctttttggaacagggacagagatgggtaaggtgtagctgctagagttccctggtatcaaggcggatccacaagaattcgccaccagaggaatcagattttaataaagcttacaagttcaggttttagttgttgcacccagggattgagttaccgttgcttctgaactgagtttgtgttgcattttccttcacgcagaggctcgtctgggtccaagagagaaaggtactgcagcaaagcgtgggtttgtcatatgtgcttcacaaaggccatgggggatttgaagcatagggttaaagtggtagcaaccagccagtgggaatctagcgagctgggtggagagattgtggagttctgagtcacagtccccacaagataaaaacaggtcgaccattgcccgccagtgcatggccagccaggactctgtggcagaagtacaagctttgcagaaacatgcaggatctcttttaatattttctgcaacagggaataaattaaatgttgttctttataagagttgccttggtcatatctctttacagccatgtaagctcagcatccttagccttcagggaaattcaaatcaaaactactttgagattccatctaactcttgtcagaatgactaaaccaataacactatttatagttcattctgacaaacatgtgttgcaaggggaatacttctccattgctaccgggtatgcaaacttttgctgccactgtggaaaaccacaaggtgattcttagaaagttggaaata

SEQ ID NO: 672 - DNA, 1000 bp, mus musculus
tctttattagagactggaatataacccctccctattttctttttttttcattagatattttcttcatttacattttaaatgctatcccctttcctagtttcctctccaaaagtccactataccctccccctgccctgctccccaacccacccactcctgcttctttgccctggcattcacctgtactggggcatagaatcttcacaagaccaagggctctcctcccactgatgacagactaggccatcttctgctacatatgcaactagagacaaaagctctggggggtactggtcagttcattttgtcattcctcctatagggttgcagacccctttagctccttgggtactttctctagctccttcattgagggccctgtgttccatccaatagacgactgtgagcatccacttctatatttgccatgcactggaatataaccagaagatgttccaacttgtaatgaggacacatgttccttatttataatagccagaagctgcaaagtacccagatgtccctcaacagaggaatggatacagaaaatgtggtacatttacacaatggaatactactcagctattaaaaccatgaatttatgaaattcttaggcaaatggatggatctggggaataacatcctgagtgaggtaatcacaatagaacacacatggtatgcactcaacgataagtggatattagctcagaaacttagaatacccaagatacaatttgcaaagcacatgaaactcaagaagaaggaagaccaaagtgtggatatttaattccttcttaaaatggggaacaaaatacccatggaatgacttacagagacaaagttcatagcagagactgaaggaatgaccatccagagactaccacacttggggacccatcctgtaaacaaccaccaaatccagacactattgcatatgcacacaagattttactgacaggatcctccctattttctgttctgagattttgtctggattgtg

SEQ ID NO: 673 - DNA, 1000 bp, mus musculus
aagtggacattagccaaaaacatcagaatacccactaaacaaaccaaaaaccatagcttaagaaacttaagaagaaggaagatcaaagtgtgtatacttcagtactatttagaacaggaaacaaaaaaaaatcacaggaggtagagaaagggatgcacctgggagggagagaggtgggagaggtaaaaaagggggcaggatgaggtatgggaagagacttgagagaagttcagagagggaaattgaatagaaatatgtttcagtgggggatggagaactaggggtagccactataaagtcccagaagtaagggacgtgaggggattccaggacataaaggagatgacattagccaaagtacccaacaaaggagtgatagaacctgtagagaatacctccactatatagccactgcccccagttgggggatgggacctcacacccatctcaaaaaatttaactcagaattctaaagaaaaggcagggataaaaaatggagcagagactgagaagaaaaggccataaagagactgtcccacctagggattcatcccatcagcaggcaccaagccccaacactattgctgatgcctgacaagaagcacttgctcacaggagcctggtatggctgtcccatgaaaggttctgcctgtaactgactaatacagatgcaggtactcacagccaatcatcaaactgatactggggaccctaagggaaaagctaagagatggactgaaggacctgaaggggattgcaacctcacaagatgaaaaataaccactaatcagaccacccagtgctcccagggactcaatgaccaaacaaagagtcatggagggattcatgactctggctacatatatagaagatacatatgtatcttacatatgtagacatatatgtatcatacatatgtagccttagctgtcatcaatgggaggggagactcttgatactgtggaggcttgatgtcccagcaagcatagtggaatgctag

SEQ ID NO: 674 - DNA, 1200 bp, mus musculus
ttgttcaattccatcaactgtttggttgtgttttcctgtatttctttaaggatttctacccctttagccatgttctcctgtatttctttaagggagttattaaagcccttcttgatgtcctctaccagcgtcatgagatatgattttaaatttgagtcttgcttttcaggagtgctggagtatccaggagtgctgggttctgatgatggtgagtggtattgatttctgttagcaagattcttacgtttgccttttgccatctggtaatctctagagttagttgttatagttgtctctggttggagcttgttcctcctgtgattctgttagcctctgtcagcagacctgggaggagtctagctctctcctgaatcagtggtcagactactctatgcaagcaagctctcctcttgcagggaaggtgcacagatatctggcattcggatttgactcctggctgaagatgaaggccctaaacaggtctcgtcccagaagatgtgttgcctctgcagtctgcatgctcacctgcacagactggtctctgagggacctggtacacaagatgcctctctcacctgctctagttgtctgatccctcctgtatagacacctctcctctggcagggaagctgcccggatatctggagcccaaaatgcctgtcccagaagctgtttcgcttctgtatttcacactctcccctgcctagactagtctctaagggacctgggacccaagatggctccctcacctgctctgaaagagccctccagggcagacacctctcctctggagaggaaagtgcctgaatgtctggaacttgaaatggggtgtgtcccagcagttatgttgcttctttagtccacttgctcaccctttgcagtctgtgagctgacctgtgcagactggtttcttagggacccaggacccaagatggctcccttacctgccatatgtgaagttttattgattactcaagaaaaattgtttacatttgaatcttcccagctttttaatgatttttaaaaaaattttaatttatttttattttggttattttgagacagggattctctgtgtagccctagctgtcctggagctcactctgcagaccaggctgcacttgaacttagaaatctgcctgtctctgcctcccaagtgctgggattaaaggcattcgccacctctgtccgccttctttt

SEQ ID NO: 675 - DNA, 1200 bp, mus musculus
aacattggtaaactactcttagttaattaaaaattccattaatacctcatctcctttttaatccaaatatattttcccttccccctctaggtgttagtcctactttctacctttagttcccatgtcttcttagttttcattggtctttgatagtttctcagtttttgagttttaaatatacacttttaatttattagagttacataattttctccacaccgcccctggcccccaagccccgtctcttcccatttccagcctccctttcaggtatacccagttcatccatggctgctggtcagctacatagttttaataaatatatgttgggtttcccatttaaccactgtgctgctaagcaatgctaaatattttcagtgtgagaaacaacttacagagaaaggctgaaacaactgtatttaaatgccatgattaaacattttctttttcattttatttaatttttttacagtgcagagtgttttttaatttttttattagatattttctttatttacattttaaatgttatcccctttcttagtttcccctccgaaaatcccctattctctcccctctctccctgcagattttataccctttccagactaccctctgactatttcacatcccatacctcccacatcctcccccccaaccctgtctccacaaggatgtccccacgcctaacctgcaccttacatgacctccccacaccctggggcctcctgtctcttgagagttaggttcatcttctctgtctgagtccagacccggcagtcctccgttatatgtgtgtcaggggccttatatcagctgatgtatgctgattggttggtggcccagggtctgagatatatcgggggtccaggttatttgatactgctgtgtcaacttgacatatgctaaaggcatttgaggaaaagcaattccaattaaaaacatggctccataacaccaggctgcaggtaaacctgtagaatatttcttaataagcgattgatagatgagggactaccccattttgagtagttatgggttctattagatgagcagcactcttccatcgtctctgcacctcctgccaccatgttccagcactgtttgagttcttcttttgactttaatgttgaactgtcatgtggaactgtatgccaaataaacacttttgtccccaacttgctttgggttatgatgttt

SEQ ID NO: 676 - DNA, 1000 bp, mus musculus
agccaacttccacatggaaactgaataacactcttctcaatgataccatggagaaggatggaataaagaaagaaattaaagactttttagagtttaatgaaaatgaagccaaacatacccaaacctatgggacacaatgaaagcatttcttttttttttaagatttatttatttatttatttatttatttattttttatgtaagtacactgtagctgtcttcagacacaccagaagagggagtcagatttcattacaaatggttgtgagccaacatatggttgctgggatttgaactctggaccttcagaagagcagtcaggtgctcttacacaatgagccatctcaccagcccgaaagcatttctaagagggaaactcagagctctgagtgcctccaagaaggaactggagagagcacacactagcagcttgacaacacatctaaaagctctagaaaaaaaaggaagaaaattcacccaagaggagtagagggcaggaaataatcaaactcaggggtgaaatcaaccaagtggaaacaagaagaactattcaaagaattaaccaaacgaggagttggttctttgagaaaatcaacaagatagataaacccttagctagactcactagagggcacagggacaaaatcctaattaacaaaatcaaaaatgaaaagggagacataacaacagatcctgaagaaatccaaaacaccatcagatccttctacaaaagtttatactcaacaaaactggaaaacctggatgaaatggacaaatttctggacagataccaggtaccaaagttaaatcaggatcaagttaacgatcttaacagtcacatatcacctaaagaaatagaagcagttattaatagtctcccagccaaaaaaagcccaggaccaggcgggcttagtgcagagttctataagaccttcaaaaaagatctaattccagttctgcacaaactatttcacaaaataaaggtagaaggtactctacc

SEQ ID NO: 677 - DNA, 1000 bp, mus musculus
acccaccacgccctcaactctggcatgttctctaaatagatgttgggctgcttccagctgagcttggttagcagagagtcagtcccactaggtgggaagggtagtatggggagacatagacacaaaacacattattgcatgaaaatattcttaagcaattgagtaccatttgcaatgagtaatcactaaacaaattgaggcagggagagtaaaggtctagaaagaactattttagtcactacacaagcctcttgctgaccccaccttaattctacagagctacttctccaacctgtggaaaaagttgcaggtgaaaactcagagagttataagaatgtatgaagtaattctttgaaaaatggagtattagaaatagaaaaataatagaacaaagaaatatctccaattagtgaggttgtgaggtgtgaaaatttatacagatgggaaattctatttattcgtgagcattctataattgtgaagtgccacgaattcactttctttattgacttcagtgtacttaatcatgactgtgttgtgatgtgtaaccaaatacactttagagctatgggtatatttgccaactcaaggaaaagagatgaatttgcctgattgacattctcctgtggagttaaaggatgtgtttcttgccaagttgctttatctattgaaatgcctgaggaataaattaatgctggccacagatgagtctgttataattatactgtaccacttatgatgcataccatacctcaaagaactatgattactttatagtaataatataggccagcaagaatgctcagtcagtaaatgggcttgctagacaagcctactaatgtgtttgatccctgtaaccagtggtagaaggaaaacaattcctgagagttgatctatgtgccttagtgcaccgcaaccaagcacaaacacaaacacacacacacacacacacacacgcacatgcacacgcacacgcacatgcacatgcacatgtgtgtac

SEQ ID NO: 678 - DNA, 1400 bp, mus musculus
tttatagcatgtaatataaatatactaataaatatacacaatatagaaatacatattaaattaagtttaaatatatatgtataaatatataattatataatatttataggtttatatgacaatataaatatatatttaaactttattgtagagagacacattgatatatatatatgtatatatatatatatgtgtgtatgtatgtgtgtatgtgtatcacacatacacacatacatacacacacatacacacacatgtgcactcttcagggtggggatttttatcccactcctcctatcccataggaaactccttgaaagctattttttccaaccagaacgagtcatctgtctggtgagtctggaaaacatctctgagcatgctgtcatgggcttgttctctttgctgaggattttgtgggctagtgatttggtcaggacttagttggtgtcatctgtctctgtggtgttagctcagttcaaccgtgtgtttgcggtcagtggattgtcaatcgggtgtaggttgattctgcgagatggcactcataggtccagcagtcacccaggtttcagctgaggcactgtgatatctctcctcgtgcctttcccactggagtaacagtttaaacttcctcacttggtggatgggttccagaggaaggatgcagtggacccttgactcagccttgccgcagaagttgaataacactatttgtccaggcgagtcacaaggcaacagtggtaaagaactgggaaatatattccttgatgtgagcatgagtaggtccccacaacaggggtgggaagaatccacagctaatgttttcaagctctggcctcaatggtacagattagtttccagtcacagaagaacgctaccagggccttggtctcattcctgggtgcatttcccccattgttttataccttagaggagagaaagccataaataatgaaaacctcacaaattgggcaatgacttgaaggagttagggaaataagcaagaacaccaggccaggggattattctgaaagcaacgtcacagtctctaccacaagagaaggagctagatgcacactagaaatgttcccactatccttgtggaccaactctacagagcctagctactaactagaatgctggaaaagtgccgatggatcctgggaagcacttattgcttttgcattcatattctgcttctgtcttcctctactattgccgattcttgcacagctctctggagatggtgatgggatgtggcactaaggtggcatctgagcattcagatattgcagttccttctagatcatcttttccacaggcagtcaaaggaggatgcagaacacagacacatgcatggacacgctttgagtattgctgatacagttgatggtggggca

SEQ ID NO: 679 - DNA, 1000 bp, mus musculus
acgacaggcaggctggaaggatggagcttgatgggaagatcaagctgctgatgagaaaaagagatctctgtcctagggagaaggggacatggcaggggagaagggggagtggccgggacagcaggaagggcaaaccacttataatagtccagatggaggttaggatgcaaacctgaagccagaaactggctgagccccatcaggagtgaaacttcttgagcagctgggtagagcttgtctgcatctacactgtcagacctgcgttagaagatagtccagtcatgttggctttcagaccaaggctctgctcagagcttccctggcttttccagcatctttacctctcatattccacagggtattggctcctggatcctcctcccaagactgaaaatgccctgtactcgttacatttgaatgcagcctatgtctgcatatcctttcctatagttgaacttattcctagaatatttgtaaagtccactcctaactaagtgctatataaatcattctgatagtgtattgcttaggacacaattattattattattatttttaaaaactgacctatatatgttcagcacagattccacccagccaatagtattcagtgtggatttggttgaatggaaatatgaagaacccaatgacactgagcacccgtggtggtccctccagtcacttcttcctcaacagcccaatggcttccaagctcatccccacaagtttcagcccatgccctttcatttctccatgactcacctctgacctgctcttgacctcctcctcctcctcttcctcctgtgacttcttggctggtgagccaagacttctgtctggctttgacccagcactgacacaatcccagagttcagcagggcagaggcagggcatcaccttggcctggaatacagctgaggtattttggctgtgtaaagacttgtaagaaaagtgattcctattcatccttctggagtgttgtctccttagttctcacttg

SEQ ID NO: 680 - DNA, 1000 bp, mus musculus
cttgcttagcttttcttttctttttgccagtaatttatttagataattttcatctagatcccagccccatctccatcctctcttcctagtcccacttttacaaatccctcctctcactacgcccttccctattgttcagagaaaaggatgccttccttgggcagcacctgatccttgaacaccaaatctcagcaggactaagctcctcctctcccactgaggccacatgagtcaaaccagcaagaggaaggagatacaaaggcaggcaacttagtcacagcctgatacaaatcctactccaacttttgggagatccacatgaaaaccaagctgttcatgtgctacatatgtgtagaggacctacgtgaatgctctttggttgatggttcagtccctctgagcccccatgggcctaggttggctctgtaggtcattttatgttgtctgttactcctccaactctctcgatccttctcccgacactcccatatacaccatgaactttgtctaatgtttggctgtgggtttcttcatgtttctatcagctgtttaatgaaacctctcagatgacagttgtgctaggctcctttcagaaagcagagcagagtatcgttaataacgtcacaggaacatcttggaggcaaggaacttttggggtcaaagggtttgggttactgtctttatcccttcaccagaagtcctgcctggccacagaaggtggccatttgaggacccatatcctccactgctaggagtcttagctaaggtcatccctatatcctcccagatgcctccagagatctgcatcttgtcccagagttgctcccccccacacacacacagattttctttatctctcccagctctctcaacccctacctctgctctccacatagctaactgccaccccagttcctctcaatactatctctgccacccagttccatctctccatccacttctaatgtctattttatttccccttctgaatcatcctttc

SEQ ID NO: 681 - DNA, 1200 bp, mus musculus
acaagtaatgtcttaataacattgaataaatgtgtgattcattccttttgacatagtttcctggtctgaaatgaggagtggatttagatttaggacattgttctggttccttgtgggcttttactcttttagtaacaaatcctttgtacctgcagccaagaaggttgacaatgatatgcaaagagacattaactaaacctctttatgcttattaatttgtgaatgaggttgatgaaaactaacaaggcagaaaatgattgcaaatgtaaatgccaatgtgtttaatgatccaaggaagcaagttcaattggagcttgtcagatgaaaattgttttgccagttgacctgtccataaatacaaatagactgtggaagactggacaaacacttgcattcaccacggaatgacttaattaaatgaatagaaatcttgaataacgaatctttaaagtgatgaaaattatctgctcaactgctagtctacaaagcaattgtggagtcattataaacacaatatttcaaaagtctactaattctgtgtttcccagcaaaatgataaagaagcttagcgtgacaggccatggaactagttctcttaacaccctgttcgtgccgggcgtggtggcgcacgcccttaaacccagcactcgggaggcagaggccagcctgagttcaagaccagcctggtctataaagtgagttccaggacagccagggctacacagagaaaccctgtctcaaaaaacaaacaagcaaaaaaacaaaaacaacaaaaaaacaaaaacaaaataaaaccaaaccaaacaaaataaaacaccctgttcctacaactcccgaattattgatattatatttttatgtctttctggagccttcaatatattgctggtgtaacagatgaattagaacatcattcctcagttatatgttatctactgagtcatgaatgccattcattcactggctaaatattgaaagtattggagttatacagttagaagaaagtgattcttaaattcagttctatttagttttaggaatataatcttataggtctaaaaattggcatagtgaaaaaatatattttgagattccagaaatgaattttttaatgtagaaccgtacttaattcattccgactgtaagataaattccatagaatatttaaacttttcattaaaaatgtagagattaaaaaga

SEQ ID NO: 682 - DNA, 1200 bp, mus musculus
gttcattgatggggtagatgttgggataagtcacttcaaagtcctggatctgggtctgagaagtatctaagcttgtcagtcagtccactggccagctctcttgctttcatacctttggagcaggctcacctacaatatccacaaccagggcctagtctactctgctgcccaggtaaaggacatgacccactctcctgagtattgaactagtgagagacagtcagtttcctacttcatgtaccaggggcaagctcttttgcctgccagagatgatgaaggagggaagaagtcccatctatgccactacacagcagataagtgtcagggttggctcacccacagtccccatgtctagggttagctctacttgctgcccagatgaggtatatggagagttctgctgatctcatgaccccagggccataagtgacagagagtgagggtgtgagaaaacatctctccttcacattgcactaccctgtggcacacaagttctcccaagctcataccctagaggctagctcacatgctctcctaccatcagggtcagctctactgtgctgcctagatgaggtgtagggcctgatttcctgagtgctgaagcaggtgagaaacagggattgctctcttgctgtcatgcctctactggggccagctcctgagaaaaagagagagggagtcttttcatcatcaaggccaccatacagcatacaagagtcgggttgggtctctcacattcatcccatcaggagaagcagtcctgtatccccaccactagggccagctctagtatgctgcctatgtagggtacagagccttctttcacaaagtttcctcagggttgacttacctaaggctctcttaagtactacagttggctatgagtggtacccatatatatgggtggctctgttctcaggaccccaggaccagttctcccatgatgcataagtgagaggtgggaccagtgctacatggctcttattcatcaacatgttttctgggcagaagactaaatcaagcctggcctttggtgtgacaaacccctgctgatgcaaggccatggacccagacataatcccctgatgcaagcataggctgagaccccagcattgtccctgctgtcatcattggctactctcatcaggttgttcctcactaccctcaagtctcagaaagttggcaataaaataattataa

SEQ ID NO: 683 - DNA, 1200 bp, mus musculus
gcaagtgaaagatctgtatgatgagaatttcaagtctccaaagaaagaaacagaagaagatatcagaagatagaaagatttcccatgcttaaggataggtaggattaacatagtgaaaatggccatcttgccaaaagcaatctattgattaatgcagttccatcaaaattccaatgtgatcttttacagaccttgaaatagtaattctcaaattcataaggagaaagaaaaaaaaaactaggataaacaaaacaatttttgaacactaaaagaacctctggaggaattatcatctctgacctcaaactctactatagatcaatagggataaaaactgcatggtatggaaacagacaggttgatcattggaatcaaattgaagacccagacattaacccacacttagggacacttgatttttgataaagaagccaaaaccataaattaaaaaaaaaaaaaagaagtatcccatcctgtgggattcagttattggtgggtgcgagggggactgcaaatctggcagaaaatgggatcggaaggggaagaaaagccgaagaccaagaccatttattaggctgagacgcctggttttaaagcatacatcaagaggaatgggtggtggggtcgaggggcaattaacaaagagcaaagaagtaggcatctgctgacatgagggccaaagtcaggctccaggcggcgggcactctgttccttatctctggaacagacttgtcccttcttaacagacttggggtgtcaggccgggggctcaagcataactcatgtccttggaagtcatgggagtcaggaagagataaggaagaggggatcataattcagctttcacagcctcaggtgccaggaagggaacagggaggagggagtgacaactggctcctagcatgaggccatttggcctgtcagggtgggagattgtaaagggctcagtttctcaaggtatggtctctgacaaagaaggcatcttcaataaataatgctggtctaactggatgtctgcatgtaggaaaatgcaaatagatctatgtttatcaccctgcacaaaactcaagttcaaatgattcaaggacctcaacataagacccaatatactaaacttaatagaagagataataggaatagccttgaacacattggtacaggagaaaattttctgaacagaacatcaagaacctagctcct

SEQ ID NO: 684 - DNA, 1600 bp, mus musculus
ttctcccttactgcttttaatattctatctttatttagtgcattttttgttctgattattatgtgtcgggaggaatttcttttctggtataatctgtttggagttctgtaggcttcttgtatgatcatgggcatctctttctttatgtttgggaagttttcttctattattttgttgaagatatttgctggccctttaagttgaaaatcttcattctcatcaactcctattatccttaggtttggtcttctcattgtgtcctggatttcctggatgttttgagttaggatccttttgcattttttattttctttgattgttgtgccgatgttctctatggaatcttctgcacctgagattctctcttccacgtttgcctttcgccatctgttaatctctgaagctagctgttatagttgtctctggttagagcttgttcctcaggtgactctgttagcctctataagcagacctgggaggctagctctctccttagtttcagtggtcagagtattctctgcaggcaagctctcttcttgcagggaaggtgcccagatatctggtgttcgaacctgcctcctggcagaagttgtgttccactcaccagaggtcttaggatcccgtggggaatcctgtgtggacccttacgggtgtagggagattccgctggcaaggtaccccgttgctagagtggaccggaagggacttgtgccccaggtcaggctgggtcttctgcttccctagttaatgcagtctcaggttccgcacgattggattggggcagatgctgtgttccactcaccagaggtcttaggatcccgtggagaatcctgtgtgggtccttgtgggtgttggaagactccgctggcaaggcaccccggtgctcgagtggaccggtagggacttgtgccctttattgtctttttaatcatttttatcagctggttatattgtgccaaattgttttaaatgtggatattgtcaatccttcttgagcagagtaattaattaattatccatggaatgtgttcaaaagatgttcattttcttcagttactcggtgataaagaattatgattacacatgaaatgaaaatttttgaggaagtcatggtacccaaaatttttcacagactacagaatagaaaatttccttgggatcatgatttagattcgtgcatacatttttgatcattcacaaatttgttcggtaaagtggtgaagtgctaatgatcattgttttctggatagaggactgaaagaggaatcatgacttgtatgataaagtcatcattccacagcttgattagctctgtgattttagaaacagcatctctaaatttgatacctaatgagcatcagctgagagcaataaaaaaggaaagctgacagaaaaataattgtacattggctggaaaaatataaccaagagacagtatatttaatagtcctattactgttacaaagtagctgtgtgaattcaggtcagccacttaattttcagattctccaattcttccaaacgtgaagaactagttaacatttagcagacatgaacataattataaagacttaagactgaatacttttaatcacacatc

SEQ ID NO: 685 - DNA, 1400 bp, mus musculus
agaatatctcaggtcagtacacactactagagccatgtatgagctcccagtgttttcattgatatcatggaataagtttgtattcactttatttatttatttatttatttatttatttaatattttttattacatattttcctcaattacatttccaatgctatctcaagaagaatgaagactgaagtgtggacactaggcccctccttagaattgggaacaaaacacccatggaaggagttacagagactttattcatttataagtgagaagataacctcaactagttagcatgcctctcttctgttttccctcttctattccatccttttggggttaacaatttgcttgaaataccaatttaatctaattagtctaatctaatatagcttttaggacaacatatctgatttacaaaaatcaaatctaaataatgcttaaaataatgccctaagcaaaagagaatgaaacactcagtgtgtgcatatgggagagatgaggttagctacatgatgaaacttcacagtccttctcaaaattattaaaaataaaaccactctggcaacagcagagcataaaggcaagcccagatccccaggagacggcacaggtggcgtgcccataaagttggctttgctgtgggacacagatgattggccaatgaaacaacagtattcatagaaaaccaaactagtatgtactaaaataaatctgtctggacagtaaaattatagttctttccaaaattcaaaaatataacatttctcttttctcttatgggttagacttacatattaattgataggaaggaaaattgctcagaaatccatactaaaattttgacagaaaatttttcataaagctggaaaatagcattagactgttcttttttgggtctgtctatcttttggagatatggctttgtgattaaattataacaaaacaagcagaatttaaaggacatgcaagattatgcaattacttttgtagctgatgaaatgtaaatgactaaaatttacaaagtaattacaaggcaattatggagaaaaaggctgttttgttcactcttatttcagctcctatggaaataagttagtgtgttaaactattaacttaggggaagttaatcaccatcttttaaagctaaaattagaaatatgaatatcttgccaaaaagaggatatatatatatatatatacatatatatatatatatataattttacaaaccaatatctagtaacatccacttacatggcaaagagggagacatgactgcaatattaacactcagataagtagattttgttaattttgggatagcttttatttattttaatcctgtgtgtgtgtgtgtgtgtgtgtgtgtgtgtgtgtgtgtgtgtgtgaatgcttgcttg

SEQ ID NO: 686 - DNA, 1200 bp, mus musculus
taacattttatgaactgaatatatacatgtgtaattagatgctctataatgtattcccaaatgatagggcatattggacctggttttgtttaggggttttcatagtcttttgaatccaattaatatacttatacttgacaagcagttctgtcatatttgtatgaaatcctagagaaatgttcatctttcttgtatggcaaataaatcgttataaatatatattgaactttccttctcagatattgattcccaatcatgcatctagtctggtagccatgttgtaacatcttctaaactttttaaaggtttttataattttatttttcaattactttatttacattccaaatgttacccacttttccagtctctattcccagagtttttcaccccatatctcctgtggagatgatgctcccccaccctcaaccccctacctcacccctcccagcatccaccttccctgaggcatcaattctctacaggattagaggcatcctctcccactgaagctagatcatgcagtcatctgctatatatgtgcctagagtcacagaccaactcatgtatgctctttggttgtggctcagtctctgagagccctgagggttctgggttagttaatactgctggtctttctatggagttgccatccccttcagttccttcagttattcccctaactcttctacaggggtccctgacctcagtccaatggttggctgtgagtatctgcatctgtctcagactgctgctggtagaacctctcagaggacagcaatgctgaactcctgtctgcaaacacaacattgtatcagtaatagtgtcagggtttggtccctgtccatggcatgaataccaatttgagcctgtcactggatggcttttccttcaggctctgctccatttttgtccctgcatttcttttaaacaggaaccattctgggccaaaatttttggaggtgggttggtgaccccatccctccactggggggccatgtctacctactgaaggtattcttttcaaaatccatctccccactgttgggcatttcagcttaggtcaaacatttttaaacttcaatggatgacttcaaattgatggtgggacaaggagtggaaaaaagcgattggtgatattgatttaaatgtgtcagtacgcttctaggaagtttttttctattgcctttctccaagttc

SEQ ID NO: 687 - DNA, 1200 bp, mus musculus
ctcattattctttgtttgtggtaggaaacttaccttgttgattcatggtaaatcagcctgtttaacagttgtgccagtggttctctaggcacctatgggtgtcacgaaattggaagtgatgcttagtcctcatgatgacagccaagaaacatgtttcctccaccaacacagtctcaccaagaagctatccttctggaatagcattcttggaaatccttatggacaaaacacactatagtggctagttttatgtcaacttgacacaagctagagttatcagaaaggagccacagttgagaaaatttttccatgagattgggatctgtgcaagctcatagggaatcttcttaattggtggttgatggggaagggcccaatccattatgagtggtgccatccctaggctggtggtcctaggttctagaagaaagcagacgtagtaagccaggaagcagcactcctctgtggcctctgtgtcagctcctgcatacaagtccctgctttgcttgtattcctcttctaactttctttgatgatgaaatatgatgtggaagcataagcagaataaaccctttcctctccaagttgctttggtcgtagtacttcatcgtagcaatagtaactctaacaaagacacgtggctactgatttttgtaagtagatttttcgatttggggagaccccttatgtataatacatagtttgtgaatagggatgatttgatttctttttttttcatatttgtacctttttaatatcctttacagttgggtagaacaactgattgctcctctcctttggcagcttgcatggcaccttctgataatgaaaactcaaggaggtagctttcagactagaccaaactctgtttctccaagttctcttagaattgcaaggtgtctttacaaataaggtcttaccttcaagttctgggcagcaaagaagagctatagcaattgcctgtattgttttaggagtctcttggacttctctgatcataaaatgtcaagggacgtttcctatgcctgctacagggctttctgctagtctctggctcttgtggggagcattgtcagcctacgcttaactttatttcaatcacttatgtatgtacccacatacactcatataatatgtattttaaataaacataaaataatgtttccctatgactttttcaattgtctgtggaattcctta

SEQ ID NO: 688 - DNA, 1000 bp, mus musculus
ggtttcccctctgaaaaccccccttcccttccccctctcctgctcaccaaccctcccactcctgctacctggccctggcattcccctacactggggcatagaaccttcacaggaccaagggcctctcctcccattgatgaccgactaggccatcctctgctacatatggagctggagtcaagagtcccaccatgtgtactctggttggtagtttagtcccagggagctctggggttactggttagttcatattgttgttcctcctatggggctgtaacccccacttagctccttgggttctttctctagctccttcattggggacgctgtgcttagtccaatggatggctgtaagcatccacttctgtatttgtcaggcactggcagagcctctcaggagacagctttatcaggctcctgtcagcaagcactcattggcatccacaatagtgtctgagtttggtgattttatatgggatggatcctcaggtggggcagtgtctggatggttattccttccgtctctgctccacactttatctctgtaactccttccatgggtattttgttcctgcttctaagaaggatggaagtatccacactttggttttccttcttcttgagtttcatgtggtttgtgaattgtattttgggtattccaagcttctgggctaatcaagttttctttcttttgaggcaggtacatagtgctgtaagcttttctcttagaatagcttcctttatgtctcacctttgcattttaattcaattctagggttttcttccttaattccaacattggctcaattttcatccagtgtgtattgtttagtttccatgagttttctattgttatcgctattcacctgtatttctttatgagtcagatagaatgctaaatgtatttcagttctcctgtatttgctgacacttgcttaatgcccaaatagggggttgattttgaagaaagttccattggctgctgagaaaaaaatgtatt

SEQ ID NO: 689 - DNA, 1000 bp, mus musculus
tcaattcttatactttgtctttaaacctttatgttctttatttaacttgctccattcttttggctctccattacatttttattttacttattgagttttttcaagttttatttttgtttggcttttcttagtttgccaccttcattcttgaactaatacatctattctttgagtttcttgaagaaatatatacttgttctttagaaataattgctttgtacatcaaaagttgcttttctagggaactattaaaatgaggatactagtttctggaggagagagattgtcttactgatttatgttgtgtttttatgatcagacgatgcatctggaattaggctcttggtaatgtttcatggtactgctgtagtagatgtagtgtagttctttgttggctggtaccccaacttgtgaggttataagacagcaattggtgcttgtgcaactctgtcttgatgtgggcatggggtgtcagaagtagtccccggtcacttaggaaaagatacagcgtctgaactcaggaactaaacttctgaagtgttagaagattatgatgatttaagaagatctaaggtgttgatcttcagacatctatgaatgttcactagattctttggaggtccttaagtggcagggtcttgggtaacaccacgcatgggcaatgctccctgaaggtaggatgtagattgccacagtgacctggactgggcatagaatgcaatgcagtccaggacatcttggtgggtgaggtggcagatcgtttcttgggctccctgcttgggaggaagcgattcttagggaggatggtaagttgggtgactggcaggttttggagattctgacttagggttggagttagaggatgccatacccctctttagtctttaactattctttttttgtgtatttttggcatcttgagtataagatgctatggagaagctcttttgtctatttggacttttaaatgccccctgtgctttcatgtccatttctttct

SEQ ID NO: 690 - DNA, 1200 bp, mus musculus
atagctgagtagtactccattgtgtaaatgtaccatattttttggtatccattcctctgttgaggggcacctgggttctttccagcttctggttattataaataaggctgctatgaacatagtggagcatgtgtccttcttactggttggaacatcttctggatatatgcccaggagaggtattgctggatcctccggtagtactatgtccaattttctgaggaaccgccagactgatttccagagtggttgtacaagcttgcaattccacatcctcaccagcatctgctgtcacctgaatttttgatcttagctttttctgattggtgttaggtggaatctcagggttgttttgatttgcatttccctgatgattaaagatgctgaacatttttttcaggtgcttctcagacattcggtattcctcaggtgagaattctttgtttagctctgaactccattttttaatggggttaattgattttctggactccaccttctttagttccttatatatttggatattagtcccctatctgatttaggatcggtaaagatcctttcccaatctgttggtggcctttttgtcttattgacagttttttttttttaattattacatattttcctcaatgacttttccaatgctatcccaaaagtccctcataccctcccccccacttccctaccctcccattctcatttttttggccctggtgttcccctataatggggcatataaagtttgtgtgtccgatgggcctctctttccagtgatggccgactaggccatcttttgatacatattagctagagtcaagagctccagggtactggttagttcataatgttgttgcacctacagggttgcagatctctttaggtccttggatactttctctagctcctccattgggggccctgtgagccatccaaaagctgactgtgagcatccacttatgtgtttgctaggctcctgcctagtctcacaagagacagctatatctgggtcctttcagcaaaatcttgctagtgtatgcagtggtgtcagcgtttggaagctgattatggggtagatccctagataaggcagtttctaaatggtccatccttttgtcgcagctccaaactttgtctctgtaactccttccatgggtgttttgttcagaattctaagaaggggcacagtgtccacacttt

SEQ ID NO: 691 - DNA, 1000 bp, mus musculus
ctcctctcaaagcttgagaaccttatggaagaggagggaaaagatagtaagcccgagggcatagaggacaccaagaaatcaaggccctatatatcaacatgaccagtggtcatatggacctctagggtctgcaaatgtcccctgtgtatatttaatggcttccagtttagtgtttaatgagactcatgagtgtcaaacaagtaggttcctgattatcattgtgcctcatcttgggcatctttccttctcttcgttttgtccagttccaatttgttagtttttgttttacattttattttgtcattgtttgaaacaaactaaccagacaaacaaacccaggaaataacaagaaatgtgtctctgaatcacaggatctggaagtttcacaatgtgcacagattaaagacctctggaatgaagtttatttcagaactttggcactcttaaaatgtgtatttatttatttatttatttatttatttatttatttatttataattttcgagacagggtttctctgtgtagccctggctgtcctggaactcactttgtagaccaggctggcttctaactcagaaatctgcctgcttctgtctcccaagtgctgggattaaaggcctgtgccaccaccgcccagcttaaaatgtgtttttaaagccaagctgtgacgaaaggatggaccatctagagactgccatatccggggatccatcccataatcagcttccaaatgctgacaccattgcatacactagcaagattttgctgaaaggacccagatagagctgtctcttgtgaggctatgccggggcctagcaaacacagaagtggatgctcacagtcagctattgaatggatcacagggcccccaatggaggagctagagaaagtacccaaggagctaaagggatctgcaaccctataggtggaacaacaatatgaactaaccagtaccccggagctcgtgtctctagatgcatatgtagcagaagatggccta

SEQ ID NO: 692 - DNA, 1000 bp, mus musculus; identical to SEQ ID NO: 691

SEQ ID NO: 693 - DNA, 1000 bp, mus musculus; identical to SEQ ID NO: 691

SEQ ID NO: 694 - DNA, 1000 bp, mus musculus
tgtgttgtttaaaactttcacaaatcactgcttttctaagtctttgttcaataatgctgagaccaaacaataattcctgaactgcaaggctagggaaatgtttactctttggctatgactgcaaagtgatggaaatagctctcattaaatctcaaagctagctaatcaagactggctgaagatgctgaggaggcggatcaacgtacaaaaacgcttgctgagcaaccctcaggaactgactgtggatcttcagaattcatgtacaagccagacacaaaaatgcattcctcagtgacccccacatgcctcagtgtggagatggaaggaggagactggagagtttcctaactttctggccagtgcagcagcaaagacaaagaaagtctttttcaaacaaggtggaaacagcaggactgaagtttgtccttcaacttgctcactggagcactcatgtgtgttccttacacctactcacaaagcagtttgaaggatctcatgttgctgttgttattatctgaagctatttttataaactggcagatattcagctagatatcttccttccaggattcatcttaaaatatcttaaccagcttcactgagcagcttgctgtccccacctccacacccaccccaaggctccattgtccagctgccctgagttacatgctgtgccacctcctccattgtctgttcaccactccaccagccatcactagacttgttgcattagcaacatccaaattacatcacttcataccacaatcccttgccaaccaagtcccctgcagcatacccagctgccctcaaacatgctatgcccccccccccgaatattattgtccagctcaaggctgcctgcctaaagccttctgcactagaaacatgcaggttagtcctgccttcttgagacatgctataccaggaacatccaggaacaaccagaaggctaaaggccagaataaaaacataataagagccagggccataaggcacctgc

SEQ ID NO: 695 - DNA, 1000 bp, mus musculus; identical to SEQ ID NO: 694

SEQ ID NO: 696 - DNA, 1000 bp, mus musculus
tgatagctaaaatgatccttaaacattcctaatcttatgatatactatgaagctttagtaataaaaataacatggttgtctgccctgcctgggagggctttgccagagcacctgggggagccatctttggtcctggatctctcagagactaatctgcgcaggtgagagtgcagactacagaagctacacagcccctgggacaggctcaattgacacagcttctgggacaggccctgttttgggccttcatcttctgccaggaggagggtccaaatgccagatatctgtgtgccttccctgagggaggggagcttgcctgcagagagtgctctgaccactgggactcaggagagagctagtcttccaggtctctggatagaggataagagaatcacgggaggaacaagctccaaccagagaaactataacaactaactccagagattaccagatatcgaaaggcaaacttaagaatcttactaacagaaacaaagaccactcaccatcatcagaacccagcactcccacctcagccagttctggataccccaacacacccaaaaagctagacccagatttaaaagcatatctcatgatgatagtagaggacatcaagaaggactttaatgactcactgaaagaaatactggggaacactgttaaagagatagaagtctttaaagaaaaatgggggaaacctgagactgcggtaaatagggaagcagactacccgggcctgacctggggcacaagccccttccgctccactcgagccccggggtaccttgccagcggaggcgcccaacacccacaagggcccacacaggattccccacaggatcctaagacctctggatggaacacagcgcctgccccaatccaatcacgcagaacctgagactgcagtaaatagggggtaaatagggaagcagactacccaggcctgacctggggcacaagccccttctgctccactcgagccccagggtaccttgccagc

SEQ ID NO: 697 - DNA, 1200 bp, mus musculus
catctcatacatttaataccaaaaaggatatatatcatttactggaaaaaatatagaaaatgaattcttttttctcattatcttgacttttttttctctttttattcaaacaaatttttattagatattttcttcatttacaattcaaatgctatcccaaaagtcccttataccctccccctacccttctccccaacccattcactcctgcttcctggacctgacattcacctgtattggggcatattatctttgcaagaccaagggcttctcctcccaatcatggcctactaggccatcttctactaaatatgcagctagagacatgagctcagagggtactggttagttcatgttgttcctcctatagggttgcagaccccttcagctccttgggtactttctctagctcctcagttgggggttctgtgttccatccaattgatgactgtgagcatccacttctgtatctgccaggcactggcatagcctcacaagagacagctatatcagggtcctgtcggcaaaatcttgctggcatctgcaatagtgtctgcgtttggtggttgattatggtatgggtcccgcatggggcagtctctgcatagtccttccttcggtctcagttattgatatgaatacaaacttgtaaagccagtatagatgataatgtgggagtttctccaatattacaataggaactatcagtactgggggaatggcaaaacagataaagtgcttgctgcatataagagaaggcaagcctcccaaatccacataaaattcagatgggacagtgcatgcagaaagtgaaaggagagaatacccagagggagctgtgtcgtcagactagcagaaacggtgagcgctaggctcagcaagagactctgcctcgatttctatgacaggaagtgcccaataccatttataattcatgcctgcacagtggttctcatacaaaaatgtgcgcctgcacatacatctgtgcccacacatattaatacacatatacagtcacatgtaccatatatatagatgtgcaaaagtagaattgctatatgactcaaaaatcatatgttaaataaacattaaaaaatgaaacatacatctcacagatgtacaatctcatatttatttattaaaataatattcacaagagctgtgtcatggaatcaacaggtgtgtcctcaagaactagtt

SEQ ID NO: 698 - DNA, 1200 bp, mus musculus
tacttttcctactgttattcctgtatttctgactctgatacatacaataaacaaaatagagagttataattaatggatatacattatactatctctgatgacaactgtatcattttcaatcaacaggtccattgaaattgtctcctctgttccagtcaatggatcaaataaatgaaactgtagcttttgaatttgtgttgttgggactctccagttcttggaaaaatacaatttttctcatgtccaccttctctttgctctatgtaagcatcatcgtgggaaaccttttcattgtctttttggtaattaatgactcccgtttacagtctcctatgtattttcttttggccaatctgtccctcattgatgttggactttcctctaccacagtgcccaagatgatctcagatcttctgaaagagcacaaagtaatatctttccacagttgcatgactcagatctgctccatccacattatgggaggagtggagatggtgctgctcatagccatggcgtttgacaggtacacggccatctgtaagcctctgcactacatgagcatcatgagccctagaatatgcatttcatttgtaattgctggctgggtcactggagtggtccatgccatgtcacagttctcttttgttgtgaacctgcctttttgtggtcctaacaaagtggacagcttttactgcgacttccctcgaatcatacaactggcatgcacggatagagacacatttgagtttgttgttgctgccaacagtggcttcatgaccttggggaccttcttcttgcttctcctctcctatgtcttcattttggtcacagtctggcaaaggtcttcaggggacttgtcaaaggcgcttgtcactctgtcagctcacatcactgtggttgttctgttttttactccatgcatgtttctctatgtgtggcctttccccacatcatcgactgacaaatacctgttcattgttgactttgctgtcacccctgctcttaatcctgtcatctatactttaaggaacaaagatatgaaggaagccataaaaaagctgagcaagcagagatgttacatcagaattttctgaacagatctgtcattagagtttatgactacagaaacctgtatttttcctgactatttgacatctccagttaacatgttgttcaggccagaatcagcactaaatctac

SEQ ID NO: 699 - DNA, 2400 bp, mus musculus
tgctggcagtaattcatagaatacaaatatttcttatattactttaagaaaactaaggcatatagctcaaaccattttacttgagaaggacttgtacggagttctcctaatcacagaataaaagtgctatatatgttttgtttattcaaatctgcataacttaattctaattaccagtaattactggacaagctgccatgttactttacttgtacaaacgtacatacatgtgggcaatataactttatcagcatctttatccaaatgagataacattgaatatgtacaaatgattttatggaactcatgtgaatctaatagataaaatatgcatttacataaaccaacaattatggaaattgaagaaaatattgaagtaggatgatcaacactttcatgtgttatttctagcctagttttcaatggtaatgtacattgtcattttagacatagactgtagtacttgaatcatgtagtaccagtgaatatccctcttttataataccataactttgttgccctagtagtcttcctcaaagaagttcattacttacagaaaaagacatgtacaatttatagtatttcaggagtcttgtttggttttttgatttgttttgtttattatcattaattaattattttatttatttacatcctaaatattgcttcccctgtcctgatcccacctagcagagttcttcccccatgcccctcccttcacctctgtgagggtgcccaaccacaggcatacctcctccctggggtatcaaatctttacaggattagatacatcctctcccacctaggccagacaaggcagccctctgctacatatatgctgagggctttggacaagtctctgtgtgtgctttgcttggtggctcagtcttggaagctcccagggatccagattagttgacattcttagtcttcctatggagttgccatcttctttggttccttcaatcctttcccaaactcttccatagggcaccctgacctccttccaatgcttggctgtgaatatgtgcatctgtctcagccagctgctggatagagcttctcagagaacaaccatgctaggctcttgtctgcaagcacaacacagcattagtaatagtgtcaaggtttagtgcccatcaatgagataaatccccagctggggtggtcttattttctaaagttgtactgccaaggcctgagaagctttcttaatatactagctctccagttgcagtgcttgaaaaaacaatgtgcttgaatccttcaaaagaactgggaacacagactggttaagaagcacatctagagacaagccttgaacgtgtttaccagattcaatttaaaattattagagatgtatctcagctcctttcaatttcttcctggtcattaaagctgcaaaataaacaaagataaaaaaatgagaacatcttgttaagcttcttatgatctgtgagttgtatcataggtattcttaactttttggctaatatgcatttatcagtgagtacataccatgcctatcattttgggtctggacaccaaaaacccactcagaaggggaacaaaataattatgcgaagtagagggagggaggaaattgggtgggatatgggagggggagaggaaaaagaggggcaggatcgagtatggggagaggcaagagggacatccagagggccgggaggaattgaaatatgaagcagtgagggttaggggggcaataggaacctctggaaagtcccagaatcctggggtgtgagaggataccagaactcagtggggacattagctgaaatgcccaacagtagacacatggaacctgaagagaccacctccagtagatagacatggccctcagttgagaaaggggcccgcccacccatcttcacaatttttgacccagaattgttcctgtctaaaggaaatgcagggacaaaaaaatggagcagagactgaaagaaaggccattcagtgacctgcccaacttagcatccatcccatgggcaggcaccaaaccctgacactatttctgaggccgtgttgttcttacagacaggatcctggcatagctgttctctgaaaggctcgaccaggaactgactgagacaaatgcagaaactttcagctaaccattggattgaggctgggaaccaatatggaagagttagaggaaggactgaggagctgaagaggattgtaaccccaaaggaagaacaacagtgtcaactaacccagacccctcagaactcccagagactaagccaagcagcgtgcataagctggatctttccttgttctctatagttagtattttgattattatgtgctaagagacttcctattttagtctaatctatttggtgttttgtatgcttcttgtatatttataggcat

SEQ ID NO: 700 - DNA, 1200 bp, mus musculus
gctcatgatattgatagtaatattatattgatagcaatatttatattgatagtaataccattcatattttgtgaagatttctatttacatctattaagtctcaagttgaatgtcaaattctataagtaatttgtactacacatccatccaaaatctttctttctctgtaggttcttaggacaaaatgaatggagtgaatgagtccacggtgtcagaatttgtgcttttgggactttcccgctcacagaatcttcaggtcttgctctttgtgatatttttgatactttatctgctcattatttcaggaaacattgtcatcatgatcttaataaccattgaccgccatctccattcccctatgtacttcttgttggccaacctgtcctttgttgatatatggctttcctcagttaccacaccaaaaatggtcatagactttctcagggaacacaaaaccatttcctttgaaggatgtatgtcccaggtcttctttgctcattgcattgctgcaggagagatggtgctgttgctggtaatggcatatgaccgctatgtggccatctgtaaacctctccactatttcacaatcatgaacctgaaaagatgcactggattggtgttgacttcctggaccgttggctttgtgcatgccttgagccagcttgtagcagttctgcagctacctctctgtggcccattggaaatagacagttttttctgtgacatgccactagtaatcaaactagcctgcacagattcccatgatttggacattttaatgaatgctgactgtgggattgtagttgtatcttgctttattatgttgctcatatcctacacatatatccttatcactgttcgcaggagctctaaggctggggcatctaaggccctgtccacgtgcactgcccacatcactgtggtgatgctgctgtttttgccctgcatcttcatctatgtttggcccctcaacatcacctggttggacaaatttcttgctgtgttttattctgttgttacacctctcctaaatccagccatttatacactgagaaataaagaaataaaaaatgctctaaagagatttaaaagctatgttatgaatcacaaggtaaatacttaatgcccaggaaatccaccataaatattttaagatgatatttcaatgaaatgaggacaggttaaaatttggggtattta

SEQ ID NO: 701 - DNA, 1200 bp, mus musculus; identical to SEQ ID NO: 700

SEQ ID NO: 702 - DNA, 1600 bp, mus musculus
ataagaattctaataatattttaaatttgtgaatattcttaattcttataataagaaattctaagaataggaaatcagtacttgaaaaagtataataaaacaatcaaaaccttatctaaataattaatgtaaaaccacacaatttatcgaggacaaactgatttgataaatttatatttacaaaaacttgaaccagaatatcacactcctactccctaaaataatacaatatacaatatgttacatgatgatctgcgctatgaaacaagtactacttttttaaaatcttacttttgagtggttcatatatgtgtacaatgtaacctaatcgtatccatccatattatcttcatccaattccccaagatttctttcagtatattttttgaagtggaaacttgagggttctttgaaagttggatggatggtgttttgctgaggcaaacacatgaaggaaaatttagctgaagcagacacaggtgaaaggatgttctgctaaagcaagcatgtaaaaggacatttgatgaaggactctttgctaacaacacacatgtattggtctgccttacattatgtagttgagctgcatttgtcaggattccatagagagaaacacaccaaaaaacttctggtgatgtgctgtagtttcttgaagcttcctcccactcgggctgattggcagtggtgtcagttcatacaggtgtacaatgtaacttaatcatatccacaggcaaatcctgtggaggacacgtgatgtttggaggatataaataggactctactggctaaggctgagcttggcttgcttatagagctagctgttcaatgcttgtgagtcttacgtcttcagtgatcttcccaccactgtgagaggcatctcctggagttcctccttgtccctcctgctgactcatgctaaggctgaggcctggatatctgtgttaggtcatgtcattgctgttgctaactcaactctacggaactggtagattagtgaagtgtttccgagtagattgaactgttcctgctaacctgtgaactgaattgtcgatttccagaaaacagagatgtgagttgctccaaagaatctttctaaaaagattcacttctcccatatcctttctttctcactatcactgctgggtggtgggctaagagggagtttaaagcatttaagaaccatcattaaaaataagctttgacaaaatttaagttccaacatcccttctaaattcatgttctcttattagtaaccatgtgagtacaattaatgctgccaaagcaaacatgagtgtcaggctaactactgggatacaagaaagcattaagtagacagccctcagagtaaaagatatttctccctgaatagttatctattataaataactgcttaactggagatgatttagaagctgctcttctctccacattgaaatttttaactggtttgatcttgctcttggttgatcaacataacaaggtagataagagctgtcagtataaacaggctagaatctcacatgacacaaaaccaatacattaggtccacaagctcagataaaatgtaaaaaagcacaaatgttgtgaaaggtcaacaatt

SEQ ID NO: 703 - DNA, 1400 bp, mus musculus
agtttaatttgcatttgtcttctcattagtacattccaaagtttagaatcagaagatccagaatatgggagaaaataagtatttgcacgcaaactttatatgccccagtacaggggaacaccagggccaaaaagtgagaatgggtgggtatgggagtgggggagagggtatgggggatttttgggatagcattggaaatgtaattgaggaaaatacataataaaaaaatatttttaaaaaaagcaaagcaataaacaaaaaataaatggatttatcaaaaatttaaaaaaaaaaacttcaaagaaaatcattgagaaagtgaaaagataagccacaaaactatttgcaaatatttaaaagtacttgcaaataaccttaaatctgataagaaacttatatttgcagtccaaccttctacccaaaatttgtcctgcctacaagaagtacagggacaaagatggagcagagactgagggaatggacaacctataactagcccaactttagacctatcccatgaacagaaacaatcccttatactattaattattaatactctgttatgcttatagacaggaacctagcataactgccctctgagaggttccaccaagcagttgacttaaacagatccaaagacccagagccaaacataagagagagctcggggactcttgtggaagagttgggggaaggactgaggaacccagagaggatagggactccacatgaagaccaacagagtcaactaaactggaccctttgtggctcccagagactgaaccaccaaacaaaaaagcagcttaatcttcatgcaggccccccaacaactatagtgggggcttaccctgactttgttgcttgcttgtggatcttgctcccctaactggactgccttgtctagcctcagtgggagaggatgtaccaagtcctggggtaacttgatgtaccagggtaggctggtacccagaggggatctcccctttctcagaggtgaagaggaagggggatggggcagtggcttgtaggggggaactaagagcacaggctttgatatggatggaaagtgaataaataaatatattaatgggaaaaaagaaaataaaaagttgtgcatttatgttcttaaaccacttaaaatatatatgattatacactattaatgattgtatagagttgtgaagtgatagaaaaaagtaaattgtaaactttgttttaatatttctaactcttccctaagcttgccttaagcatgcttcctctgattctttgtcttctttactcctcttgctttaaagttcccctcctgacctgttcctgatttgcaagctagcttaattaacttctctctctctctctctctctctctctctctctctctctctctctctctctctctc

SEQ ID NO: 704 - DNA, 1000 bp, mus musculus
actagagagataagcccacatttctctctgaaattttgtgtgctgaaactattcatgaatgaatgatggacaataaaacataaaatggcatatttgattcataagactggtttccagtctgcctaaccttaaccatatctgaccatcacatgatcaccacatgaccatcacatgaccaccacatgaccatcccatgaccatgccaagagtacattcctcctgctagcagacattatcaacttggcataacttcattccttctcacagcactcttcaccgtcagccaggctgttagtctggtccttgtcttactcttgcacgagaaagtgtaatataataaggaaacaggatgcatccatttgttgagtagtgatacaaaataaaatatgttaatgaacaaagatcaaatgctattttttccactctcctgaagataaagaaatgttccttgacacggggactaagcagttaagagcactggtacctagcatccatatggtttacaaccatctataactctaatttaagggaatataattcccttttctggcttttgtaggtgccagatatgcacatggtgtatatacatacatgcaggcaaagcacatacacataaaataaaataatggtaaaaagcgtgtgtcaggcctagacataaatctatacccaatgtcttatttttctgtagtctaatataaagacatactaacgagttttttgttaccttccactcaaaagaaaaatattctctcaaagaagagctgggctatgaaaatgtgcaagttatttaatattaaataactcaataagtgaaaattaccaagttcaaaacagataaggtagtcactgtgcataccttaacaagtttcaacagttcatagagatcttcaacctcgtcaccttcacattgcgtataaactcttcctgtctccaagctccttcctctgatggctctgcgatacaggggcagcgccattgcttcagcatacaagtcaatggc

SEQ ID NO: 705 - DNA, 1600 bp, mus musculus
atttattaattttttcatttttcttctgacacaggccacagaactaaaaaaatcagccactgtgtttcacataatttgagtttaaaatatgataagaaaaaagtgaaatagacataacatctaattatataattaaaggtgttctgtgtgacaaaccttacttctttcaatgagcttctatttgaaggaatggcctcatagtaatctctatatgaattttatgtgatgaagttatttcctttccttatcactaagtaataagtagacttatttgttgcttaatataatgagctacagatgaattcagagcaattttcctagccctctacaaagttgcacacacacacacacacacacacacacacacacacacacacacacacacggaaacaaactaactagcactctgctaaagagttttctccctctctcctccatccaatcaagattcccaaaggaaagaaggacaaagggagaagatgccccatccccgatgtcctgaagaaacagtatgccaaggtggtcgatcctttgagaaaagacccaagaaattcggcattgggcagagcatccagcccaaaagaggtctcacacacttcgccaaatggccctggtacatcaggctgctgcaacaaagggccatcctctgtacggaatcaaagtacctcctgccactaactagtttacccaggccctggacaggcaaatatcaacatacccacttatgcttgcccatgagtacaggccagggacaaagcagaagcaaagactagtggtggtgctcagaagaaagctgctggcaaaggagatgtcccaactaagagaccagctgtcctctggccaggagtcaatacagtcaccactttggtggagaacaagaaggctcagctggtagcgattgcctgtgggtagaccccattgagctggtcgttttcctgcctgccctgtgtcaaaagatgggggtcccatactgcaccatcaagtaaaaagccagactggggagcctggtccacaggaagacatacaccactgttgcttttacaagggttaactaggaagacaaaagtgctctagctaagctggtgaaagctattaggacaaactaccacaacagatatgatgtgatttgatgccactggagaggcaatgtcctgggtcctaagtctgtggctcacattgccaagctggaaaaagcaaaggctaaagaactcgccactaaacagagttaaatgtacagttaagttttctctacatataattacaggatcacaaaaagtgttatctttaatccccactagcaccttcacccctgcccagatacatacacacagtttggtagtactcattctaaacattatggaaactaaagcttaaaatgtattgaagatatcaaagagcagtccacatgtttcctgaccacagcacactcctttttaccttagaaactaagtcagaaaaggaattctcttagcttctttttgtttttctccttaccagaagaagcacagtagctatatgtgaattaaaaaagatctataaattatatttttggtgaatacctaaaatataattgattattcagattaatagtaaacattca

SEQ ID NO: 706 - DNA, 1000 bp, mus musculus
ccccaaaggacccaattcttttcgacaacctatgtcttggacagataaccatatctaacttatgaaattaagaatctctcagctacttggagagcagagcaggtagcaaacaacactgggtaaggagaatataatgggtatagatgagggggaggggagggagaaaagaaagatggaagaggggagggaaggagggaggaaataaccaggtttcagacttcctaaatgaaaggaagaggaaaaaagtttgcagagaagctagaagctgggcacctagggaccacaaacagaggtcatatttggattcccatcaaaggacaggttttcaatatagttgctaatccagatttttaaaatattcaccaaaatattttctactaaaaaaaaagatacacttaaaagctaatttatgcgagttatgctgacacatgtctgttatgccagccctgaggatactgaggcaggaggaacacaacttcaagaccatcctggcctgcatagcaaaatcctgtctcaaaaatatgtccgtccgtctgtctgtctgatatcatttatctatcatctataaataaaactaatttataagttagtatgaacctctcatctcaaatggcaacatatgtgaaaactgcccacctagttgagccaggcgtaggcagcaggtgccgctgtcctcagtgagccagcccgtctttatgagagtcttgatcagactgcagcaacctgcccttgaagcggtagtttaacaacctttgcccaagcactctctggctctttgcacatctttaatagtttccttgacagactatgaagaactgccagatgacagttctatttcattttttgtcagtggctggtgctccctttttctctctggcgttttctcaagggcacgattctgtaagtcagcgtggcaatgttcacggtggggattgctctttcaaccactgtaccgatgtagcaagagcgagtcacagacatgtcaagatttcaggccttc

SEQ ID NO: 707 - DNA, 1400 bp, mus musculus
tagatggttttgagttagttttttatgctttgtattttccttgactgttgtgtcaatttcttctctggtatcttgtatgcctgagattctctcttctatctcttgtattctgttggtgttgcttgcatctgtaggtcttgatctctttactaggttttctatctccagggttgtctccatttgtgatttctttattatttctacttctgtttttaggtcttgcaccactttgttcgattccttcatctgtttgatcatggtttttttttttttttttttttttttttggtttttttttcccacttctttaagggatttgttttctctttaagggcttctatctgtttaactgtattttcctgcatttctttaagtgagttttttatttcctctctattatattcatgaggtaggattttaggtcaatatcatgtttttcatgtgtttgggtttatccagggtttactgtggtgggagagctgtgttccaatggtgccaaagtatattgccttctgttgcttatgttttggggcttgcctctcaccatctggctatctctggtgttaactggcctaagtgtctctatctggagtctgactcctgtgtccctggttacagcagatatcctgggagactggtgaccctgactatagtaaatcctctgggagacctgcaaactgtggagtatttaaaggggcagacataacaatatgtcccagaagaagtgcagaccagaagggagatagggttccttcatatgggagggagtccgatgtctactggcctccttgggggtcccagctgctgcagttatgtgggtgagtgtcttatctgggtcacactggctgcagcaggtctcctgggaaaactgcagactgtgaggtgttgagagtggaggacatgtagatctacctcagcagaggtgcagacctgaaaggcactaatttccattttaatgcaactttactatagtgtagttcatgtatcataaaaatcatttacttcaggtgggatgaactgacagtttagcagctctcaaggtagtagagccatcaccataaagcagctttagaatatttttacacatactccatggaaacacctcatcctcacaaataattctcatttctgcccctcatctgcacacatataggaactagctttcatttcatttctgtctccacacatttgtactttcatatgtttgtaaccaggcatcatcctatcatatgtttatgcttgtctttttttattattattttattttcagaagtttcaagggcaatggttctcaatctatgagtcatgaccttttggggcactcaaacaacccttcacaggggttgcctaagatcattgaagaatacagatatttatattatgtttcataacagtagaaa

SEQ ID NO: 708 - DNA, 2000 bp, mus musculus
agagcctgagatggatgtccacactagctccccccagctcccgccatcccagagccatgggtacctcaggagcagggcctggcatctgtccaggatgctacgcgcctcagagtgtccaccctggtgcaggctgtgggctgtggcctccaatgcacggatcttttcggcctgggccttcaggccctgctcatgcctcttgagctttgacagaagggtctccacagtgaccaaggggtcctggtggaagcggagacccatgctaactatagggctgactccactccaccctgaactgtttccctctagagccagcctaacaaaccctttctacaaaatggttgttctctacaaagtgggtattatttaaaccccacaaggctaactatggctagtatccattctcagggcaggttgagtactgccctctcacctctatgctctgagtaagatctctgtcttactcattattctcccaagtccctgtgagttacacatatctgttactggagttagggtgatgttggaaggaaggcagaggcaaggagaggggtaggaaagagatcagagggaacaaccagctgggctctaagcccattcccttggctcctaggacacactctgtggacgctatccaagggtacaagaagtacttaggactgatgataactgctcagcagtgggaaagaccttgacccagagagcttgctgttctggctagcgattggtcttatctgtccttcctgctcctcttggacacctaccgccactccctcactagccagggaggcctcttcactgtcaagccagcgttccgccttttccacagagcccagaaacagctgatgaaaaaagacaagagaaattcagaagagggctacggactatctgggtgtgtctgtgaccttctctgcccagggattacctagtgtgtctgtgacctttttggtggttcaggttggagaacctgaggcctggctccgtgatacaggcacaggcagactggcagcaatactcaaggcagtcttttcagctttggctttgaccagagctgtggggacatcacaggccctgatagcagggtaggctggaagctggcatggggcctacctgctgctccaaggcctgctgtagctgctgttgccggccctgccaggattcccgcaagctactcaacccctgctctacagcggccagggtctggtgaatctcagaggcctgtgggtagccagatgcaagcagccgctgccccatgctttggaccaggttaaggctctctgttcggatgtccagctcaacctgtaataggcctgagatcagttccctgtgggctgaggtctaccagaagtccagcaggaaggggacaatggaaaaggacaaggttggccaagagacagagaaaggttctagcaggggtcagaggaaggggtggggtagtgaggggtgacatttgaaaggcctcgcacctcaggactgtggctcaccttgtatgcccggtactcttccaacatgtactggattctcacagggctgcagggggtgccctgtgtggccatctcagcctgtagtccccgggcccagtcctgcagatcctgcagcagggtctggagtttctgaacttcatggcccacatccagcaactccctcctgctcacagcactcattagtaagttctaggctcatgagtcccctttccctcatgcccagcgccctttaatcccctcggcacagaaggtctatgggatgggaattaattggtaaatgatacagaaactctggagaaagtaggggccaaacgcaagcgtgtgagccgggaaccagagggaggcccacgggctcgtaccacttctgggctttgctccagaccttccaccagctgtccatcatttcttgctgcttatgtctgaggctgtgggcaacctcgggactttccttgcagagccggccaatcctaccttcaagagactgtagggagaaaggtcagaagctgtaggcagcagggg

SEQ ID NO: 709 - DNA, 1000 bp, mus musculus
agatggcaaataggcatgcggttgccagaacaacacattctcacagtcgggataaaggtcaaagaggggaccagatgcttataactgatcaggtttggaagacgaggagaaagacaggcatcctctcctttgtgctcccctctcaagtgatgcgactgatctctttttttgtacattcttcctcctttgagccaaggaaatagaattcttggctcctcaaagcaaccttatgtaaccatgacaaacgttactgaagtttgactgccccaaccctggggaagggggagacagccctacttgccctttgcctgcttgattttcacctcctggttgcctctctggaaaggcacatatatatgcaatgctgctcagtctgtataatagtattgatctcagagctgaccacttgttattggttaattgatgtgctcttccctggggaagactgtttctcccactctgggcattccttagctgcctgtagttgtttgtgtagcgttgagggataatgagatttccccatccatgacagcatgcctcttggtgtcctccttgttcaggtctggtgtagacagccatgttgatgagacttcctgggtgtcgcttccctgtcatttctaggagatacaatcttacaacggactttctgttccttctggcccttacaatcttcatgtaaagattgtttttaaaaacttcctcctgaaaccttggctattcatgagggagccgtaaaactatggaactctctgagaaagagcctggaggaaggaaaggaagaagtgttttgctttgttttctaaggagtctaggggatttggttggactggcccacccgttagagacagcactcggggccagtgctcactggtttgaagacagaattcaggttaaaagtgcagtacttccacgacagtgcttatccagtggcctttcccacttcacaaagacccctttccctctccctctctcttccacggcctccttgaagacacacact

SEQ ID NO: 710 - DNA, 1000 bp, mus musculus
tgggaattccttccctccacctccctacagtactcagtgttgactgacttggtgaatcagtcccggaaccaagaatatgaattcccctggagctccccagcgttgttggaaggcctggcggcctctgtatactctcagcaggtagggcatactttcagtcaacatggaggaccgcgcccagttgacactgccagcactggagtgaagtaggtagggttaagggttgagagctgagaagaggaccctgaaggtgacaaggaaggaggagaaaggcagcccttagagcccctgaagagactgatatgttggtcccagcaactccatctttggccacagctgaatgtaaagctgcttctggacttttctttcctggctagctggctctttccagcctctcctgaggccaagtagcacagcctttcctgctgttttgcataaagcaggctggtagtgaagccagaggtcaaaagcagggaaacatacaggatgtgtttgactgtttgccttttcctcaaaactgtccctgctcatgatgtcagcctaaagctcaaagttcagaaaccaagacagggaagcaatgctcagacagccagctaggacagaggctagatggtgagcccagtcaggtctacacccctggtggcagacagttcccctccgtgtgccaaattcaagagctaagagaagactggtggggaagcttgctaagaacatggcagatgggatgtgctttccagacaatggtggacgccatgttgatgttgcccagcccccacatcatctgggtccaaagcctctgcacctcaccctcagctttaaaagctctagctgagtcagacactggctcttctttccttggcatctgatagtgggcaagagcgtagttggcattaccagcatgggatttcttggtgcatcctccaacctgaggagctgtttcttgcatccacatggcctctgagaggcagtgtatcatagcagattcattataggggtgact

SEQ ID NO: 711 - DNA, 1200 bp, mus musculus
caatttcttcactcatattagcacagccgtaattttcacgcttttgacgactgtaagttttagtcatgagaagtaaaagctgtcactgggacgtgacttcaggtagaaagcacttgcagcaacacctagtgtgcgtgtgcagggctgagtccaactggcaagggagagaggtggaaacaggagactgcctctccaagtgctctgaggccagtcacccagaacaacaaagaaaccctatttcaatcaaggtagactgcaagggctaacacccaaagttgtcctttgaccttgacacacatgcctcaacaagttcttgtctgcatcatacacacaaacacatgcacatatgcacatacattatatccaacacaaactcatgcatcatacatatccatatacctgcactcacacatacaaacacacacacacacatatgcgccgacatcacattcacatggcacaaatgcatacaccatacatacttacacacccacattcatatacacaaacgcatacacatgtgcacacacaaaggcaaatgtataacttgttcacacacatcagaaatacagacacacacaccactcacaactgaaaataaaatttgcaggtgattgttagctgctttatgttaaaagaaaacacttttttaaaaaagatttatttatttatcttatgtatgtgagtatactatagctgtacagatgtgagccttcatgtggttgttggtatttgaattttgagacctctgttcactccagttggccctgctcactctggtcaactcctctcactcagtccctgctctctccagcccaaagatttatttattactctacataagtacactgtagctgacttcagatgcaccagaagagggcgtcagatctcattagggtggttgtgaaccaccatgtggttgctgggatttgaactcaggacctttggaagagcagtcaatgctcttacccactgagccatttggccagcctgaaaaacactttttacttgatgtgggaagagtacctaatactgtcatcagaaactgactgtactatataagctcagatgaggtagcccatgcatgacccctagctactgaccactgaaaatgaggctagtctaagccaagatatgctgccaatggaaaatgcacattgacttttaaatatctagtataaaaatacttctataaaatct

SEQ ID NO: 712 - DNA, 1000 bp, mus musculus
taagtgacatgagaggaggactatttgggacaggaagtgaagcagcataaggtgggcagtgggggagaggaggcagctgaaggagtgcatgagtgagcaccaagcagactgatacagatgtataagatgccataatgaaacccactcctctatgtgctaaattgaagaaaaaaatcaaggcggtagacagtatttcttactgcacagcccaccgatccaatcaatctgttttattttgaaaaaaaaaaaaggttataaaatatgccaaaaaaactaaaaatacttcatcctttgatgaaaagcctggaaaagtctcagccatgaaagcatttccaaccacaaaaataagtttggttaggtgctctgaaaacctatggttatggaagacgaactcaataggtaaactgaagccttgaggtaaacaacaggcttttgcaccaaaccaggcagctgactgaggccgtcggaagacaaaggaagtgtacagtcactgttcacttagctcccaggcaaggcagccatcacgtttacttgtggaccatcatccactgtcctagatctgacctcactgcaccggaggcaggcagtctacctcacacgatgggacatgggcctgaaaacatgtccaggaaatcgcatgttttacctgcaaacatttaagcaagtatgacatcatttcagaagatagaaatgggaggattgaggaaagattaaatgttataaacactcaaaatttaaaaatccaacaacaaactacattttccttctctcctgtctcaagctgctcatttcatacatatgcatttcttttccatgtgtttcatttgttccacatctgctgtctgacatatgattagttgctcagagcctgaagagaggcttttgctcagctagagctgaggagggagcagaacagagcagaacagtggctgccggaaccacactggctcttgctctagagttccttcgtaagtcatttttaaaggtaaaagctcaaagc

SEQ ID NO: 713 - DNA, 1000 bp, mus musculus
ctctttaagggcctctatctgtttacctgtgttctcttgtatttctttaagggagttatttatgtccttaaattcctctatcaccatcatgagatgtgattataaatcatagtcttgcttttctggtatgttggggtaaccagggtttgctgtggtgggagaactgggttctaatgatgccaagtaatttttgtttctcttgcttatgttcttgtgcttgccttttgccatctggttatctctggtgttagctggtcttgctgtctctatctttggcttgtccctactgcaagcctgtgtgtcagtacttctgggagtccagttatctccaggaagaatttgggcatggagagctgtggtacagggtcagctctggagtgcagacagagtccagaaggatcctgtccccacctgattcttggttcctgtgtcatgatggctctgtgaaggtccctcttgggccaggaatttgcagggaagtggtagtcttacctgtgctagctggtatgtaagcactcctgagagactggctctctcctcgaagtatttgtgtgtgtagcactgtggcacaggatcagctctgggtgcagacagagactggaacctcctgtcccaggctgcccctaggttcctgtgtcccgagggttctgggcgagttcctctgagcagcagtagtggtcttacctgtactctcaaggctgtttgcactcctgggaggtttgctctctcctggtgctatttgggtatggagctctgtggcagaggatctgctccaggtggagacagagacctaaaggctcccttagttcctgtgtctgttaaatacattttttccctctcggcaggctgccattcatgctggagccttccagcagaactggcaccctaacctcatatttaatcatgtgtttcctgcttagctcatattcctgtcctcttgataattgggtagaaagataattctgtagatgagatcttgacctgtgattgttaattcata

SEQ ID NO: 714 - DNA, 1000 bp, mus musculus
acctttaagctctaccagcgggccaagcacgtgtacagtgaggctgcacgcgtgctgcagtttaagcaggtatgtgaagatgcgccagacaacgcagtccagctgctgggggagctaatgaaccagagccacagaagctgccgggacatgtatgagtgcagctgccctgagctggaccagctagtggacatctgccggtgagctgagagggccacgtgggagctaaaacatgccaccagggaatgttggtgcaatgaacaaaaacccgtattctcataatttagatgaatccttcctgtatgagggaccccagtcctcctgatgtagagctcccatgttcttcctgcatgtctgcagagtggcttgagacccggctttatggggcacagaagtcaatctgaaaccagtttcattgttagctgattaaacctctcaggaaggcagctgttctctgacatgggcattttatgtgtttcggaaacccctaggaacccaatggagttctgtctagaagagagtcaaaaaacggtcttgaccttgagagttctgctgaaggaggtgggctggaagaatcacttggaaagcccctcttgaactgccatatttattttgggcaattaggggaaatgaagaccaaagaaaggccagtttataaacttggctatgacagaagtgtaaagagagagcatctttcacaaaatctccagacctccctgtaattgtgcaacaatggggataatagagtccttcccagggaggtcccacactgaccttggagaactgaaagggaaattggagggaaatcagatgacctgtgttagctcactctgacgatgacacagccctgcacgcaactagcagtggaaatgtaattagccacttggcgcctgtggcttgccaggctcatgccacacccagtcagaaagtttaaacccagcggctagagtggatcacaaatggcatgtggaacctgcctggcccggccaggagcttgtactca

SEQ ID NO: 715 - DNA, 1000 bp, mus musculus
cgtagcaccacgtcacagaaatgaatctgtatttgtttgtttgtttttaaatttggtgaattattgacttggctttgtcaattagtgagaaacttgttttgaagtaacttctccaggtagtataacatgattacatgttcttaggaatgagctaaaactttaccatatacataagaaaacaaataccacagtcaacccaatgcttatttctttagacactcagcatttctttttcttagagttctaagtcagcgtttgttgaagatcacagtagcacttagctaacgtgcgtttctttgttttaggttgtacttgtttttcctgggcctcagtctatctcaatagaagatgtctctttccatctacaaaaaaggattgaaagtaagggtagaaacaaagctgacaaccttgatgtgccacctcggaaactcaagaggactacggacgaggaaggctgggatctgcatgagagcacacgccaaggccccgagttgaaaagagttgtctttattgacagcacctggagccagacaaaccagatcgcctctgatgagcggcttcggggtgaggatggagtttggggactttcttcccctgacagcctttatttagaaaaacttcacttctatggctccctcaaaagaaaagttctattcaatgcttgcatttgctccatttctcatctccctttctgtattctgtgtgtgtttatgcatctatatacatcgctggaggaaccctttcaaagtaagcagtaggctttgcaaaatggctctcaaaatactgtagatctgttagaaataagggcactcctatgtgataaataaaatgccgttggtgctcctaagagaatcaatagaacaatatataacctacaacctgtcttcacatctctccaatgtatacaataatggcttttgtagcactttctcctctgacagtatttaaactcagactttccgactttccgatgcttctatatctttagtttcttaatcta

SEQ ID NO: 716 - DNA, 1000 bp, mus musculus
gtttccaccttgcacctgttgcgatctctgctaccccccagtctctattctgctctgaactcagtctgaactactaagcaacaaatgaagtgcatcttgtcaaatacatcaatattattagacacaaaactggagacaggaggaaccaacctctgagatagcttttcgtacagcactccagtgggaatcagttctaggaagacaaaggagcaaggtcagtgcagggaccagctgtgcctatttcaactgggagtcaaaagaagagtgtggaatcaccaatcagctcgggaaactaaccagtcttctcaggggaggcccagctaggattcaatgccctaaatggattacaaaattaaagtagcaaaatttgccttccttataagaaagtgttgagttattaacagtaaaaataaagccaaaaacttctgaggctgcagatgatttagttggtaaaatgtttggcgtgcaagtgttttgagttcaaaacacgagagccgacattaggtgtggtgatgtaggtgtggtgatgtgtatttttaatctcagagctggcatgctggagacacaaggttcctggggctcactgtttacccagccaagcctaattagccagttccgagcccaagagacacccaacattaaaaagcacagtgcattactcctagggtacactatccaaggtttcacacacacgtgtatacattgcacatgcctgcacatacaacccactaaacacatgctcgaacatgcacacacaggtttaagccacctggatgccctctcccacctcgtacctctgcttcacctgggctccatctgcagtttcatccaccacctccacgtcctcctcaccgtcctcctcaccgtcctcctcaccgccctcctcgctgccttcgcttgactccagcttgtcttctttattatagggctgagagattgtggacatacaaagtgatgctcagtcaacacagaatcaaaccacaaagatgtatcagtactt

SEQ ID NO: 717 - DNA, 1000 bp, mus musculus
catcctgaccaagtaggttttattccagggatgcagggatggtttaatatacgaaaatccatcaatgtaatctcttgcgcgcgccggactggccagcagtaacgacactgcaacaggatccttctgcacacgtttattgggagagcttgattgtagaggcgaagagacttcgagtccagaactggtgctgcttttataggcctaggagaggcgtgtctcatacccggattggttatgcactaagcctcatttgcatgttcctcatctgattgactactctctctcagtacctcacagagcctcattatcatacctcatttgcatgtctcacatccgattggttactctcttagtaccttacagaacctcattatcatgcatcatttgcatgtctcacatctgattggctatactctcagtaccttacagaacctcattatcatgcctgggccaggcagtgtctttgcaaaaaactttactgcatatgtacacattggttgtttgtccaatcttatgcatggtggccagcagtagtcagtgccactcagcaacggcacatgtggcttcccacagtaatccattatataaacaaactcaaagacaaaaaccacatgatcatctcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacag

SEQ ID NO: 718 - DNA, 1000 bp, mus musculus
agacagagccaacgggactacgtaatgagtgtagtggtacagtcagggagagggtgagtactgagtgagcactgtatcttgtacttctctcctcctttacagtctcacaaattagatgccttggaaatgctgtgcccagtgccaagttggaccttcatcttgagtggaagataacatgtgctaaacagctctgtctcttttaagatgaggtacttagttaaattacctggctctggtatgggtaggcggagctaagtgggaaaaggtagggcaaaatatggcttattctctcccaaacggaaccaacctcctctctcccaggatcctttcatatacccatcgagtccaccaacctggtccttaccaagccatagtctctcaatcgaccccccttccctttattcacccctccctatgtccttccaaggaccccgctcaaacacaaacagctcctgcatgagaccttctccaatgctgccaaaaacaaagaatcgcctcacacgggctcttgcagaactttacgcatcacctgactggaacattcataccattcccttccagttttgtgaagcctgatgttttcatgatgtccttgtagctgaaaaccattgtttaactcattctttaaaaaacagttttgaataattctctaagaatttcatacagtgtatcttgatcatattcatccctctctcctaacttcccccaggtcctctcaatctccctgtccatccaactttgtgttcacttcccaacccccatcaagtccagtttgtgttggtcacccactcatttgccccaccgtgtggccaatgcatcaggtgtcatatgccattaaagaaaacggactgaacaaagaattctcacctgaggaataccgaatggcagagaagcacttgaaaaaatgttcaacatccttaatcatcagggaaatgcaaatcaaaacaaccctgagattccacctcacaccagtcagaatggctaagatcaaaaattcagg

SEQ ID NO: 719 - DNA, 1000 bp, mus musculus
acgatcaagccactcacactgcagtacaagttacttgaccctgttctgctttggggcaaggaatgacttcctggcgtggatgtctgggtccctgtgaagagctgtgatcatgttgaatttatgcttcctaacagtctatctcttatatttttggttgtgagcctagcctttaacggctgagccatctctccagcccacagtctatctctaaaggcttggtggtttattaccacgtacttgtgggtgaggctaaacagaaggagattaagatagcttcatgtagtatgactggactctgctggtagctgacccccatcaatgcgagtacaaaagtttcagagctcctggtgcctatgtttgataccagaaatcctaccaacaaggcaacctcaaggaccagggtctacctttgtaataaacattctaggattgtaatgttctggaaaaaaagcaaccaaacaaaaagcaaataagaaaatactaaatgtacagaacaaagaaagagtattaaactctgcaagggaaaaaggccaacttacatgtaaagacaggccttctgaaaaacttctgacttttcaatggagactccaaaagtaagcaggcctgaatggatgttctaccaactcttaagagacaacagatgctagcctagactattacactcagaaaaactatcaatcacaattttgctgactagttttatatcaacttgacacaagatagagttatctgaaaggaggaaacttcaactgagaaaatgccctcataaaatccagctgtatggcattttcttaatttgtgattgatgggggaaggcccagcctgttgtgggtggtgccatccctgggcaggtggtcttgggttctagaagaaagcaggctgagagagctaggaggagcaagtcagcaagcagcattcccttgtggcctctgcatcagctcctgcccgcaggttcctgccctgtttgagtttctgatttcctcaatgatgcactataatg

SEQ ID NO: 720 - DNA, 1000 bp, mus musculus
ttcatatacttgctgtgtgtctacaaggagaggaaagaaagaaaagaaacagagattgttaaatcaggtatcctgtgctggcccagtgccagcctgggatgcaattttctccctagatttggcaatgctggtctgtctcagacagctgtttacctagaatttggtcattaccaacactcagctggctacttttctcagggcatccccagaggcctttagatcagaaatgctatgtccaatgcaaaatgtaaaaacaaagatacattagctgttttttaacctttcctaaagcaagagtatatagtctatatgtatctatttcgacctaaaaagctctgccacaggggaaggaaagcagcagggttctgctgcctgagcctcagcttcccaaaggcactggagagagggaagaatgaagcaaggagctgttaagatttcagaggagaaaaaagtacagaagcagttgtggaccatgccaggaaacttagtaaggctaagtggactggaagccccagagcctcataccagaggactgtaggagcttcatctgcttctgaccagacccctgtcacctgaccacagcaccccatggttaggattgtagcaatcagtcacatggggcagtgcccaaagtccctccacatgcagatgaagcatccctaacatctcagaccaagccaataggaagcatctgctgtcagaaccaaccgaccccaaaatatatataacatcttatccagaagaaataaaggtgtgagaattactccatcacagatcctctgagagcttctgtcacataagagctgtaacacttcctggggaagagggctctctcctgagacctttgccactggaagctccctggacccacctctattactggtcacttcccacccagtggccctgaccttagttcctggccctgcacttcacctgctagctgagcactctcctcccctaaacactgctgtccagcctgaagatctccaaggatagcatc

SEQ ID NO: 721 - DNA, 1000 bp, mus musculus
ctaccacctgacgctaatctgagagttgctctgtgtactctaccacaggcttttccaggatcctgtttatgtctaaacccaacagtccagcctcgccagcctcttaccacatggaaaactccattgctcagagaaagctatgaatccgtatattcttatgctttaagatcctctgtgacatcccaaagcaaactccaggtaagcctaccagatgttttggggaggggagacaagggatagatgaataatttccattagcatagtactgttaccataaagatttaatgacttcattgatgtggtgttctgtgcttgtggaaaaagcgtaaggaccagaaagaaaacaatacgtatgagtacccatgaggccatttgaaaaatatactaaagaggaaaatgggatctcaagtcccccagacgaggaacagaatgctctcatttgagctgagcttagggacctgggagtcatccagagatgggggcagtaggggaacaaaggccagcaaagtgtcagtcccctcccctcctcccctgctgctgcacttcaagctagaattgaggttccactctgtcttcagaatacctgtgctttgcttgtccccttctacatccacatagagctatttttgctgttggtcatttgcaaaacaaataggaatgtcatgaaggatgaagatacctcacaagagacttagaacagtaccagaggcagttgatacactcaccagtcaccactactttcattattgtctctctggtatttaaaacaagttcttcgctttcatcagattctcaatttccttctcacttaaaggaaccaggttgcgctcactttggaattctcatccacttttaatcataaaaaaaaaaaaatgatggttttgaaatgtgcacatggattctgttctctgaggacccagtcccagatttttgaaaccaggtgcactgttcagcaggtgttaactgccagaagaatttagaagcaatgtcaccgagaggg

SEQ ID NO: 722 - DNA, 1400 bp, mus musculus
atctcacaaatatctgtaacttcactttgaggggatctgatgccctctgctcgatgctatacattcaggcaaatactcacacacataataaaataaaatcttgtaaaaaaatttaacaccattatatttcctggataaccacagaaaatttcaaattttcttgggaatttcagtagaatacaaactgatcctagagttactgtttagaattttatactgaagttgtttaaacaaaaagtccagtatctatggtgtattaaacttaaagatttacaggacatattaaatgtcaggtactcctgaaaaatgcctagagttgtgttagtgcccaatccatttacaaactatccctttacttttgctaaactgtttcaggataccatttgcctgcatcttctctctcccgagggtagaaatttcccttcaaagtactatttgtatctgaggatgtcaaattatccttgctataggcaacccacactacatcagagtgaatgaactgtgttaaacacagcacagaaaatggtcattagaaagggtgatcttcagtcctatctgtctccaacccttggatgataggcattttagttctgtctttgttgggtttaattccattttgggaaaagtcaataatgagtttgccaatcacggcacctgccctctctggtgttcagtagggtagactagacgtggaggagggatgataacccataagcatagccacccatgtcctgtggccaagccctgagcaaagaagcttatggatttggtttggggaattcactcccacatttctggcaacgcagctttttttttttaatttaaattcatttatttatttgttctttgttgttatttgatgtagatagaggtcaaaacataacttgccagacttggttcccttcattcatcacacgggtcctagcaatcaagaggcttaaactcaggtcctagatctcggcagaaagcaccttttacccacagaaacatcttgttcaccaaccctgccagttttcctagacctctgatacccgctcatggatttcttttgctcaagctaggtgttttctttcatttgcatgcaaacttagagtcattgctgatacacctggcagagtccctgacacaacagataatcaatgggtgctgtgacatgaataatcacaacctaagtgcatatcatcatcacatttgcaaaatagtgggttgttttatgatttcaaaaatttcagaaaggtattcaaggagaagaaaaaagcaatatttctacctgccagagactgtctttctgttttctttcaatgtttttataaacctacgtaatatttcagtgtcataaattcatgtgttatatgcagtaaagttacctgagcattcgatgtacaattatgtcattacat

SEQ ID NO: 723 - DNA, 1200 bp, mus musculus
atgtcaaggaatgctattttacttacaagtcatacaaagaatggctcaatagtataatagaaaatatgatggttggtatagaaatacactatacttctctcatggtaatttctatatacgttatacaaactagtgagttcaaagattcctatatcagaagaaaccaataatgcacaatctaaacaccttgtgcggactatttcattacagtgtagtgcagagcccagggtggctttgatggggacagagtgacatggctcttgtccctaggacagggccccagtgtgagcctatgtgaatgtccatggctgctgtgggtgtaaggcttgtttgtgtaataacatacatattttctgaaaccagtactagcagtggaggactctttccatgcaagaaatgtcctccctgttagtgttaatgactccataataattaggaagagcacaagtccagaggtcggggatatggctatgtctcttcaaaatggtaaaagttggtgtgatggtttgtatatccttggaccagggagtggaaccatctgaaggtgtggccttgttggaataggtgtgacctggttggaatgggtgtgtcactgtgggtgtgggtataagatccttaccctagttgcctggaagtcagtcttccactagcagcctttggatgaagacatagaactctcagctcctcctgtgccatgcctgtctggatactgccatgctcccaccttgatgataatggactgaacctctgaacctgtaagccagccccaattaaatgttgtttttttataagacttgccttggtcatggtgtctgtccacagcagtaaaaccctaactaatacagaagttggtaccaggagtggggtattgctgtgataggcctgaccatgcttttatttgaaagaatgtggattttgggactttggatttggaaagcaatggaatgctttaaatggggcttaatgggtcatcctagtaggaatatggaagacttagttgctgggagtaatttgaacagtgttgacctggcccaagagatttcttttttttttttttttttttccattttttattaggtatttcgctcatttacatttgcaatgctataccaaaagtcccccatagccacccaccccctctcccctacccacccactccccttttatggccctggcgttcccctgtactggggcatataa

SEQ ID NO: 724 - DNA, 1600 bp, mus musculus
ttaatttgttcccagcggcagttcattaccgacatcacaagcaaagcgtgctctctccctgggcacagagggcccaccggaaattaagcagacagggctgccatgcccctcagagcaaccatccagtcttgtctccttcagcaggctggaggcaagcacaggaaagtggcttttgaaaggattctgcctcctgttgcctgacaccttctgagacttccgctgagaggagcagtgcttctcacgaaggctgggatcatgctgttccttccacaacttgtcttattctggaaggagatgaaaaacagctcctgatttttaacacaaagaaagcttagctctgtcccttgtcttccaatgtgattctgcttcctgggtgcacagcagctttctggacttcaggaaggttgcttcctttattgatgactcatcagggggtcgtggaaaggaagtcagctgactctacaagaaaaagccgagccctggcaaatttagtttttgagaaactggtattttgatttttttattgttaattattagagagtgagacggcaagggatcaagattgggagctatatgtgaacacatgtgccacacataagtatggacgtgagagaacaacgctctgggattggtcctctcctcccagctttttgtgagttctagggattaaacttgtgtaacatgcctcatgactcactgaaccaactagcaggccctcaggaagccttagttttagacaaactccacgttctgactgagggaaggacaatgctttccgttactgttacttttgttgtcttcagagtcttgtcagtctctgggctacaacagatcaacaccatcctgacggcgactccgtcctaaccaggaacaaagcagggtgaactctgggcatctcagtaggccttgcccaagcttcactatctatcatcatttattttggctcttcgcttctctttcatgtagtgggcaagagagctgtggatgagatagggtgttggaaatgggtgctgtgtgctgaaagacagaatttagagggttgaggtcaaatcattgtcctcccctatcacagaaaatatgtcagtggtttctcatttatatcataaatgaaactgattaagaaaatttaaaatgaaaaggggtggttgcttcttaacattaagtaactgttaaaaaataatgtagatgggttcatagacaagaaaccaggataaattatccttcagatgatctcttaaggtattaataaaaagatattaagagtggcagtgtaaaggctgcaagaggctatgatggaaccctgaaaggagacggagggaaccctgatatccaaagaacaataagggtttagcctttaaagttttcagtggtgggaatggagggcttcattctgttttatgagtccaagactgtatgctagaagtcaagaaagcattagtcaaagccttgtacaacttaaggccagtttgagtcagaagagctgggaagggatttacaaagatgtgggaaaatggtcatctttctaggagccagctaacatatcatttgtctgtattacacttctataccaccgtgtcttacttatagtgtagtgcacatg

SEQ ID NO: 725 - DNA, 1200 bp, mus musculus
tttctctaaaatacatcatccaatgggacacaaaataagttcaacaaacataggaaaatggagagaattgtactatatctgagcacagtggtgtaaagctaaaactaggcaaaagaaactaacagacatatacaagacactgaagatttaacagacattttccaatctgagcagcgcagaagcagaggttcctgattgaaaaggtttcctgtcctggaccattattaaacctcctgccgtattctgaaccattgattccccttcttatgtatggaagaggggcttaggtgcttccttctgtcatttcacctgttcccttcacttcactgtctgattcttcatatgctctccatgcttagtgttagcagagatctcacataacatgtgctctttctcacatgctgcctgctgcaacaaagaacaagccaaatcttgcacctcaactttttttctacttttcctgaaaaaacaaaaaatcacggggcaacgtagaggacagtatcgttgaatccttttctcattgtgattcctctattacatgggttgtcagcccggccactactgtgtttcttattataaaaagcaacaggcattcaactgtagccatggcctgcttacactccattccacacgtgctaccttcagggacagtaccattttctctcttggcactttgaaagacattcctataatcccatgaccaatctcattaatcaagatgtcataccataccacagtacatagaggaatatggtcacccaaaaattctcttcaacgcatctccattttcagacagctcagaattgcttgcatgtcttacaacaaattcagggagcgtgcatctgacactacaggaaggatgcataccacatgggaaaggttgccatactgggattgcctctgtgactatttatatccccaggcaggtcagcctttattatatgtcctaacatccataacaaggtacatacaactgctcctccactactcatggcttggttcttttggtctctgttcaggcagcaatagttttatgtggttactcctggagggacatgcataaatgtttattaaccttagacaagacaccatgccagacatccaaatctatcttagtgaagcagtgaatttgctggagagttactagggaagcatgtttaaggtatgataccttctttataaaatttattttcagaaatt

SEQ ID NO: 726 - DNA, 1000 bp, mus musculus
attctttagcagcatgggaactggacttagaactccatgaaaactgtgacatgattttctcagcatttcaaccctagtggattaaggagcccatgagatgagcaaagtgggcggagtgagtgctcatccctgggtggtggctgtccttgcctcacgataatttatccctgtctttggttactgggctaccgtaattctcacatcttgagactttttctttttcttttcttttcagacagggcctcactttgtagccctgattggaactcaatatgtaggccagcctgaccttgaaactcacagaaatccacctgcctctgactcccaagtgctgacactactaaaggtatgcctggttccagtgatgttgtttctcttaagctatctagagttggttgtatggtttttacttggcttgtgtgtgtcctacagaggttcacatcctggaagctgtttccgagtatgatattgaccttaaagggtggagccaaagctggaggtaattaggtcagtgcaggcaccagcatctgaagagattggggctggcctttagtccgagtttaggtatgtctcctggaagtaaggccttctcatgcactctgcctcttctgcaagtgctcgattctctggttttctttttctccgtcatgttgtgacccaagaaaagggcctttcagaggctgagtggacaaggccacttgacctttgtgatggtttgtatatgcttggcctagggaatggcactattagaaggtgtggccctgttggagttaggtgtgtcactggtaggttataaaaccctcatcctagctgcctggaagccagtattctgctagcagcctttagatgaagatgtagaactctcagctcagcctgcaccatgcctgcctggatgctgtcatgctcctgccttgatgataatggatgataatgaatctctgaacccgtaagccagccccaactaaatgttgtttttgtaagagttgccttggtcatggtg

SEQ ID NO: 727 - DNA, 1000 bp, mus musculus
gctgaattaggtggctggcccacaagcttcctcttctcaggtctgtgggattcaagactcagttgctaagcaaccacttcctcactcttgggccaatgggcttcttggaagttcctttgaagttggaatgaagcttggctgggtgtttgggaagagcaggctatgagaagggaccctatttagtctgccattcttgtggttggagacgaaggctaaacttaaaataagtagaggtgacttcctaatacggaaggagataccataagcctagtatgtatgtttttatactaagttcaactgttcaggatcattggagaatcttcctttgtgttacctctagagacacatattatcgtttttaaaaaagatttatttattttatgcatatgagcacactattgctctcttcagacacaccagaagagggcatcagatctcattacagatagttgtgagtcaccatgtgattgctgggaattgaactcaggacctctagaagtcagtgctcttaatcactgagccatctctctgccccaccgccccctttaactatactatatgaagatgcttgaggctggataatgttatagaaaagaggtttagttcagttcacagtccagggtgtgcaaaagtgtaggagccacatcctgttagcaaagcccagacatagttatagggtatcacacagcagcaaaggcagggagtccaccctgtacaagcacatttcttctaggatcttccctttccgggtcacatttctttatttaatttgtaggaggtggatatacacatgccatgcgcaaatgtggcagtcagagaacaatttgagtgagtcagttttctccttccaccttgagagtcctgagggcatttacctcacgttgttgggcgtggtagccaggaccgttgcctgctgagccaccttgctggcctgctcttccccttcttataaagccaccacattcaaccatggggtctctacactgctgaccatatataa

SEQ ID NO: 728 - DNA, 1000 bp, mus musculus
tagttaacctttctttttccagactaacattttccttttcataatttctgtagggctccattagtagtcagaaaatgctcaaatttgttgttatcatgaaatgtttttcttcatggattgtgattgatggttttattcatatgtggtcatttagagtttgcagaacagatttccagcctcttttgcattttagagttttcactgaaaagtcagctgttactctaacatgcctgcctttccatgcgacttacatgagttgtggtgttagaggtgttgcttggtacagattgctcatctcttctttgctggattccattcttctgttgctgctgcccaatctgggttctagccaaatgtgatggctgtggggtccttgggttccagctcggtgtgagagtgtagggtcctggatatgtagctattctgcaggtaagtggagagccacaaaagactggacattagccagaaggaaaggctgaaggggacttccagggagaactagaagaatcctgcgtcttccctaagaggccagtccctggtgaatgaggacaggttgctaagcagggcttctgtgagcaggctgcagcaggacaatcttcatagcttcaaaacttgtaattagagattaggttctttgcatgatcaacagattaaaaaaatgacaatggcgggatccaggtgagaatacacacggggtttcatgactctttcagttctgctgtataaattaacattgttcataagagaacattaaggaaaataatatgcagttcagttaaatttctaaatgctcaacagtcttgaggtttggagatgtgggttagatgttgaggactctaagtggagttgaggatttgtgtgtgccttcagctcttgccttcagctgtggctcatctccctcctgtgtgttcatacagggcaccactgacacatgatagagtgtgcctactcgataaccttccagcatcactatatgcagcccttcctattgttactgagg

SEQ ID NO: 729 - DNA, 1000 bp, mus musculus
tttacttattttccttgatcaacattagactctattaaagtctttgaacattgagagctaaggagttatctccataaatagagtgcttgccatataatcctggctgcttgtatttggatgcccagtttttacccaaagccaggtgacatggaacttgcacgaaatcctagagcatttgagaaagatgtctgatatcaacttctgacctccatacctctgcatatagctgcatgtacacatgcatacacatgaatatgtatacatatctctctgggtattaaactaattctgaatatggataacatatgtataaataaatgatttccattctatagataaatttatcctatatataaaataataaagaagaggaactaatagacattcctcagagacatcctttgataaccaaatccaagcctttgactgaaaaatttcctcattggtttagattgagtgaatgaactaattactttgtaatttgttctgctgggaagttccactgatgtaaagagcaaagagaaatgctactaaccttgctgccaagaaaaagacaaaggaacataagaggcatctaattttttcttctattttcaacactttttcttgaggtatttgaaaactctcttttaacaggtatagtagaaatgacttctcaattcatcaaactactgtaatagtggaccccactgaaatggaaattgcccccaaagttcttagacttgggagaaggaaaagctgcagccagaaaggcgacttgcctctcagaaagagctttccaatagtattaaccacctgtcagagcacctgacaggctaagactgaagtccaggcaaggatgggtcagtattggacaagaccacaatttaaacaggactgcttggatctgcatcttcttgctcctatatttaaatgttaatctcacctcaggacctgaagattgacttggggaagaagctgaaattctttgtccctcttcccagtatggtcttattgaata

SEQ ID NO: 730 - DNA, 1000 bp, mus musculus
tacatccactttggaggcacagaaaatcacatcctggggaacaaattatataatgtgctagatggtaaagactatcagaaaaaatacaaaaataaaattaaaaagtaaaaaccagaagtgttgaggactgagcttctggggaaagaaggataggaaggaaggaagatgtgatgtgagacacggaagaccaggagggaatcagctccataaaagcacaagaaagagtgaccaagccagctgagtcagtcaccagggcatcaagggagggagtgaggactggtaaagaaaaacaactagacaaaattatagcaggacttcagcccacactgagactgaagcagctgtagttctctccagcctgcttttatatcattctaggtatatccaaaaaaacatggttagttcttagatcaaagacaaagtaatcaaagcaaagtagtaaacagagggatcacacaagaaagtaatcaagtaaagaagtaagcaaagagatcacataaggaagtaattcagcaaagtagcaagcaaagccccatagtcaccattcctaatattcttatccaagcctacttccttgtctgagcccagtgacaaatgccaaattcctagaagtggcacccaaagctctcaacaaaagagttttctaggaagtaggagacagaacaaaccattgttcagagacatcaaggaatccagtgtcacggatgtgactggaacagtgggagacaacaggagctgattgacaggagtcagcttttgtccgttaacactggaaccttagatttttcctttgacatccatggatgagcatggctgaattctttaccttcgttctgaagttgagacagggaaagaaactgaaaccttctcaaggaaggctggattttctcttcagtgggaaagcatggcctggggtcccagactggtcctgttggtggtggttaagtgaaagagcaggttaccataaccaggtacctgttattttcaaagcagaatgtgt

SEQ ID NO: 731 - DNA, 1200 bp, mus musculus
ttaaagatgataataactacagctactagaaagtctttagtagtaattatttgttaagctggttttatagtcctcacatgaaataccttcagtgcccacagagtgccaaaagagtccaaattctctcattctttccatgttccaatgagtgggaaatagtaggcaatgtctgttgatcagcaatgacttatcaccaggtactaagtgttgcaacataaagttggtgatgctatggcacatgttcttcacttactctgtgtatttaattcaaccagacctagagctctcataagtctgtttgtgctatgtacccaagataacagcagttagaagaattagaactgcaactagggaaagtgtgtatttcattttcattatttgcattttttgtctcagctaggcacttgaattaaaattctatcaccttgagacattggaggctgccacagaacaaagcacacttcaaatataccaattattgaggtcattggatggttaatgagtcatagcttgggggaatagcatatggtcagaaagagactatatgttaggatatttgtgttaaagtagagctggctgaaaaacactagaaaagggaaacttactagtgataatggttgaattggtaggaataggatattaaacacatttttaggttattttaaagatttattaggagcttaacatgtggaaaagtagaatttcaagtgccggttctttatgcaaatcaccaaaacctaagagatgttggcatactatcatctgaagaatgatgtgagagaaatggagataactggtccaggatctctgtaaatctgtaagctatgggtatttcaatagtagtacagtcctccactatccaaaggagccaccttagccaatgagagtcagacagacaagtggcagagtcatgcagaggaatggataagactggactttgatatgtagcatctggttatctgatcgttcaccatctgtatttttttcattgccatgaagctcacttggatcattattgcacaagtttaatgtggttaaaataaacttcttgggagataggtaaggaatttgtgaagaagttcctgttgtgtcagggttttctttccttgaactggagtgaatgagattcttctagagacaaacatctcaaaaaggatgctatacacaccttttccccataatttctcataattacttaca

SEQ ID NO: 732 - DNA, 1000 bp, mus musculus
gcaaagacaaatgtatgtatgtgtatgtatgtgtgcatatatatatattcagtttttctatttctgtactgtcttcagtgaatttttgtgtttgcccacatgcatgcatgtgtgcacatgtgtgtgtgtgagcacacatatgcatgtgtgtgcaaccactaaaataacacaaagcaatagatgatattgggaagcctttcttggcgtggccatatttcatggctgatcctccctgaagatgctgtgatagtctacccagatcttcccttcagggctaaataattcagccacttggttatcctgagacaatccaaatgtttctagcagcagaaagctgtcaccagcctttcaaggctaagaacacaggtgatagtgtgtatctatgtattcaaaaccaggctcatcagacagaaacctggataaaagatgaggggcctattgttgtcttagttagggtttcatagctgtgagtagacaccatgaccaaagcaagtctaataaaggacaacatttaattgaggctgacttacaggttcagaggttcagtccagcatctaggcaggcatggtacaggcagagctgagactttcacatcttcatctgaaggctaatagtggaatattgacttccagacagctaggattagggtcttaagcgtatgcccacagtgaccaacctacatcaacaaagccatacctccctgggccaagcatatacaaacctttgccatcataacaagtaaaacgtcagaagcatggccattggcaaagatatttcagagtcagaagagcagtagaaagacccaaacttttttctgactcttaactaccagccttctctttgtgatacccactgaccaaatgtcaaaggaacctacagagctacagtgggcaagggaccaacatgtgttgtcccctggtatggagcaaagcaaggaatatagctggggctggggggaaacattcaaattccagagcaaatagaagcaactaaaagtgaa

SEQ ID NO: 733 - DNA, 1000 bp, mus musculus
acttaaggttgggtaattaataaaaaatgtttagttagcccacagtttgaggcctatggttcaaagttgggcatttctatttgtactccggttatgaccttcaaaatggcacgggaaagagatcaaacggggagacaaggtcttgtagaaactgtcaggaagcctcaagaatacatgatcccttctgccataccccgcatccctatcactttcaagtcagctctacctcttaaaagagtgcactgtgtcatcgcctcattggggatcaccatgtgaacctttgggggatgcagatgctgtgcaccaactgttcagcaggtgaacattggtcacaagaatctactctggcaagagaaaagctgtgctttgtagtaatctgacctgcatcaaaactgctctaaaggggactctgctagatcagggtaggtacctaatttacaccacctcgacttctgtatctgtaaaagtggagaataggagagtagaatattgcaggggcttcactggagcgtgtgatagccaagcacataggtgataaaaaggaggcaccagcaggcagcagctgccaggaaacacagctgcagagcactcaggtgaacgcctatttatctttcctgaaagacaggcgtgaggtttccctttcacaggagtcagccaacttggaaacttctcaccaagagatcaagcagctggtgacaccctcagaacccaaactataactgtttggaattagtgtttcctccccctcccccaccctaatttccctctctaatttcctcactcctcccggcctttggattccagagagatggaacagagctgaccatggtagatactctcattgatcatctggggagagaatacatgcagggcaccaggcttgagctgaggtgggaagagatcaaagaaacatgacagcgatgtgctgtaggtactcctagccagctgcaaaggatgtcttgggaagtaggtataatgtctgtgtgatccatggattggg

SEQ ID NO: 734 - DNA, 1600 bp, mus musculus
gaccatcctcggagtacatcctccattagtggattttttctcaattacctcctgtgagcttctgctacatccactccagtagtgacccacgtgacaggcctagaaacctggacatagtcccgaggtgaaaagttcacaaaaacttagtctcctgggaccgtggcatcccatataacgaatgctccaaatctgtccttgctttagttattaaatgtatctgtgtgctttccctcaatattgctttattatcctcaatattgctttattataagtttctctaaggattgattttgacatatagctaagttagatttttcaccagtcctaggcagtccttgagctgatcctgagcatagatagctgagtcactgccctacacaagaatttacaatgacctaggaagaaggaaggttgtggtctaaggaggaactagagtaaacacttagaactatagataactgagtcacacccatacacaggaatttacaatgcctagggggaaggtggactatacaatagagtagaattggaactattctaagattaagctgataggtggggctgcttttgatcccagttgttaacattgaattttatcccagttggttcctgttagcttttaagtatgcatttgtctgtttgtgtaaaagtcacttaaaagactgatgctcactttgatagaaatacattcagatatagcacactcccttgtgtctgaatttgttagtcatttctcaccgactcctgcccacctgacctggaccctgatttctcctgcggattgaggtgggctgaatgaagccagtctgcagcaagcttcatcactggatgtgtgactatggcagccataccttcactctactgttgacagaatcatgatagataaaattacaaaaaatagttcaaagtgtggcacagagcctccagaaatcacttggaaaaacctcaatgctctatccaaagtggatatacataatcattccacaaaattagattgccatcccttccagaataagtgtaccagttttccacttgttcttgtaggcaaataagtgagatctttcataaaatgccagtgatggacaacctaaggacagctaagctgccacatcagaggaacatgtttccagtagtaaataaaatttgaagaggaaataaaaagcaggcagtacagtctcatgttttagccagcattcttaacacaatggttcataatgataatgatgatcatgtgagttgattcaagccctgctagatacaatgcttcttttatacccagctatttaagattcttcatatcactgaggcttctttgctgcacttcaaccagcattcaaacacaacactgtgcagggacatttcccaggaaaactataggactacagagaagaattagtttcttagttaaattaatttgtctgtttcagtgttgagtattcattttgaataaacattcagctatccagattcaaagtgtaatctccctactgatcctatttcttgttatgtaatagcttatgcacttcttagataaaaggcctatattctaattactatgcaataaagctaatacttaactaatcaatataaatattaaagt

SEQ ID NO: 735 - DNA, 1400 bp, mus musculus
ctaatctgagcatcaaatttaggaaatctgaagtcagtttaagttctatctttaaaaaaaaaagtagcaagcagaatagtgacaataggcggtattgcaccagaaataccagaagtaccagaagtaagaattgccctaccagagacttcacaatgtattatactcacaccaaacaattgctatacagccactagatctgctttgcgggagaagtgttgaacaatcctacccccatcttccagctcagccctaggtgctgtcaaaatccctcctgtctgtctggtaaagaccaatggtgccaatgtggttgccttctttatatactagccaactttgggcttagctagctatgaatctcgcttgctattttcttctcataataacttgttcaaggttccaattcttgccagacagcttgtcccagagagtgggaagaagctaagattacatactcagctccagctactaaaccaagggagcatctcgccatttatttaccccattcataaaaatgggggctttgcctcatcaatgtgcaaggcagcagacacaaggcacacacatccctcccaccttctttctctttcaggatctttgtcctggcagctgctcttgcaggcttcttcctgtccttcaggtttcagctcctctgaccacatctaatgcccattctccctcaagtcatccatcaccacctttcccttcctgccctaactcatcactttcccacaattacctggaagcctattttttcccctcatttaacatgcaccctgagcattcttcaagtcctggtctgccagtgaagagggactttgactgtccggttgctcaattctgtcaccagagaaatgcactataatcacaactccataaatgaaagcatattccttgcccccacttattactgatgtagctgcagctgcacacacctcacaggtgcctggcttaatacccagagcagctgctgcctctagccaccagctagctcttttctaggtcgtcctctgtattattcatttggtcgaatgagactccactccaggcaccagccctgatttttctctcttcctaaccagtcccatctcagcaccctcagcaccgagagatgagaaagtgaggaagagggggagggttcatttacacgatatgcctactttcaagaaggcacagattgatcagcagggttaagggaaaagagaaaacttgcaggtaggttctccagaagggtctaaaagaaacaccatcaagaagtcatgtgtggaagtggatgctcacagtcacctaatggatggatcacaggtctcccaatggaggagctagagaaagtacccaaggagctaaagggatctgcaaccctataggtggaacaacattatgaactaaccagtaccccggag

SEQ ID NO: 736 - DNA, 1000 bp, mus musculus
tactagaagggatgggtggggctggacaggaaggaggcacaattgagaatgcttgagtctcacttggaaggggaaatggaatgatcatggaaggcagatggagggagggaccttggagggatagggaaccaggagggtactcacagatttcagggtcagatgtcgggaggggtgggggatggccagatgaccaagagaatgaatggaaatctgcaactgatggggtggggaggtatggtatctccaggaatagatggagacctgggaataggaggcacccaagaatgagttgggtgtcattagttgtcactcacagcattggggatacggagcccaggaggctgcctcctgtggccaggcagggacctagtggattgatagggacaccaccttacctacaaaactttccacccaaagcttatactgtttacgacaaatgcagggattggggatggagtagagattgaaagaatgaccaaccaataactggaccaacctgagacccatctcatgggccagcaccagtccctaacactattaattatccttgcagacagaaatctagcatagctgtgctctgagaggctccacctaccaattgactcagacagatgtagacacccacagccaaacagtggacagagcttagggactcttatggaagaataggaggaaagatcacagccactaaggagaactccatagcaagaccaacagaatcaactaacctggacttttgggtctctcagagagtgaaccaccaaccaaacatacacggactggacctaggcctccccacacatatgtagcagatgtgcaggttggtcttcatgtgggtcccgaacaaatggagaagcggctatcccaaaaaactgttgtctgttcgtgagatatgttttcctagctgagtttccttgtctgacttcagtgggagaggatgagcctagcctcaaggaaacttgatgttccagggtgggagagggggagacacctgctcaga

SEQ ID NO: 737 - DNA, 1400 bp, mus musculus
tgcttcatgtgtgcagaaggtgtgatctctcagcttccaacacctgcctccatacatgttgtttagagccaaatgttctttccacagaagtgtctaatatctctggatcactaagtccaaattaactctctctttcttaagtcactttgggtgacagtatcataacaacagaaatataaccaaaacagaagtcagtaccaagagtaggaacagaacctgactgtatagtttttctgaagtaagtggaagaccttgacactttggactagaaaagtgttttgatgctttgagcaaaattatcagaccattctgataggaacctaaaacatagtagtgctgagagcaaagtgcactgaagactaccagctcaagaggtttaagatttgaacaatattaacaattaagctagaggccattcctgtgctgttttattaaataatttggctaccatctacccctgtccaaagaacttggctgaagataaagaggaaatggggcctacacattacagcctgtgtgcctcccaggagatcctcagtaaccaaagacacaggtgaaaatcttgcccaaatatgcacaccagctgggataaccagggacccagctgatatgggacagaccccctccccatcccctgagctccacttttcttctgatctgctttctacttgagtcagatcagctgactgatacctgcccacacactgaagcctgcatgccacccaggaggtcctcagtaatcaaacacagatccaaggtgatatagaacccacccaccctgcctaggtctgccttcctctggacctcttttccacccaggccatatcagcacccatacccttcccagacctacagcctatctgcctctcaggaggtcttcagtaaccagggacatagaagaccagttctaaccaaagtcaaaagaggcccaacctaaccagagacagtattgcctgcttccaaggagacaagctctacctgcctccaaagaggatggctccagtcagaggaacacaaaccatttaacatcagaaccagagtgccagaggcaagcacaagatcataagtgacaaaacctgatgcaatttggaaccatcagaactgagttctatcaccacaatatgccctggataccccaacacacctgaaaagtaagataataacataaaatccaatctcatgaagatgatagttgccttgaaggaagattaaaaagaactcccttaaagaaataaaggaaaacacaataaagcaggtagaagtccttaaagaagaaacaaataaaacatttaaagaaatacaggaaaatacaataaagcaggtaaaaaaaatttgaacaaaatgttccaagaactaaaattggaaatagaaacaataaagaaaatatacatggaagcaag

SEQ ID NO: 738 - DNA, 1400 bp, mus musculus
atacgggttatacttttgaaatatatagaaaagtctgagctggaagcctagaaaacttagtacatttacactgttgtcgttccgcttaaagtgggttgtattcattgtatttagtctttttctcaactggcaataacatagagttcaattaaaacatgtcttttgtcagaataacctaatcctatctatcctctttcctatgctcacattgtctttagcacctaataatcactaagcctttctccatttccatttacttgtgattttatatacattatctaagttgaatcattacatattgtatgcagtacttttgaattatcttttttcccagaacaattcccttaataaatcaatgtaattctgtaagtataaacagttctcttttatcattgattgaaatgtaatcaacatggatgctccatatagcaatcaaaatggcagtcattaagaaaacaaatatcagctcttctgaagacaccacagtctgaaggtctcccatgaggtttgctgcatgcagggaaactgaccccacaatctgaaggcttcctaggagttctgctgtacacagagcaatagaacccaaagactgaaggcctcccaggagaccagctacatgcagggtaatagcttgactactactctgaagacccaagagtcagaatgcctcccaggatatctgctgtagctagggcaacagatcagcagctcgtctgcttacctgaacaccccatagtctaaaggcctcccatgagagcatctgcagccaggccaagtcaccagtgaaaatgatcctctgaagacaccacaatctaaaggcttgacaggaggtctgctacagccagggccacaggcctcccaggagaactgcagcaacccagggaaacaagaggcagtctccagacagagacattcagaccagctaacacaagaaataaccagatggcaaaaggcaagtacagaaccataagcaacaaaagccaatgtactttggcatcatcagaacccagacctccctacactgcatgccgtggatataccaacacaactgaaaagcaggaaactaaccaaaaatcctatctcatgaagatagtagagttctttaaggaggatataaataactcactgaaagaaatacagggaaacacaggaaaacaggtagaagctcttaaagaagaaacaaatatatcccttacagaaatatagaaaaacacaatccaacaggtaaagaattgaacaaagcagtccaagacctacaagtggaactagaaacaatagagaaaacacaaatggagaaaactgttgaaatggacaacttaggaaagaggtcagaatacatgagatcaaagagaaaatctcaggtatagaagataccaaagcaggagtgggtaggctggtga

SEQ ID NO: 739 - DNA, 1600 bp, mus musculus
acgtcaccatttgtgtggctcccttaacacaaggccttcacaaagatcattctgtagttggtgcccaggatactagaccttccttgttgggcagagtgctgagcttaaaggagcaataaatttgattatgctcaatagctactgaattccttagtcacagctcaagatccaacctctggcattgtgccttccctggggtcagtaagggatgagccctgaatatttttcccaacaggaaggtagaatttgggagtcgctggctattattccttactgtgagatgccatttctgtagcttatttgggtgctagcctgccctggttttaacaatgttcctgccttgacggacagtgtgtggctctctgggtctcagatctgacttataatgaaagcggactgtgtcctctgggcaatgcactttcaggagttgctatttgcatggcctgctggccaccgagattgcaaaatgatcattagttgatcccggaggctacttgtcttgtcctggggacagtgcatggcctccaccccatgggcatagattctgcagagcagagcagagcagtatgtgagccgaccactaggaacctgactagccctgagttctagtgtgcattcaacctttaggatactaagcaagctgtgtgcttggaatttattcagcccctgggtgttgggtctgtcttctggtctgatttgtacactcctgtttattaggtttgctctggtgcagcattgaggaaaactcctgggtccttgatttggccccgaggccagcatgctgttgggactctcagtcctgggtctggcttcaagtcagcaaatgatcagcccctggtcactgggcttgcctgctgagctgtacctttaggtgctggagacctgatagtgttttgaggtgtgggtgtggtgcagtttaaaactccactcaatatttggccacaggataaactgtaattgagtccctggttattggacatacactgggctgaaacatgtgttctgggcctagtctgagatcaacaatgtgtcacgttcctgggtactagtcctgtactgtgagcaatgtataagatgtcttcttgagtactgcccttacattgtgtagcataagatcattcccctgggtactgagtcagaactgggaagaagtacaaagaaacctcatgggtactttctgcccttaaaacaacagcctatgggcaggcccctgagaacacgacatgccttaggctcaatattttgggtcctggccgggcaggaggtcagcactcaagcaacccgctgaatcttggtctttccctggtcctgccatattgcttgctgcctgggatgcgggccttcccagaaccagttagtcaccttatgtatgtgtgcactgcttagtttctgtcaacctaacactagctggggttacttggtaacagaggaaacactttttcaaaattgtctccgacagactgacccatggacaagtctgagctgcattttcttcattaataacgtgatgtgggaaggccccgccaaaagtggtcagtgtagcctttacgtagatgatcttgaattgaacaaattatctgactgctagcaaggactacat

SEQ ID NO: 740 - DNA, 1600 bp, mus musculus
tgggcaggggagtgggggtgggtggatatgggggacttttggtatagcattggaaatgtaaatgagctaaataccttttaaaaattgggaaaaaaaaaagatcatctacgtaaaggctacactgaccacttttggcggggccttcccacatcacgttattaatgaagaaaatgcagctcagacttgtccatgggtcagtctgtcggagacaatttttaaaaagtgtttcctctgttaccaagtaaccccagctagtgttaggttgacagaaactaagcagtgcacacatacataaggtgactaactggttctgggaaggcccgcatcccaggcagcaagcaatatggcaggaccagggaaagaccaagattcagcgggttgcttgagtgctgacctcctgcccggccaggacccagagtattgagcctaaggcatgtcgtgttctcaggggcctgccataggctgttgttttaagggcagaaagtacccatgaggtttctttgtacttcttcccagttctgactcagtacccaggggaatgatcttatgctacacaatgtaagggcagtactcaagatgacatcttatacattgctcacagtacaggactagtacccaggaacgtgacacattgttgatctcagactaggcccagaacacatgtttcagcccagtgtatgtccaataaccagggactcaattacagtttatcctgtggccaaatattgagtggagttttaaactgcaccacacccacacctcaaaacactatcaggtctccagcacctaaaggtacagctcagcaggcaagcccagtgaccaggggctgatcatttgctgacttgaagccagacccaggactgagagtcccaacagcatgctggcctcggggccaaatcaaggacccaggagttttcctcaatgctgcaccagagcaaacctaataaacaggagtgtacaaatcaaactgtaagacagacccaacacccaggggctgaataaattccaagcacacggcttgcttagtatcctaaaggttgaatgcacactagaactcagggctagtcaggttcctagtggtcggctcacatactgctctgctctgctctgcagaatctatgcccatggggtggaggccatgcactgtccccaggacaagacaagtagcctccgggatcaactaatgatcattttgcaatctcggtggccaggaggccatgcaaatagcaactcctgaaagtgcattgcccagaggacacagtccgctttcattataagtcagatctgagacccagagagccacacactgtccgtcaaggcaggagcattgttaaaaccagggcaggctagcacccagataagctacagaaatggcatctcacagtaaggaataatagccagcgactcccaaattctaccttcctgttgggaaaaatattcagggttcatcccttactgaccccagggaaggcacaatgccagaggttagatcatgagctgtgaccaagcaattcagtagctattgagcataatcaaatttattgctcctttaagctcagcactctgcccaacagggaaggtctagtatcctgggcaccaa

SEQ ID NO: 741 - DNA, 1200 bp, mus musculus
agacagaaagagagaaaaagaaagaaagagagagaaagaaagaaagaaagaaagaaagaaagaaagaaagaggaaggaaggaaggaaggaaggaaggaaggaaggaaagaaagaaagagagagagagagagagagagagagagagagagagagaaagaaagaaagaaagaaagaaagaaagaaagaaagaaagaaagaaagaaagaaaagaaagacaagctctggagtcaaccagtgtgcagagaactgatacagaacagtaccaaattcctcacaacaccaagaggatcttccagatggcacctgctggctgtgcctcctcaggaagagacacaagcttgtttagattttcttttaaacagtgatttggttgcaggaagccagggctcctgtcatcttggaagcctctccatctctagttcacatggcagtgcaaagcatcccttgtgccctaaagaaatctctgccatctcaacaggatatgaatggctgggcagaaatacaagctgtgggttacccagatttcaggctacaaaaacacagtgttttttgaacagaagtcagggccctggtgaacatctccatacccaattataaaaagattttgaaaacactgagataggacaactgcagaaggagttagaactcatatgaattgttccaaaccgagtcctttaacaaggtggctaccctacctccacatgtctattgaggaagaatatatttgggctttcaaatccaggaggtgcaacctgtcacaaaagtaccaagcattctaagcaggagggtcaggagttcttagccagcctaggctacatagcaagaccttgtctcataaaaaataaaggagagaattgtgcttaaattgagtagacttgaaggacattttgctaagaaaataatctacaaaacagaccaatgttgcctaattgaagcctaaaacacaaatctccactactgataaacaatagcatgatggagaaatgtttgcaggatgcattctaggcagtatgtaggaggaagagggcaaatatgtaatgcacaggatgaacaccacagtgcatcatgaagattagtgtgctctcaccgctggaagaatggtgcatttggaagacagacatgttaccttgttccagcatccagacgtttatacagatataaaataggacaccgtaacacacagttcaaacacagaaagtt

SEQ ID NO: 742 - DNA, 1200 bp, mus musculus
acagaagacagggaggcagtcacgcccctgccagcctcctctggtcacactgaggtcctggcagccacttctctaagcccagtccctcctagatcaggggagtcttcggagtccaggggtttcattagagatcagtcccccgtgattcttaagtatatccatctccctgaagagagtccagtgcacaaggacccgcaaggtgagcgcaaagcacctccagtggccagcaagaagcccagagttgtccctgaaggaaccgaggggcctgccctcctggggttggtgctcccttcaggaaagctggagacttcactccaggatagggaccaaggaggttcccaggaagacgttagcaagacctcagtggctaacaaaattcggatatttgagacccatggagccgagccttgcagagccagtcagggtgaagtgaggacccttccacatgagccgccttcggaagcgtccccaggacaggtggaggagcgcagtaagcctcgggacttgggctttgtccaactccagcctcctggggacttggccagccccaaagttacctgttcttctgtcatgcctctggctacccagcactatggggaggccaccccaactacctcccaccaggaaagatgcacagacccagagctcgtgtcccctgactcaggctgtgaaaccacgctggaggaagctactggggtaactggccacgtgagccctgcacccactaagttcccctttgtggaggctgagcgcatgctccgtggcaccttagaagcatgcctcagcggccctcgccattcctgcaatgacactgcttggtcatccttagaaggtctcctcctacatgggcctgagatagccgctgagagatggggtcatctgctcagcccttgttagcgcgttagagtccccaggctttgctgcgaccttatgtatgttcagaggatcgcacagtggccgcagagaaggagccaccaccagcagcagcagcagcagattacatacctgctttgccttgcccctcccacctgctggactcctcctgtcatgcttggcttatacagtggtcatactccacccttccccacccctgaatcccaccttgtagaagctgacagttcagaggtctcctccactctgcttccctctccaccttccttctacctccttaagactaactgtcttctctaatccagagca

SEQ ID NO: 743 - DNA, 1200 bp, mus musculus; identical to SEQ ID NO: 742

SEQ ID NO: 744 - DNA, 1000 bp, mus musculus
tccctgaaaaaaaaggaccatacttggccgggtgaaagccagccttccaccagacacagcaggggcctctgggacaagagggggtcggagagctgggaaacgctgaaggctccgcccttcttgccagtcttgacacctcaatctgcttccatgccccagcctgggccgacccagagaaaggctgcgtcgaggggggctattccaggggcaccccagcttctcagcctgcaagcagaggcctaataaggccgggctggctgcctcagccccgcccccaccccacccccgcgcattcttctgccttgtaaggccgggcggcctgcggaccctccagccccggctccgcccccagagctccgagcatcgagcatcggtcggagctgctgccagccaactctcgaagcaccgcaacagcgccgaggacttttcttctctgcagcaggtgggagcccactcagcacccgggcagctacagtaggtggtcaggctgaacctcacccggccttctgagggctgtggcatgcttagtggtgtgggctggggctactgccttgcttgggtcctaaaggggaccctggcctgggactgagcaactggtggttctgcgccccggaaaactggtctttgggcaaggaaacaaggatccagagtgtccttttgctaaagagcctaacacaccaagcctggaaactccaggctacctgcctgtagagatgccagtgagggggttgagggcatccctgacccaagaaactgtgtgtggcagaggaaattgagccctacggaagcacagcgctcacacccagttttgcaaaccctaccccaggagggatggtaaccacctcatgccttccttatctccagtgctgtgtgcactagagaacggtgggatgagggggtcttggcttcttcacaaccctccagccgccctggttgcttgatgagccggttggaaagcagggtatctggcacagccagctatggagactagtaatgagga

SEQ ID NO: 745 - DNA, 1400 bp, mus musculus
atgcgctgggccttctaggtagggtcctgcagttttgagaggtgatgggtctactgggctgtttgtggggcgtgcctgtacagcctattgtcttcctgtggccaatgttcctcactaccacgtggtggcgctgttgaacacctgacccaaaaagctgatggttcgtgtcattgtgcctcagcaagaaacagaccaggatatgcagctctagtgtaattagcacacctcatgatctccaggccctggtgtggaagacatcagttccaggctctccaggactggtgttggatctcactgagggctttgagctgtgtcctttctcaagacgtctggtgagactgcccaagactgttagatgggttttgcaggtatcaagtgggccccgaggcctctctgggctgggatttcattcaggcctaagtgcactctgtctccctcattctgtgactcctataggtatttcagattgtgtcacagccaatcacaagcccacctatagcaaagctggggttcctacacatcttccctcagcccatgagcctccacttctttccagatgtcagagctgtctggggagtttcagcatgtataaagtagattttctgcattcagttgcctaggtcacacactaattaaaaggcaccaaggctgaggaaacaaaacttcttcttctcatttgtcagccagtaaggtgcacctatttctatttgtggcggctagtggaggacccggcttaggaccagagggcatccagagggaataaaagggagagagtaatggaaatgagagatgaggctggtctgctctcaaaagctatgggaagcccttggagggttttgagcacaagaaggacacttccagggctgcagagatggctcagccactgagaatgctcgctgctcttgcagaggaccagaattcggttcccatgaggtagctcacatcctccagcaactgtgactgcaggcgattggatgccctcctcggacctctgtgggtacccgcatgcatgtgcaaatgccccaatacagacttacacatcgttgtttttttttttttttttttttttaagacacgatccaactcatttttgtaagtctatcctgggatgctctctaggaacatctgctgcacatagagaaagggccctccacccccgcaccctctctcccatcatttttgtgattcattaactttctggccactttccaacacacatggcaaccccgctctgccctctgaaaaaacaaacagtcacttctgggccctaaatggacaggcagagccacagttcctcccccaaaacatcccctctctactgttcagaaaagacagcaacatggggtctggtttggggcgtgtgtggctgtctgagccatttctcctccaggtggggcctc

SEQ ID NO: 746 - DNA, 1200 bp, mus musculus
atcaattccattgatcaacttatctgtttttgtgctactcccatgcagtttttattactattgctctacagtacaacatggaatcagagatggtgatacctctggaagttctattattgtacaggattgttttagatatcctgtttttaaatacgaatttgagtagtatttcaagttctgttggaccgtgaaaggcagcctgtgttttggttgagcgaagcttactctggagacccagcagaaaactctacaaggggtggaacagtgagccacgttcccagacataggcgcctaacaccacggagcccccaactccataatcctgtgactatcagtcacataggcaatctcccaagctcctggcactctggctagactccaccctcacagttaacctgacaatagccaggtatgctttttccccacagttacctggcaacaacaaggtagcccagcttgttctcctactctcattcctccctccttctccccttccctccctctctcctcatggccatggccggcctctctttttctaccttctctctttctctctgcctttctacaataaagctctaaaaccatggacagtctctgctcatcaagacccaccatgcttgaatgatggaataggcctttccctaaagagccgagtctaatctcctgagagaaggcttcccagcatttctagccaccagaccggaccaaggactcttgctggcacggagtccacccagcacccttctccctttggccccaggggcagacaaagctgaccccggattgctccctctctacccctgtggactggggttctgtggcttcccacagccagatagatgcctacccaggccacatggagagtgcatggctgtcccccacatccacctgcccagagccctggagctctggcaggatgtggttccccccaacccccactttatttccctgtgccttctttctgacaaagttctataacgacttgtgttgtaattttgataggaattgcattaaatctgtaggttgcctttggaaagatggccatttttactatgttaatccttctgatcaataagcacgggggatctttcaatcttttaattatttatcttcaatttttcttcaaagattcaaagttcttgtcatataggtattccgcttgcttggtgaaaaagttagaagggttactgattttgtttt

SEQ ID NO: 747 - DNA, 1000 bp, mus musculus
atatcttcaagaccatatgtagtccggaaataacattgtaagaaaaaatgggagccgggcggtggtagcgcacgcctttaatctgagcacttgggaggcagaaggcaggcggatttctgagtttgaagccagcctggtctacaaagtgagttccaggacagccagggttatacagagaaaccctgtctcaaaaaaaaaaaaatgtaaaccgaatcttacctgtaaccattgtacaaggcaaaatgatgatttgagtctaagcatttggaattcagagtttcacatgctattcctatgtattcctgagcgaccagtactctgtattttgatctacttgtatctttaaatttaagtagtactgaacctatgcatatattaaagtgtttgttaaatcaatatgtagaaaattgacaccagaattgaaactttcgaccaccaggaatattatagaaggtttttgcttgacaaacaatatttgcaattaaaagtcaaaaagttaaaccacaaagtggtgtgtctgtgtaagcgatgagatttattttgtgtatttaagatgagggttcacactgatagaatttatttcttggcccattagtttttccgcacatcagagcaaaggactacaatgcacccaagataagataaaagggaggcagcaaaggtgcatggttaagaagatataatcgagagctgagctggatggatacgatcttggtaccaccatccactcagaaacccactcggtgccccattgtgtggacagttttgtagtgaaagagatgaaatattttccactaattatttggcatattttatttgtcatgacatattttgtttgtcatgttctcctatgagccagaacatgaacactgtgaaaaagcctgcttggatatagggagacagactcgggcccagtgactgtccagttttaagtagcaacagcttcagggttatgggtgcaaagctaatgccgcagaagtgcacagaagtgagctctcca

SEQ ID NO: 748 - DNA, 1400 bp, mus musculus
aagacagaaattcagaacttgactcacatattatgtaagaatatgttggcaagaataaatcatacatgatctaggattaggcactaaacagttaactaacagtatgcctgtgtatataagactataaacagaagagagacagaaagaggaagagtaggaaatggagagtgagatgggggagggtcaaatggaaggaaggagttgcttcagagtggcaaaggggtgactgattttttaattttatcttttcttattaatttttaaggttcatttagtgcaacaaatatttattgagccactactgcacagcaagctgatggtagaagagtgtataaagaggtcccttttttcaaagaccttatggtttaattactagaaagttgtttattggcaataaaatgcaagggagaataaaatctaaaatgatccaagtttttaatggggattaactcatcaacaagcttgacctttactgaggctaagtctcagtattgcaatcccttcccacggtggaagtactggagctaggcatggcaattctcctgccctccaggcagagggaactaggaagggcttgctgtaagctctttgcctccagaagccaagataaggaaggtaaagaaatcatggcgtgctgaggttgctgccacaggactgtggctcctaagaccctggcctgcatctgggtcacctccctcctaggcagctgaagggttagccttggaggtaaagatgtaaagatggctggccttcagttagtaaaggacccaataacgtcttgctggaagtgcaaattggatggtgttccattccaacccattatgtcatggcagtggcttcccgttactcttggcagaaggcagaagccctcaggagttcctgcaaagtcttgcactgatgctgtctacttgtctcaggactcttcctgtctcctgggagacaaacatataccccatgaatcctcttcccttgtcttccaacatgcattttcccttaactggaataaccttccatccctgccttcatttctttataaaagcattcaattttcaaaacaaagcacaaacatcactgccttggatgtgtgttccaggatatataactgttcattaattacttccacttcatctacactatttagtcttatccatactagtttaacatagctataatgtaattcatttgattaacatctgcctctcccatgacagcatagacagtgtcttttacattcccttctcttctttccttcttttcattgattacttttgatcctagagttgtgtgaggcaccaagtagatcattaatacgattggtgggtgagctcagtagaccaggtttcctagagttccactggggaaggaaaactgattagaaccccagggtgagtacatagggt

SEQ ID NO: 749 - DNA, 1200 bp, mus musculus
gggaggggaggggaggggaggggaggggaggggaggggaggtaaggtaagggaagggaagggaagggaaagaaaagaaaagaaaagaaaagaaaagaaaagaaaagaaaagaaaagaaaagaaaagaaaagaaaagaaaagaaaagaaaagggctgcagcccccaatagaagccttcccttgtttagacatctgcaagagcaatgtatagagcagaggagagggccttttatttatgcattttcttgtgtatttatttattctgtcaaaagcattttcaaacttgtcactttaaccctaaggaatttttcatccattttggaatttcaatcaccatgtcactgagtggcgaagatgatatagggggagcccggctgctttgagcagcataaatcccatggccttggcctccaggtaagctagttccctggtgacctcctgccaaaaacattcaaccaaaggatgctggactctggccctgagatggcattcttgtgaacgatgcttatctgaatgatggcttgcttcctgtccttgagtcacgattaaaatctaataaaacaggctcttttcagggtctctaacttccagtgtggcaaataaaacctaaaaatccacctggccctgacactaggctgtgaagcaaataaatgcttgagagcagcagctgtgcccagcacttgcctgtttgttctcaggcatgctcctttgcctggctccatatgcataaggcagcatatggcaaattatagtctccccagtcccccagaactggcttctaattgggaaaggaaagaaaggaaaacaccagagactatcaccagctttcttcctttccagccactgactgccatactttcatggctcctacctgtgcacagtgacctatgtgccttggttcccgggccctgttagctctgcctcattcctttagagggtgtcacatctaagtgagtgatatcacatccctggcattctggcaccaagattcatgtagttaccaccatttttgtcttgttgatcttgttattttcatgtactttaaagttgttatgatcccttcaatgcaaagatttttcctgatctgttcttcttcgtcatagtgtagctgggtatttttctcactcatttctccagccatgaagtcaatggagcttggatctgagttgtgtaaggcaatacttagcttcccaaaatgtcc

SEQ ID NO: 750 - DNA, 1000 bp, mus musculus
tttgaacacctttcccctctggctggagaggtcagcacttggatccagtgagcccacagccttgtagttaatctgtgtgacaaaatgatatacaagcacataaatgtcctactcactaaccaagagaactcactagagaggggcagcaggggcaggatggagaagagaggtaagctaagccactatgtgacagagctgctttgtaccatccatagtacacacaaccacagccctgagttttctaccaacaagcccatggaacaaccatgtctaacccaatcagaacatgataccttaagctagagtttacagagagggcagctgtagaggagttacaccaagggagaggagacagtagcacaaaggtaaaattatgggtgggtagggaggatgctggagctggaggtgggaagctttaatcaggatgagggagggaagaggggaagatgggagaataggtaggggttaacaaaaagaaagaggacatgaaatgccacctaaggatagaaacttgctatctttgttatctcatgatccagtttacaaaacaaaaagaaatttgatggcagatgccttccatgacttgataatgtcagtcctaggagcagtgggccactaaacaaaatgtccagtgccgggtgtgggataccgctgtggctgttggttagggagactgttcctgaaggcaccacagatcttgaatgcaaagtataaaggaatcaaactggaattgagctagaagcttcctctctgctggagacttctcactattatgtccaacagtgctacagactgctgcaggaaggaaagatattaatggtttactcagctgtgatctctatgaactacactatcaacctgtcagagaagacgggctcactggtacaataatggcaggaatactatatgagcaaccgactgctcttggacttgaggcccactccatgagagaacgcatccctggtattgtatgcctagtgaaacatttgtaactgagcat

SEQ ID NO: 751 - DNA, 1600 bp, mus musculus
tgtgagaaattttctgcaatagttcaaaaacaaaaccaaatagcctaacttaaccacggtggtcgtggcttcctgcctttgtcgaagctatacatgcaaatacctgctatcttttatttttccactttaataaaatgattcccccagcgcccccaccattctaaaatttgctttctccttgaaaattgtatcagctgtgtggcccctttttggcccatgtaggtgtctataggcagaggtttgggttatatacattttcattttgtatgtatactgtgatggagcgttccattccttgacttcattagtcaaatgtgtcatgaaaactgcctctatttcaggcctgttgtagatgtagagaattcagtactaagccagaagagtctgcctttatgagcggatgctctagtttgagcccttgactagtgacacagttagagagcaagagcgacaaggaaacaaagccagaggacaggatggctctcgtagagggtcagggcaagcattagggttttctcaggtctgcagaggctcaacaccggagaagaagagtccagtaaggggactaagccaaaagggaccacaggacatctcagagcagagtggataaagggagagtgacaggtgagttgtcaaagcctcggctggctgagcaatgaggacatcagtgtcatcactggcacctgagtggacagtcatccactgttcactgatcccttgggatgcttgaggtgggtacaggattgggacaggaaaggagtgagctgaggaaggcagatgactctagaggagtttaatgaagagagagagagaaagacaggcagtcaacctagatgcaaagtgaggacagagacagcgtggcttgatgtgttcctaagtgccaggcagggacacttaggctttctttggtttctgcccagtgaagaccccatggggttcttgttactgaaatgtccttggaagggcatgtgttttgtcaacaagccaccttacagacttgtgtattggttcaacatttctatttggtgagaaaatgaaagactttgatactgtttactgcagtattcttgggtcaacacctccaggtcccttgaagtgtagagtctctaagaatgcctggcccacccactctcagtctattctgttccctcccctaaactgactagccacacagaacactctagaagacagttgctgtgttgatcccatccagtccctccttcctcagatcacctacccacccctctgatcccctgtgaggatcaggaccctgtgagaacttaaaggtcacgccaacagtaagacctttgtgagcttctgagatgtgagccctcacacagcagaaggactgtaacccagacaggtctgctttagggacagtgagcccatggggaagacctaggtagtcaagggctcagtagtccaataccaaggccagctggatggagagccagctccagcttttctgaagcatctacaggatattagcaggtgtgttgttctccatggtcatagctcaggtccctggacctctcctttagatcacattgtttgtctttatggtacctggataggcacatggttctaacagacagtatat

SEQ ID NO: 752 - DNA, 1000 bp, mus musculus
acacaccattttatcaccaccaccaccatcattatgggttatggaaacccttactgaggaaatggctttgtggtgaactatgaaagaagtttaagctgccgttaggcaaccgtggagagaacaagcattcttgaaggattagtatgtgcaaaagccttgtggcggggggacttgtgggggagacttgtgatgcatttggggagctgaacaaagctggtggggcctgggcaggctgatcctggggggatttgattcgagtaaggtcagagagacaggctggagcttctgcagttaggatctatgctctgtttccatcccaggcgcaggaactggcaatgaagggtttgagtaggcagaactaacatctgcttagcggtttgaaagtctcctctagtggctttagaagctgatgatggtgagctacaggtgggggtaggagccctagagaaaacggtgaagaagctaagaggcagaccccacaggagtcagggattgtaaggcggccagcggggagtattttggttgcttttccagttactgtgataaaataatccgatcaaagcaatttaagaaggaaagtctattctggctcatggctccaggttacactcacggcagcgagttgcagtggcaggaacttgagggagctggccacatcacatccacagccaggaggtcaagcagcagagagtaactcatgcctgctgctgcttagcttccgtcctccattcacacagcccaggatctctgctagtgaatggtgccgcccacggtgggcaggtcttctcacctcactcaacgagatcaagataatcccccacaggcatgcccagaggcccatttcctaggtgagactatagtctgtcaagttgacaatgctaaccattgcagtgagggagagaaagaaggccaggatggtgcctctctgttactctgcttacccacggggtgcaaggacggtgagggatgggcctgagcttcagtttcctcatgaacacac

SEQ ID NO: 753 - DNA, 1000 bp, mus musculus
gagtttcccagctgctgggaaccttgaggagctagaggacaagcctggccctgctcttgattctgccttgtgtcttggcaactggagttggctgcctccggcccccagccatcgtgattggttcatatcttctggctggggaaagcaagcctattaatgcatgggtgtaggcaatgtaccttattctgtgacaggtccaagtggccataaatgagtaggatgtgggcctgtggcccgtggagaactctgctagtgaggaagatagtgcagtccaagtggcaaggatgctgatcgtggggtgccacaccccactcattctctggcctgcctcatgtgagcgatatcctgccgtcgcagagctgcctttgtgttgctatatcatgtgccagcctgcaggaatggtgagcgagactccaaggcctgggcgtgtcccagtgacaatgcttggttgtccagattcagcttgtcatcccaagggctcagagcttactctgagcctctttgagtccaagtccaagtccaaggccacactggacttgggagcaggctgcactctgaagtcaaaaccaacctctcacttccttagacagctgtttgtggcttccagttctgacgaggggctagggttgtctctcgtggcaccagttggttttaatttctggctcttttcactgtctgcggtcatctgccacacttgtgatgacttagatggtggctgacctccacacaagaccgtgacctccgtggcatgctgattgtgaaccataccctccacagagttgtgggtgtgacccagaaagcactccgggaacactggtgtcatgtgtcaacgtggcctccttatttatcctttgaacctcaccttccctaacaggagagcagggtagttaaggacttctcatgaattcttctaggtctttttgctgtcaccagagggtctgcctaacttaaaagagacattaggagctgggtgtagtgatattcacctgagctcccagca

SEQ ID NO: 754 - DNA, 1000 bp, mus musculus
ctcgctacgtccggaagtggctgcttcttcagcatgctggcggagctcggcttcatccggaccatcggcgagaatgacgaggtgccggttgagcccgagtcggactccggagacgaggaggaggaggtaggagccggcgggagaaggggccgtgggcgggagcggccgggaaccagctgcgggccccaggccctcctcagcgtgctcaggtgtccccatgcaggccgtgtcaccaagctgtgcggagtcgaacttcgcaggcgaagtcagtcttgcttcctgcccagtcggggacacatgctcccacctatccatcaagcctcccaagggggttctagtgatgctaggcggtggggatgtagccctgagaaagtggctccagggtgagtggcgagagaaaaagacccaaacccaaactctcagtgcctcacaccggcgtcagccagcctcacacgacactaaggatggcccaggccctctgcagtccgattccgagaaagctgatgtctaaggctccagtctttaaggatgttgctgggaggtcgtttggagctctgctggtcagtttaggcgtctgtccaaggcttctatccctctgtccatccacactccggtctttgcaagtcccacccgcacacctgcaaacctgtgcccctcacatacttcagtttccagcttggtggtctccttaccaagtagctgagtggtctcagtggtctgagtggttccagccatgcagctaagtttttgtggctttcagagtcaggccaggctctgttgtcttttctgccatttgaccctcagcagccttccttgtcctggcaacaccgacataccattccatttcatgtcttagaaacttgtgttctttttctgctcagagcctttcacatctctacccagcccactcccccaggctttctctctatagccctggctgtcctggacctacctcggtagacttcgaactcagatctgcctgcctctgcctcctgagtgc

SEQ ID NO: 755 - DNA, 1400 bp, mus musculus
tttatccctgaagatgttccatatcccaggacagtcactggaaaagcacagcacacacagccatccctttgtacccgggaagggggcggtgcgctggctctcagaagataagactccacaaaggctctggtccttatccgcactctgtacctgctgagcccctccagcggcccaggagacgggaggcagcaagctctgtgcactcagttgctagactttgctagatgagcaaaccacgagtctctgtatgtctggcacagacatgttttcattcaaatagtctggatcagcagttagttaagtctgaaggtacagagctcactgatagagcagcccactgtgcttgacttgatgggttcattagagaccccaccccaccccttcctaagccagctggctctgtggagttagtagcaggagtttgccagatgtggcagagcaggcatttgccagatgtggcagagcacaccttcaatcccagcgctagggagacagaggcaagaggctctctatgagctggaggccagcctggtctacacagtagacgatctgaaataagagaggacacctctgtcctggggcgaaggcccggggtcttaccgatgaactcatggaggaacaccagggaggcaatgtagcaggccaggctgagtagctcggccactgtcatgagccagtgccacgtctggatggtgagcgccaccatcagtagctcagtgaggatgagggatgtgaaggagattgccacgatgtgtacaaactccgactcgaacagcagcagcgccccgtacatgatggtgctccctgcaaacaccacagacagcaattggaggcggtctatctgctgcccagctgccacccctggagcttttggcctcgctagtctgaggtgagggtgggaggggcagcacctagtgacagagcttcactgtcacctggacaagggactcacagaaaaaggaactgccatggaaattaatcactgcctttatgtttacgatctctgtgtttcagagctgggtttcacgaagccgtagctagccctgactttctaatcctcctgcctccgcctcccttgtgctgagatgtcaggtgtgagctgccacaccgtgctcacgtggtgctggggatcaaatccaggactctctttgtgctagacatgcactctgcaagggaactgcaacccagcctgtgactgcctttacaaacacggtgaggatgcaggaggcaggagagaggatggaggagagaggatcagtctttcgaccgatgcatgccttatgctctgacacagcttcaaatgccaaagaaatgtctcaccaaccgcctcatccccttcaaagttctgggctctgaacacttttgagtatgtcacccacaggggttaaaaacaggaagga

SEQ ID NO: 756 - DNA, 1400 bp, mus musculus
ttcccaggcttgggttcctcctacaccctgcaatgctgtcatctactgatgagtagatgacatccgagtctgagtcatggagacagcacagcttcctccaagctggatccacttgctctggaatgcagccactgtgaacataagggatctcatgtcgtgtgaaacagccacaaggaaagactctgaaacccctggtcctcagctgcactgcatagtcatgtgctcctgcatggcgagtcattccaaaatggaaaatgtcttagggtttctattgctgtgaacagacaccatgcccaaggcaactcttataaaggaaaacacttaactggggctggcttacaggtttagaagtttagtccattatcatcacggtgtggagcatggcaatgtgttggcagacggggtgctggagaggtagctgagaattctatatctagagcctcaggctgcaggaacagagagtgataccgggtctggtttgagcatctgaaaccccgaagtccaacccagtgacatacttcctacgacaaggccacacccactctaacacagccatacctcctaatagtgtgactcactatgggtcttttggagccattttcagtcaatccaccacagaaagactcaaaacagcaactaatatctcttccatacaagaggctgccatctggatggaactgtgcacagggaaggccccactccactccatttgaccaccatggctggtgaactggggctggagaccagctgggaaactgtcatgtcagagaagtgaggctttcagctccttccgatgaggtctgggatgacttgtgttgtggtgggcaggctctcagaactaataccttaagcttgactgatgctgccttactaacctctgacctggacccaaagacagacagacaggcagacagacagacagacaggcaggcaggcagcatcgcttgctcagaactttgttctttaaggcagacaagaagcttagttcaaagggggaagcacccttaattgtacatcttgagggaggattggaatgttctggaagggtatgccaggcaaaatccattatcacagcccctttgtagaagccacaacccgtcacagctggaaaggaagagatgagctcttttcaaagcacagtactttctgggccttgggctcttcctgggggaaagtcagtaagagggccacatgactcgtctagaattacaacacagaaggactgggcttcagggttcagctgtggcaagcaggcaactgtgctgtgttccccgacagaaaagcacctgaagagttagtaacacctcttgccattttctaaccatctatagttgtaaaaccatggaagctcccattaaggaaagatctagaagcagctagcagaagtgtgggagggaagg

SEQ ID NO: 757 - DNA, 1400 bp, mus musculus
gagaaggagaaggagaaggagaaggagaaggagaggaaggtgtgggagaggaaggagagggagagagctaaagaccagaagccaagacaagaagtatatgaggacatcaggagccactgggaaacagtaaagaagagaacagtagtcaggattctacagaggggcagcactaaacagattctctttttattcgtatttaaatttgcggtaagaattgacacacatgactttgggtgtcagcaggtctgagggtgtgtagttagcaagcaggacacccagaagagtggatcttacatttccaagaacctggttgagtctgaacaaacgctggcgaaacgtaaatagtgcctgagcaggcagggaaagctcttcccactcaggcttgctgtaaagcaaagctcaaccaagtgtccagacacgccgaggtccaggcaggttgacatacataatgagccatctgaaggaacaaggaggaatggcctgggagaagcttcaggttcaaacatctgcaagaaaaggaggcgggagggaaggaggagagggctggggactcagcaaagagctgagaaagcctcaggctgagggcggttgagtagcatgggctgactagcaatgttttcccatctggcagacgcagctttatggaaggtgttccctgctgtgaacagcactgcagatcctacagggtagcagctgtaaggtgtcactaaagatgaccctgcagacagcagtgtggctgtcacaggtctgctacagagaagagtcaggtgactccaggactgcacataggtctgtgaggtggaacagaggaagaggagggagctgtcctaggcaagtcctgttcttgctgtggatgcagggcaaagcaaggggcttcattagcgatctcgttatcatggtgacacaatgtcttaaatagtatgttttaaacacaagggggtggataggctgactgcttgaaagacagatcattagagtgtccatggagagtggccttcacattggtcagatcagtgggccgcccatcattacttcagcaggcacagggctcaagtgggtgggactgaaagcctggagactggaggcacgtatctaagggattctgaggactggctacagggaagagctccatgacagatctgatggtagtcatctagaggaaggcaaacatctgacacttcctagatttcctggactgtgtaaggagctggatggaggtagcacatttagaggaagccgactattgcccagcctgctctgatctctctctctcctctctcttctgctttctctctcattgtctttgtccccctgtctctctatttctttttccttactctctctttctctcttgccctctctcttcccctccctcttcccctccccctctcctccttcct

SEQ ID NO: 758 - DNA, 1000 bp, mus musculus
tccctggtcgcaaagctccacccctctccagggagctaacgccattggatatctgctgggggctggggaattgggttgctttaattctgggaccctggtgggttgagcacattcctcacatttgggtgggaagggatggggtgggatggagaagggtaggaacccacactgtgagaaattctcatggatacgtcaacatccttaaagataacaatcctgtcgtagatgtcttgcaaaacctggactgccctgactgagtttggtccggatgtgaaagctgataacactctatggcagtgaagaacgtgggatggatttttatagacacgagtttctgagatttagaatttggcctcagaccaagagagatttgaggaaacaggagccttagtttcccctaccactacggtgaggatgatgtgagctcccgacagtgagggtcagcaaggtttgaaagtcctgaggcagccaaggagcgcatccgagttgcctatgagcattgcaggtgcagcacaagagcaagtggaggcttgggtttaaaatcaggcagaagctagacatgaaacacagggcccgagcccatcatggagcactcatggcatgtctttgtcattgacattctctgtgtttcccgctgtgctgcattccctgtaggccattctgaaggccatccctgtcaactggacaggaatcttccttctttttgcatcaggaggaaacgacaaagagcaaattccttggaagaacatcaaactcaacgactccaccagaagccctgagctctggggaaacctccctgacactgtagagtccactcggatcattctgccaagctaccagggcttcgtcggccatctagaatgtaacccctagtctgtgactcttctccaaagggagggtcagttctgtctggccatcacctcatgggccttcctacctctggtcatgtggaagagaaggttagctgtgagttccttatctctatatgtgacctcatcac

SEQ ID NO: 759 - DNA, 1000 bp, mus musculus
cgcatgcgtgtgtgcactcaggcacaccacagcatgcagaaatcaggagtcagagaacagcctgacgtttgggtcctcagcttctagcctatttgaggtggtctattgtttgcctccggttggaacagaacagctaggcttctgagtactctcctgtccccaccctcaacctccccctaggagtgcagggattgcagaaactaatgctctaagcctctggcttttatttgggttctaggtgttcaaactccggtcctcatccttacacagccagtatctttacccactgagccatcttcccagtccagaaatggatctcttatttggctgatagatgcatgccgcctctgtccgggcataacatttctcaacagctctgcccttttccccactgagaccaggtgactttaggttgcaccaaggtgacatttaaagctagccatcacgatgagtccagttcctccataaactggccagcatgagtctttttttatgacagtcaacctagttgataaatcttgatttttgactcagaagtactgccttaaagcagacacccagtgtcgcatggagctgtccgtggccatagtgctgaaaccagcgtggccattcagtctggtgcgtcaaagcctccaccaaatgtaggcagcgctgttccttggtttgggttcctaaattgtattcgagaagggaagccagatgagagaaagataagacgcaagtgaggagccatgcattgctgtctgcttgtgactgtggatgtgacgggactagccactgtctctacacccctcaaggatggaccctggaacatggaactaaaggccaactaaaccctttctgcccccgaagtagtttcctaggggtattttaggacgacaccaagtgtcctctcaccctggccacttgaagtcccccttgtctgcatttttgccttccatagcttatatcaagatcagtcactctgggtattccagtattctcttgtttcaccctgccc

SEQ ID NO: 760 - DNA, 1400 bp, mus musculus
gggccgggctctatgttctgctcacctgactgcagtgtctggagtcactcctgaacagacaactcagtgtaaagcccaaaagattaatttttgaaccaaaccagtccggggggcttgctggctcccgtcaattcgtggcctctttgagcctcggtctctgtatccatagtatgagagctcttgtgatggtcaactagagagtgtatgtgtgtataagaatcttctccttggagctggaaatgtggctcagtgggtagagtcctcgcccagcatgcacaaaggcccaacaccacataaactggggaatgctggcagtgggatccggagttcaaggtttaacctaagttacatcatgggttcaaggccagcctgggctctgtgagaccctgttcttccatcttcccttacactaaccctgccagcaatcttagttctggggagattgagataagagagtggatccctggagcttcctggccagccattctagctgaatggactttctccaggttctgtgaaggacaggtgtatacaggagcctcaaggggcccagcagggggctgaccattgcctgtaagcagaggcagattatcaggcccacacccctgcagatacgcctccagctttctgtgtcctccactgacatctcaggttattcttgctacttattatgtctaccagttggattccaaggcttgtcagtggcttccctgagttcatcttggtgtctgtccctgcaacttcaggacactctgtgcttcggctgtgcacatctgagtcccagtgtggtcacagcacaactggatccacactggctactcagcatccttcctagcacctgtccctggtaccacgaacacagctgtggggtagccaggagctgaggcagatggtgggcaccaggaaagatgctcagagcctgatggagcactgctcagagcctggtggagcactgctccaagcctgatggaggactgtgagtagctcaaggcagagacgtctactgggtcctcttctctccctccttcctgtccctacttccaaagccttattctctctctctttgttttctcggagtccttcaatcctctgtaaacactctgcagtttttgcaccatgggccaacccagctcatctccccgactgggctgtacgtggctttgcaacttaagactggactcagtgcttctgtgtcctctcccttggaagcagatgcaatgaccatgggagaaataacatctgtgccagcagctaagccagcacaaagctcaggctttgggagactggatcatgttatacagacacagacacatgcacacagacacacagacatacagacacacacccacagacatacagacacacagacacagacacatgcacacagacacacagacaca

SEQ ID NO: 761 - DNA, 1000 bp, mus musculus
tgtttccctaatttctttctcagcctgtttatcctttgtgtacagaaatgccattaacttgtttgagttaattttatatccagctacttcattgaagctgtttatcaggcttaggagttctctggtggaatatttcgggtcacttatatatactatcatatcatctgcaaaaagtgatattttgacttcttcctttccaatttgtatctgccgaaagtagtctgcataggtgaaagtatggactacagaagctaacagcttctgggacaggcaggagccacagagcttctgaggcagcccccttttcaggccccagacatctggacaccttcccagccagaggataggtgtccgcccagcccgggagggctttgcctgagcatcagcggcagacatcttggttctaggactccaccgagagtattctgcacatgtgagagtgtggactacagaagctaaaagcttctgtcacagggcgaagcaacacagcttctgggacacgtcctgtttggggccttcatctttggccaggagggaggtccgaacgccagatatctgtgcaccttccctgtaagaggagagcttgcctgcagagagtgctctgaccactgaaactcagaggagagagctagtctcccaggtctcttaatagcgttctcacgcccggccaggaagaacacaacagaccagaatcttctgcggcaaaactttattgcttacatcttcaggagctaggagcgcaaacccccagccccaaaagcgaaaagccccttcaataacgaaaccgaaaccccttccctatttaggagagttatatttcgcctaggacgcatcactccctgattggctgcagcccatggccgagctgacgttcacgggaaaggcagagtacaagtagtcgtaaaatacccttggcacatgcgcagattatttgtttaccacttagaacacaggatgtcagcgccatcttgtgacggcaaatgtgggggcggctcccaac

SEQ ID NO: 762 - DNA, 1000 bp, mus musculus
cttccttctaatctctccccaggtattcttacctgacctaaacttttcctcgggttcaagacccttggaaaggcctgtatacttattttgtgtaccatattttctctttgctcctactctctctccccgctttacttctgatagattgtcctgaatttcatccagaatccgccctgccttaaccacttgataacatgtgaaaaggaacaaaagggcttctaacactagagaaagttcaaggccaaacatatcttataaagctattttccactttacttctgatagactgtcttgaatttcgttagaaagttcaaggccaggcttacctcgtaaagctgtactcactggtactctcgttccccagctgaaaagttctgaattcatgcagttgaatccttcttaacagtctgctttacgggaacctttattaccgcgacccgcagttctggttctggaatgagggatctcccttgcgccggtcccgagttttcttgtattttctcgtcccggattttttctcgtcccggaatttctcgtcccggatttcagcaccaattcttaatagcgttcgcgcgcccgacgaggaagaacacaacaaaccaaaatcttctgcggcaaaactttattgcttacatcttttggagccaggagggcaagcgcccagcgcccagccccaaaaacgaaagccccctcaataacgaaaccgaaaccccttccctatttaggagagttatatttcgcctaggacgcatcactccctgattggctgcagcccatggccgagctgacgttcacgggaaaggcagagtacaagtagtcgtaaaatacccttggcacatgcgcagattatttgtttaccacttagaacacaggatgtcagcgccatcttgtgacggcaaatgtgggggcggctcccaacacaggtctgctgatagaggctaacagaatcactggaggaacaatctctaatcagagacaactaaatcaactaactccagag

SEQ ID NO: 763 - DNA, 1000 bp, mus musculus
ctctctctctctcagaaattaacctgttattttatttgtatggttggtttgcctctgtttgttttgtttctgtccgtgcctgatggccacaaaggccaggaaagccagggaggctaccatgtctttcatgtgtttcctgctctgttctgaagcttgtctcataaccatcatgtggacttgcaggtgacctaaacccagcctgaagacagaccaaaatcttgttccctaaaatgtctctttaattgctaacattcttgtcacctgtccacttgtgggcacattggtaacttcaatgtaagttgattcatgggctatgtaagctatccagcttgattctaggaggaagtaggaggcatgcatagggagtgctgtggttggagttcagattgatctccaaatttgcaaaacagtgaacacagagacactgcccacaaagggaagtaacagacaattgagcagcatggatctggaatcttagttactccctggggcttttaggaggatgcacaggtactctattggagcaaaggcatgagtgctactcatctgcaaatctctagatctggaaaacaattgccccaggttggaactgtgtccttcagcacaccctaaccctaagggtagttaacatgtcactcaagactcttgagccaaccagaatctctacacagctggcagtcagaaaaggaggcagctcttcctggttccaagccagcaacttcctccctgtaattcatctgatctttgcgtttctgtggaatgtgttttgagggcctctactgagtgatgtgaggggacctagcaagctcagaactccagacatggtaagtgcaaagtcatctcccacagagaggaggagcaagcagcttagcaagaaatgcacttgtagttccacttcccagcacctggatggtaagaagcaggcagctagatgaggccacctgtgaggagctttgtggacctagtctcctcttggacccggctgtggcctctgaataac

SEQ ID NO: 764 - DNA, 1000 bp, mus musculus
ttcgacatgtttagcagtgttctcctgaatttctttaagtgagttattaatgcacttctgaaaatcctataccagcatcaagaaatatgattttagaccttaatcttgcttttcaggtgtgttggcatattcaggacttgctgtggtacgttctgatgatttccagtggtcctggtttctgttagtaagattctttcctttgcctttcgccatctggtagtctcttgtgttagatattctagctgtctctggttggagcttgtttctcctgtgattctttagcctctgtcatgactcttgggagaccaactctctcctgtgatcctgtggtcagaacatgctctgcaggcaagctttcctgttgcagagtatgtacacagaagtctggagctcatatccacctcctgattcctggggtcagagccctccctggaggctgactctcctcaggcagggaaggtgtgcagggctctgagtgttaggtcttttcatctagctgaggataaaggcctgaagggaccctgtccaagaagcttagttgcttctgctgcccacttactctcctgcataaactggtctcagtgatcccaagattctggatgtgctagggcctgcctttgtcctttgaccctgttgctgctagcacaagaccttctggattttttggaagtgatgttgcattccactcaccagtgatctcaaggacccgggtgtgctaatggaagtgcagcatggagaatcctctgaggacatttgggccctctgcctagatcatgccgaatatggcatgggggtggggggtgggggaggaaggagctgaccagaagttaaacccagctgctggtcaggctgctgtcctttgtccctgtttctgctaccacaagaccctctggattttgtggaacttacgttgcgctccactcaccagtgatcaaggacctaggtgtgctagtgtgccagccatgtggagactcctctggaaacattagggccctcatta

SEQ ID NO: 765 - DNA, 1000 bp, mus musculus
aagcaatgcctctacatacactgcatagtgacatttaagttccataccttcccactcccagggctaccgagcctctgggacccctgtaaaaccacactcaggaagagtcaaaggacaagggtctctgctatgatcactacatggaccaacagaaccacactctgacccacagtccatttagaaccagcagatcaaactcaattagctctgcagacttgctcctcctgtactgtcaatggagattactataataaccaggaaatggcttgtagtcttccaggcagcatttaacacatgcatctgaggagaatcctgtaaagatcttgtaagctaccttcccctagtgtttctgattgttaggcgtgaccatagtccctcattagcttggaaaacccagctgggcctcaggacaacagcagctccttcaccgttggatcacagagcaaatgactcaaacagctgaaaccttccaagctctgctgttccatcctacatgtggacatagccctagtctgaaaaatttacatgtaaaagaatgttctagtcctgcagaccaagtattttatatttaaaaggtccagggtcctttctttttatatttaattatgcatgcaatgtcctgtgcagccatctctatttcttaataggaaagtcttgcaactgaactgcaataaaattcatacattaacaataatttaaaagtaaaagtgactatgcattttaaaggttgaagcagttaatgggagagaaaagggaagacaatgaagaaataaaaagtaaaggataggtcccttcaggtcggcgccagcactgacgcaccttgggcggggagtctgcggacacccccaaggtccccagtggactccccacaggatcttaagacctctggtgaatggaacacaactgctgctccaatccaattgcacaggacttgagacagcattaattagggaagcagaaaaccaggctgaccagggtcacaagtcccttacagttggca

SEQ ID NO: 766 - DNA, 1200 bp, mus musculus
gtggaaatgcatgtctcttcatttgtggcttcttttggggactgccatttgcctttctctctgccccaatgggacgactctccctagagagatccatgttagggttaagcttttctgaagggacagctactgtcctggggaaatgctgactcccagagtcttgagttgccattatggcttgatgtctgatgtcctcgttttcctgatgctggctggacctgtgtcctcagacacacagagatcagctatgaccctgtcacatacgaggaaggaaagcacaaggtgcctactgcatgcctttcttctgtgggctgagtggggagtggtaggaaggacaaggggttcagcctaggtccattgcatctcagtgagtaaggctttggggctcttttgccccttgtgggtgaagatgggagtggggaagtggctcctttatcgccgtacaatggtcctctccacacaccacgtgtgccgtgtgccatttgttgaaattagggatgagactgttggagggtgtgctgctctgctcgcactggagttgagagacaaagaaaggttgagtgggaggggccggctgttctctgaagcgcctcagtcacaggccccttcactggggagaagctctgatctctccatattcctggctcctctttctgatttctcctagaacttcaaactcaagatttcttcattctccaattgcagagtggcaggtcagggtgcaggaacaggaaggaactctttaagggagcaactgagcagccttcagaacgactaaagccacaggggaaagcctcctcagatcgcctttggtctggtgtgatctttaaaggccacttccaaagtggcctccgtttagttaataaattacacgcgttacctccagggctcgctgacccggtcgtccacctggaaaggcactgaccagcaggaaggtaacagaaggcagatgagactttcaatttttctcacagccctgctgaaacgaagaggcaaattaatttcggtaataaagtttacaaactgagtatttgcataacacttcacttcaattgcactcggaaatacaaagggatgaatatttatagacatggtttgagcgcaccgctacatgggacagtggaggactgggtgaatagccctgatcctgatctgaggttactcattcctgtttgctaaacactaccaaattagtgctgg

SEQ ID NO: 767 - DNA, 1200 bp, mus musculus
tgaactcaggaactttgacagagactacaaactgatctgcctagaacatttcccagcacacttccctgcaaagccctcctcctcaagcggttggtttggaatgatgagcagctgcccccttctcagcctcatccgcccccagttcccagcctagcgctgggcctcagggaaactcactctgaagtctctgtgacaactcatgcactctaggctctcccgggagtccagtccatacctgagaaggtgcctgttgcaccccagcccagtaactgtcccatccatgcgtgttgagcaaatgcagaatgactttttcattatccacttcttcgcattggagtctagaggagaatgttctaaaccaatcagcatcacactgttaattagcaaaacctaaaacccagcccctgggcacaggaatgcccatgctcactgctctgctccggggtagaatgctcagtcttcccggtcctggaagcctcctgccaaattcaccttgaaacagatttgcttctgtttttacaggctgggtttagaagcttcaggcaacagggaacctggcctagggccgaagacagtaattcttaccagagggaacaatcccattaaagcaaggaggaagcagaggaaacctccacagagctgcacaaaacctcctctccacggggagccatcctaccgactgttttccataaatttcagctctgggcccagtaggagagaagggaggcatttgctcctccttgcaccggaatccgatatagagcaaccgctacagagcctggggcaaagtgtgtcttaaggagactactccacagcgcagatatcctcactcctgtcaaaagtgggctggatggtcaggaggctgagagatctgcaatgaaacccagaaatcttccagcaaagctcatgcccattcttcactcctgggcagctggagttcattaccttaaaaggagttttggggtctctggcctctcttcttagttctttgctcacacaggcaatgagctcacacagtcccactgtagggcaacccagaaagccttgtaaacctgtgctaacccaggggagctatttactcttcaattccttccacaggagcaaggattccttccggtggggagggtccctcatcggacagtcaatcccattgtcccctacatgtccacctgccctggaaaagccacagtgagaaacaca

SEQ ID NO: 768 - DNA, 1200 bp, mus musculus
taaaattagaattattcatataagtgaaaaaggcaacatgaaagttaaacataaaaccattttaaaaatcaatgtccgggagcaactgggagagccatcttggttcctggatccctcagagactactctgcttaggtgtgagtgtggactacagaaactacacagcttctgggacaggcagaagtgacacagcttctggggcagacgccatttcaggctccagacatttgcgcaccttacctgccataggagaggtgtcagcctcacccaggagggctttgccatagcacctggggtaccatctctggtcctggatatctcagagactagtctgtgcagatgagagtgcggactacagaagctacacagcttctgggacaggcagaagctacacaacttctaggaaaggccctgttttgggccttcatcttcggccaggaggcatgtccaaatgtcagatatctgtgcgccttccctgcaagaggagagcttgcctgcagagagtgctctgaccactgaaactcaggagagagttagtctcccaagtctgctgacagaggctaacagaatcatgagaagaacaagctctaaccagagacaactataacaactatttccagagattaccagatggtgaaaggcaaacataagaatcttactaacagaaagtaagaccactcaccatcatcagaacccagcactcccacctcagccagtcctggataccacaacacacccaaaaagctagacttggatttaaaagcatatctcatgataatagtagaggatatcaagaaggactttaataactcacttaaagaaatacaggagagggttacaagcccccttccagtgggctccaggaccgggtcatctgggcacagagttggcagaaactccgaggtccctagaggactctccacactatcttaggaccaccggtgaggggaacccaacttctgttccaatccaattccgcgggacctgaggcagcattagggaagcagaaaacccagcctgaccagggtcacaacttccttccggtcagtgccagcacctggacaccttaggcactcagtcaggggaaacccccaaggtccctagagaacagcttctgaagcaaaccccattcctggcttcagacatccagcacattccctgccagaggagaggtgtccgtcctgccctgaagggctttgc

SEQ ID NO: 769 - DNA, 1000 bp, mus musculus
acatctctgattctggatttctttcctatgatttctatctccagagtcgtctccctttgggttttctttattgtttctgtttccatttttatatcttggatgtttttgtgcaattccatcacctgtttgtttgtgttttcctgtagttctttaaggtatttttgtgtttcctctttaaggtcttctacctgtttagcagtgttcacctgtttttatttaagtgagttattaatgcccttctaaaaatcctctaccagcatcatgaaatatgattttaaatctgaatcttgtttttcgggtgtcttggggtatacaggactctctttgttggcatgctgggttctgatgatgccaagtgatcttggtttctgttaggcagatttttatgttagcttttcaccatctggtcatcttggtgttagttaaatgttctagctgtctgtggctggagcctgttcctcttatgattctgttaacctctgtcagcactcctgggagtccaactctctcctgagtcccagtggtcagagcactctgtgcaggtaagttctcctattgcaaggaaggtacccaaaagtctggagctcagatcaacctcctgggtgaagatgaaggcctaaagtgatcctgtccaagaagctctgttgcttctatggcccatgcaccctcctgtgcagacaggtctatgagagactggggatagaatatggagctctcacccgagtctctgggtgaaaaaactccctgaaggccaactctcctctggcggggaaggtacccagaggtctgggtctcagctctgcctcctggctgaagataaatgccctaaaggaccctgtccaaaaagttctgttgcttctgaggcatgtgtgctgtcctgagcagtctggtctctgagaaacctgggattcaagatggagctctcaccctaatcccagggttagagccctatctggaggctgactctcctcagtgatgtaaagattctgggtttgctagg

SEQ ID NO: 770 - DNA, 1200 bp, mus musculus
tatatatcttttaaatctgtgtatactcaaaaatatatatccttaccaaatatgaaacaacaaaaatcacttctgattgcagagtacttctgtttatatgttgttcaacatttttgaatgaagaaaatcttgtcaatttctaatctaattcaatattttataaattaatctaataaaatgtttttatattccccaaaacgagttaaccacaatatctataagaagagtagttatgtctttaggttggcaccagcaccaggacaccttgtgcctgaactaggcagacaattcccatatctccagaggactcccatctcacaggcaccttagtacacccaggatcttaggatcactggtgagtggaacacaacatatgctccaacagaactgagggtgcctggggacagctggagcacagacacaggaaccccacaagaccagtggctctggttccttctggtcaacactagcactgggccaccttggcctgaactcagccaacagtcccaaggtccctagagaactctccacccccatgcaacctagcaggcccaggatcttaggatcactggtgagtggaatacaccatctgttccaacagaaatgggagtgcctggggccacctggaacactgacacaggaaccccacgcgaccagtggctcaggttccttccagttggctctggtgtaccttggtttcaaactctgtggtcagccccacagtccccagaggaagtaccacttttaggcactctaacatgcacaggatcttaggatcccaggatcccaccatcccaggagcttggtcacaccaggatctcatggtctcagagaaagcttgacttccaagaactctgacacacccaaatctcagcatcacaggattctagaatctcaggatcacaaagagagctggattctgagaagttctgattcaactgcgaacacaggaaggacaggctccagtcagatatatcaagggcagggaacagttgagataatcagataaacaaaagcaacagaaaccaaggttacatggcatcatcagaatccaactctctcaccatagcaagtcctggataacccatcataccagaaaaggaagatatgaatctaaagtcacttctcatgatgatgatggaggacgataagaaggaaataaataactcccttaaaaaaatacaggagaacacatccaca

SEQ ID NO: 771 - DNA, 1200 bp, mus musculus
gactgctttcttgaccactgcatctcatctttatcagagcataagaatgagcacaatggggcttaaaataatatttagtctctgggtgcacaaaatgtgatggtttgtcaacaggagggatcatgagctcagtgggggacctggacctggacctggaggagtatctgtaaggctgactgagaatgagaacttctgtgattgtggaatgacagtgggtatgcctctgaaggagtatctgaagcagaaagagttgccctccatccgagccacaccttctggtggcagctctccaaacatcatccagacctccagtgtcagattgagactgcttcctggacgtatagcccctgggcagaggtgttctttgacattgcatacaagaagaaagataacaagagagcaaagtacatgtaagtttacctcatcacttttggcatgtctgacctctggcgaggacagaactgccaagagaaccaaggtcaagaagccaagtttctgccctaaccatacaggctagtttctgtctccattctcgtcattctgatagcatctgaagcccctcacagaaacacctgcccaccagatgttcccaacaacctacttcagtatgctttttgtagaacaccttttatgtattatttggttatttcctacaagcacacaatgtatcttgatcatacaaacaacgtcttcctcatgtgccactcagacacctacacccaagtctattttccactttcatgtcattttttgttccctgttttgctgcttgctggaatgttgactgatcgtgttggcttgactttggcatgtaaccatccttcagtgagttcatgagtacaggagtcacaccgtgtccagaagatggcacttcataacatgcttcatctcttagttcttacattctttctgttcaccatgccttgatgttcccttaggtacccacaacagtcacttagtcttgtcactttaacccattatatgtcttctgcggtgctagccactgcagagagaggtttctctagcaaaggctgaaggaagcactaatctatatgtataaacaaaaaatacttcaaaagcattttggcaacatgtttatttagcaaaacaacagtagtagtgttcctgccccacctacaacctatcccacccccaccacccaccctgtccttagggcctatgccatgggcttttaacctg

SEQ ID NO: 772 - DNA, 1200 bp, mus musculus
tctgtcttccctatttgtccttcttcctactcccatcctatgggaaccatatgtcttgcaatctctaagcattgaagtgctatttcttttcttcccttttgacttgatagctgcatttgtttgtttgtttgtttgtttgtctagtgttcttttgaaagatgtcctcctcgacttccacaaataagttctgaatgtggcagacaacactgtacatggtctgctagaaactcgagggaatcaggctgagcaaactggaaaacgactctcaaaagcagtaggtgatagttcaacaccaaaataaaatacggaaactcatagggaagagcagaagaaaaagtcctgagcttgcccaggaatgggttttgtttgagaagccccctcctgggggggggggcagcagcacacagcctgaccagagctgcgatttaagacagccttggtaaatctgcattgcacattcaatagtgtccatttttaaagaaaaggagcacacaaaaccagagggaagtgaggagctaaggaaaccctctaaaaatgacttccatgtcatttacaaagtcttttagcaagaaacatttggaaattaataactctaaagatatatttcaaacatagtaatgtttctatgtaggataaatgtccagaaataagtctttgaatatttcagtgaataaatacaaattataagtgaagtttccaaggttaagttgaatagttttaatttacaaataaaatttacaaacacatttttagggttgttgccatctgttacaaaagaagaaaaagtcagactttccttttgtcccacaaatgacagcacagtgtacttcccaaccttgccatctgtctagctaataaaaacgtggtatcatggacattcagcgtttttctgctaatggcaaaacagtataaaattgtatgttaatgagctgattttgtgtggactaagtttcttgtgtccagttttcaattccacctacttatctgtaagattatgaacaggatttcttcatttagtaatgaaataagtactttgtgactgtactagtctagagtcatagaacctttgaattgaatatgaatatatatatatggaatttattgaaatacaggctgcagtccaactaacccaacaatggccagctgtgaatggaaagtccaagaatctactagtcgctctgtcccatgaggctgggtgtt

SEQ ID NO: 773 - DNA, 1400 bp, mus musculus
tcttttgtgattgggttacctcactcaggatattttctagttccatccatttgcctaagactttcatgaattcatcatgtttaagagttgagaagtactccattgtgtaaatgtaccacattttctgtatccattcctttgttgagggacatttgagttctttccagcagctcgctattatttaggctgctatgaacatagtggaacttgtgtccttattaaatgttggagcatcttctgagtatatacccaggaatggtatagctgggtcctgtggtagtactatgtccagttttctgagaaactgccaaacttttttccagagaggttgtactagcttgcaatcccacaagcaatggaggagtgttcctctttctccacatccttgcctgcatctgctgtcacttgacttttttgtttttgccgttctgactggtatgagatggaatctcagggtggttttgatttgcatttccctacagaccaaatgaagctcaagaagaagaaagaccaaagtatggatactttagtccctgttagatgggtacatgggataagctactgagataaagtgtggatcagagactgaaagaaagaccatccagagactgccccacctgggcatacatcccatatacagtcaccaaactcagacactattgtggatgcctacaagagctttctgacaggagcctgatctggctgtctcctgaaagactttgccagtgactgacaaattcagagacagatgctctccgccaaccattgaactaagcacaaggtgcccaaaaaggaagctagagaaaggactgaaggagctgaaagagttgcaatcacataggagaaacaacaatatgaactaacaagtacccccagggctcccaatgacttaaccaccaaccaaagaatacacatggagggacctatggctccagctgcatatgtcaaagaggatggccttgttagacatcaatggatggagatgcccttgatcttgagaaggcttgatgccccagtgtaggggaatgccaggagagggaaccaggagtgtgtgggttgctgaggaggggaaggggagataggatagggggtttttggaggggaaacctggaaaagcgaaagcttttaaaatgtaaagaaaatatctaataaaaaaggaataaaatatatgacatggagagtcagcagactaaggtacttgccatgtaaatatgaggaactgagttcttatatttaacatccatactaagtcacatgcagtaacacaagtctttaaccctgcagctcttacatcaatatatatggtggaaatgggggaatcccaggaagattttgggccaattctgctatcataataccacagaaaacaagggactttgtttcaaacaagttggaaggta

SEQ ID NO: 774 - DNA, 1200 bp, mus musculus
ccaggatcctggcacaaggccacagtcctccatagatttttggccatcagtcacatacgggcaatgctgcaaacccctccacaggtagaggatgtgacctgtggtcacatagactcaagacagatcttcattttattggggtacctaaagggctggaggacttttccactaaactctccttcccagccacccatcctgaaaaaggcatttaatctcaggctcaccatgagaagtggtgtatggtttttctcatccactttccaccatgacaataaattgcttaaaaccatggactgcctcttttcatcaggagctgctatgggaagtcataaagcctataaaaccactgtccaatctcccaagctagctgcctgctgacaagccaagaactctcccctgggaccagccctgcaggatcagccagagctcccctcttttcccaacttggtcctagctaggtccagccccaggggcccccactccattcttagctcttctttggcacccagtggtgcctgggtgtctgaagggttgagaaccaggcatccctgacctccctgcatgcctggggatgtctgagacacctctggctgtcctgtgcttcaaagtgcacttccccacccttcgtaccccacagcttccctacagcctgacacctgctcagtggcagcatggggtaagcaggtcaacttcctgagtcctgcctccccaagctgaccaagccctgtggtagagcatatgcaggaccctacaatcctacacaaaatgtcattcgtagttatcttattgctatgtctagtagaacaataggtttgggtttaccatagatccctgagctatgtcatgtcaggttcttggtcacctaagcaacatagggtttgggttccatttcacagagctggttttcagtcaaatcagatattgctctgtctaattaatcctacaagttttatgccatcattgtacttgtatatctgacagtcaggataatattgtaggtccaatggattattagtatttacatttctcctttggtagtgttggagttccttcatatatcaaagactctaacaagtaccgatgaagactctttgtaggctgtagccactacctcaatttttccattgtcagtgagatatgtagaaatggaggtttgctgtcagtttgtggacagcaacctgtagtcttgaccacagcttg

SEQ ID NO: 775 - DNA, 1000 bp, mus musculus
aggtgtattttatcctgttatggctaggtgaacctgctcagtttggggaaagagatccgaatgcatgcaacagaactacagacagcccctgctcctgctgataggggtcccacatcaagactgagctgcataaatgttacagatgtgctaagggcctgagtccatcccccacattctcctgtttggcggttcagtctccgtgagcctgtactggctggttttgtgtgtcaacttgacacaggtggagttgtcacagagaaaggaggagcttcaattgagaaaatgcctccatgagatccagctgtaaggcattttctcaattagtgatcaaatgggagcgtcccttgtgggtggtaccatcttttggctgatcttgggttctttaagtaagcaatctgagcaagccaggggaagcaagccagtaagaaacatccctccatggcctctgcatcagctcctgcttcctgacctccttgagttccagtcctgactttctttgatgatgaacaggaagtgtaagctgaataaaccctttcctccccaacttgcttcttggtcatgacttatgtgcaggaatagaaaccttgactaagacagggtcgctatgagcccaggttagttgattctatagatttgcttgtggtgtcctagaccccactggcatctccagtcctttctcccctccacaggtttcctcaatctcaacctaatgtttggctgtgcgtctctctatctatttccattagtttctgagtgaagtttctgcgatgacaactatgctatgctcctgtcttcaagcatagcagaatattattaatagtttcaggggtgagcttcctgtcatgacatgagtctcaagctgggccaacattagttggcaatcccctcaatttctgctccacctttacccctgcacatcaaattgtgggtcaaagattttgtggctgggttggtgtccccagttcttcattggaagtcctacctggttttagaagatgtc

SEQ ID NO: 776 - DNA, 1000 bp, mus musculus
tggtaaaggtgtgtgtgtgcatgtgtgtctgtgtgtgtgcatgcccttttttaacttttctaatttgggattatttataatgaatggattattaaacacagttaaactctttaggttgaaatgtatcttcttgcacagtatgtaggggtggatttgtgtatagatattgctgaaatttgatttttatcatagaatgtcttattttgtccatctatggtgattgaaagtttttctaggcatagtagtcttgccaagtatctgtgatctcttagagtcagtcacacatctgctttttctgcttttgagtcagatgtaattctagtaggtctgtcttttatatgttatttggcattttactcttttaggttctaataatctttccttgtaatgtgtattcattgtcttgattattaagtgctaagaagatttgtaacttccccccacagcctgaagcagtctgagccagaccttgacttcattgccactaggagattacttagggtggagcctgcctccctggatcactctattgttcagccactgccgctgctgctacctgctgggagtcggcctagctattccagagcctacacatggtcacataggctcgaaggatgatttggctggaatgggctttcccctctcctttataaagtatgtccaccattaaaaatttgaaccttgagcagactagttgtcttgtttccaatatttctcaacccacctaggctccctcttttatttctgttccaagatgccttccaggcttgaacccagacatgagagccgcaggccggccccaacaaagatttacttttctcttccaatctatttggtgttctgtatgcttctactatactgataatcatcttctttatgttaagaaatttttttatataattctgttgaaaatattttctatgcctttgatttgggttcgtttctttcctctgtttctattagtcttagatttgttcttttcataatgtaccagttttcc

SEQ ID NO: 777 - DNA, 1000 bp, mus musculus
agccaagtatctgtgtttgtttacatctaatgtatagaatcacttgaataatacaattgaatcatgcatattttcattacagtcctgatttcaggattaagataaactattttaaagtaatagatatttataattcaatactttaacacatagtaaaaaataaatttatgtaaattataatattaaaatttaaaacatttcaccaaatgttaatatatatgattaactaacaataaattgatacttttttatttgctttagccaaaatttgatcaaaatcctaatgctaggtcagttattttgtttttctttcaactttattagcatgaaaaattatcactaccacattaataaaggtatttctcaaaaattctattatgtcaatggaatatataatggcatatggaaactttcttgtgtgcttttcatgtgtttactaagtccaattcaattttcaatgtgttttaatacctgtaattcagataatttcaaacaatatttttgcatctaaatattaggtatctaaagactgacctactgggatttagaatcattaagcaatatttttcaaattttacatatttatgttatgatgtttcttgttttaaattattataagctttaatggctattcctcgttgtcaatgtgaccattctgaactacaatcctgaatttgaagtctcacctgtgatccagatattgagtttgagagatacaagtttctgacctggatcttggtatggagatattgagccacagtggctatggatctctggagttttaggcaaggtcagctcaggacaaaacaagtcccagatccagatgtggtggtacacacctttaatctgggccacaccttctgttggagacctacataaggacatttgaagaaggaagattcgcctgcttgtatttacttgccagcacatcagttgaaatctattagccttgtggcactgagcaattactagatccttggacttcccattcacagctgac

SEQ ID NO: 778 - DNA, 1000 bp, mus musculus
tgggaaggaaagtggatggggaagtgtgtgggggggggtggggaaaggaacctggtatggtattgggtgaggggaaaggactgaagcactgagggccagcagaaagaatggaaacaggcaacatcagtagataggaggttggggggaatcctccagaatgtaccagagacctgggaggtgagagaatttcaggactcaaaggtagggggaccttagatgaaatgctgaacagtagggagagagaacttatagagcccacatctagcaggatgacaggatatcaagtgagagacagggttgccatctcatagtcacaacactgacccatagctgctcttttctgaaagaattacagggatggaaatagagaggaacatgaggacaagaaggtccagtgacaggcccaaagtgggatccagatcaaagggagtccataaggcctgacactattactgagtctatggagtgctcacaaaaagagacccataatgacagccctctaaaagacccaacaagcagctgaaagaatcagatgcaggtgtttgcacccatccaatttacagaagcagctgaccactgttgttgagttagggagggctgaaagaagctgaggagaagggtgatcttgaaggaagaccagcagtctcaattaacatggagcccagagatctctcatacactggaccaccaaccaggcagcatacaccagctgatatgatgcccccaacacacatacagtaaagtactgctgggtctgtgttcattcagttatgatgcacctaacccacaagagaatagaggccccagggacttaagaggtcaggttgcatggtgtttgggacattcatgtgaatacaggggatgtggaaaagtcagaagatggacaggggagggtgaataaaatatggaatgtaaacagaaaaaaatggagataatgtcctgaaataaaatctaatccttgggatactcttttgtaaaagatatcctttatataattctc

SEQ ID NO: 779 - DNA, 1000 bp, mus musculus
tgtccagagcataggaggaactctggacggaagtgggctatcttcccccacccctgttcccctgccccctgctctttccccaggccttttttagttcccacactctactttaatgccagtatttagatatacaagtgtgactatgttacaatgaaaaatgaggattatctctcctgtgactctctaagcttgcatctaggaagtgtctgaccccaggactcaggtgagattgtcattttctctctggagactatctaaggtgcgtccactcaggagatcacaggcctcagaagcagcagagcagtggagacagggtcctatgggcctacatctgcagccaggaggttgagctgatcctcagtcctctgtgcaccttacctgccagaggagtgcttgcctccagggagttctctgaccctggaactcaggggagatcacaattttctttctggtgactctctaaaggatccagacaggagtgcacaggcagcagaaacaacaaagcagctgagacagtgtcctacggacctacatctgtagacaggttgggctcttcttcagccctctgtgcactggtctttgttgcatccaactcgaccagcaaggaaaacgcaaccaccagttcttcttaatgcagtttactcaggcagcttttctctttaactcccccgagcctcggggtacaagcgtttttatgcactcaaaccacaaccacacctcaaccaatcaccacaggtcacatcacctcaccagacaggcttgttcagccaatcagggattaagggtgagccatctaccaaatatgggcttgtttactgcctggcacagatttcagtctgggatggccagggagtccagaatggcttcccacacatcttgccaggagagaactagtcccccaggagtgctgacacagctttacagactcatatgaggaacaagcaccagtcacaagcagcaagaacatctaacaccagagattaccagatggcaaaaggca

SEQ ID NO: 780 - DNA, 1000 bp, mus musculus
agcagacctgggagactagatctctcctctgagtttcagtggtcagaacactctctgcaggcaagctcttctcttacagggaaggtgcacagatatctggcgtttggacctccttcctagctgaagatgaaggcccaaaacaggacctttcccagaatctgtgttgctttggcctgccacagaagctgttagcttctgtagtgcacactctcacctgtgcagactacgttaggcggagttctggaaccaagatggctcctgccaatcctgacacaaaggcctcccagacagggtggacacctgtcctctggccaggaaggtggccagatgtctggagcccgaaaacggagctccctcagaagctctgtggctcctgcctgtcccagaatctgttagattctgtagtgcacactttaacctgtgcagactacttttggggaagtcccagaaccaagatgactcctgctgatcctgaggcaaaggcctcctggccaggtggacacctcagcttatagtatcttaaaactagacataatcatgtctaggtgagatggaaagaatccacttattgacacatggcatgagcctgaagagaaagttaatattggggagacaaggggcagtgtttctgttttttccacagaatgctgcagaagcatgctagcttccagaatgattcatgtgacaggctgacctgtgagttcctgagtgccctgacagtggtgacaggaaagccgtgttgagcacacagagaacaaggaatcagggagagcagccacttgcaaacaagatgaagaaacttcctatctctgccatgggctacagcaaggagagcagaagtggtgtcaacttggggacaaataaaaatgatgaccaatgaggcagagggactgctgcagtgtatttgacaagatttcatcagagacactgtttttggccattcagaccaactcccttatagctgtgaaagcttgtctaccttacctatatgctatattgt

SEQ ID NO: 781 - DNA, 1200 bp, mus musculus
agtgaattcttaatcctgtaatgactgaagaatgcttccacagtccctgacccatgatgaatactaaatacctaataaatggtgttattacataatatctattgtacttaatggtaaataatgcatgaaacgaaataaagtggggtattagtcagggttctctagagtcacagaacttatggatagtctctatatagtaaaggaacttattgatgacttacagtctccagcacaattcccaacaatggttcagtagtagctgtgaatggaagtccaaggatctagcagttactcactcctacacggcaagcaggcgaaggagcaagaacgagactcccttcttccaatgtccttatgtgaactccagcaggtgtagcccagattaaaggtgtgttccaccacacctttaatcccagatgaccttgaactcacagatctaatcttctggaatccatagccactatgcctcaagatctccacaccaagatccagatcagaaacttctatctcccagcctccagataagggtcacgggtgagccttccaattctggatgtttcacagtgggagtctgtatcaatgttcatgggccatgttaccagtaaaaggcatgcaaatgtccctggtctgggccaccatctgaggccatgttaatgtccaaaggtggcacagagctaggccagcccccacattgactgtggcacttgggaagagttagacccaccccttgcctgcacagcgcagaagagccaatcctggtgtcctcagagcatgagagctatagccccatacctctcctgggaagttcaggagagctggccctagtggcataggcatggtagacctggttctggcccttgtaataagtaggagagctgaccctcagcctggacattgtgggagaactggccctggcagtgtggatacaggagagctagcaggctgaccaactcagctactatccaggcccagattcagggctttgagttggcccaccccaacatctactcaatatatgaattgctgaagcacttgaagggctggtcctacagaaccaacgctgcatgtgtttctatgatacaggacaacaacaggctatccaagaggagtctgggtcaggatccagtattgatggcatagcaaaatgcagacttctaaccaaatcaatgacttcttgcaatgaacatttgcaagtaaggc

SEQ ID NO: 782 - DNA, 2000 bp, mus musculus
tataaagtttgcacgaccaatgggcctctctttccactgatggccgactaggccatcttctgattcatatgcagctagagacacgagttcggggggaggtattgtttagttcatattgttgttctacctataggattgcagatcccttcagctccttgggtactttctctagctcctccattggggaccctgtgatccatccaatagctgactgtgagcatctacttctgtgtttgctaggccccggcatagtccatttcttatattctgttgctgatgctcacatctatggttcctgatttctttcggaggatttctatctccagagttgtctcgctttgtgttttctttattgtttctacttccatttttagatcttggatggttttgttcaattccatcacctgtttggttgtgttttcctgtagttctttaagggatttttgtgtttcttctttaaggacttctacctatttagtcatgttatcctgtatttctttaattgagttattaatgcccttcttaaaatctatcattatcatgagatatgattctaaattcaagtctcgctttttgggtgtgttggggtatccaggactcgctgtgggaatgtaaggttctggtgatgccaagtggtcttggtttctgtttgtaagattcttacatttgtctttcgctatctgctaatctctgattttagatgttcatgctgtctctgggttgagcttgttcctcctgtaattctgttagcctctgtcagcactcccgtaagtccacatctctcctcagtcccagttgtcagagcagtctctgcaggcaagctctcctcttgcagggaaggtgcccagaagtctggagctcagatccacctcctgagtcccaggatcagatccctccctggaggcctactcttctctggcaaggaaggtgcccaggggtctgggtctcagctctgcctcctggttgaggatgaagaattgaagggaccctgtccaggaagctctgtttcttctgctgtccatgtgctctcctgtgtagactggtctcagtgatcccaagatcctgggtgtgctagagcctgtgtagttcaggcccaagatggagcagggctggagccaccagaatgaatcccagcctctggttgggcgggtttcctttgtccctgttcctgcagtgatcccacgatcctgggtgtgctaggtcctgcagagtttgttcccagtatggcacagggctgctgctgaccgtaaggaaccccagctccttgtcagatggatttcctttgtctctgttcctgctggcacaagagactctggattgttttggagcagatgttgcattccactcaccagtgatcccaagatcctggatgtgctagggtgcctgtggcatggagagtcctctgggcaccttgggaccctctgctgagttcacacccaagatgatgcagggcttgtctatttcactacaacatgccttttgaagtccttgtttcggctcatgttttgacagtctagatggtgagagtttactggtgtagtttcatacactgttaggagacacaattccataacaaattccctgttcttctgcccttatactacttctgaccacatttccacaggtttcctgaacattgggtgtcattgttttcttccttttatgaattatgcctggttgaagtcaagggctttagtgtccatgggtaccagtagcttctggagtttgaagactgcaatccttccataaactatgattcagaagctgcagagaagtatcacacttggcacttatgtagcactgatcgtaccaattcaagaccaaattctataaaagggaatttctcaaaatttagtcacagaaccagttttaaacaaaatgtgaattcaattttagcattagatcccagaactaaatttcggtagcattagagtataatccacaaaccttctttctgttagaacagtatgtttaactctatattcaaatatctgccatta

SEQ ID NO: 783 - DNA, 1800 bp, mus musculus
atatattactgatctcctacagaggagaggaaattacccagtcagaatagatatgtctctatagcctagtatccgcagcctaatagccacagagtttatcttagtccatatgaagctctgagttattaattgttttaatgatttcattgatttttgttactgtaggtaatgtgccttacctaacttggtagtttattttgcttttcaattaaccttttacttttgttatatcatttttattaaaaacaaaggttttatctgcattttaatgatatgcccatctaagtgtattatgaatagtatttggctgtacagcaatttccctgaatacttcagggtaatggcaaatcacagtgagtattctttatttcaggttattgtctatatgaaatattttataatgttctttgagtaaatgctagaatcttttccatagaaccaaaaatattttttaaagaatttcaaagaacatagccatgaatataaagttccgatttaacttgtgccccatttttttatgtttaagaatcataaaatttcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccagcgaaaccacagccaagggaacgggcttggcggaatcagcagggaaagaagaccctgttgagcttgactctagtctggcacggtgaagagacatgagaggtgtagaataagtgggaggcccccggcgcccggctccgtcctcgcgtcggggtcggggcacgccggcctcgcgggccgccggtgaaataccactactctcatcgttttttcactgacccggtgaggcggggggggggggcgagcccagaggggctctcgcttctggcgccaagcgcccgtcccgcgcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggatacaacacccttctcaatagtcacaaataatataaaatatcttggcgtgactctaactaaggaggtgaaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatag

SEQ ID NO: 784 - DNA, 1000 bp, mus musculus
tttaaggacttctacctgtttggttgtgttttcctgtttttctttaaggacctgtaactctttagcagtgctctcctgtatttctttaagtgagttatgaaagtccttcttgatgtcctctaccatcatcatgagaaatgtttttaaatctgggtctagattttcgtttgtgttggggtgcccaggactaggtggggtgggagtgctgccttctgatgatggtgagtggtcttgatttctgttagtaggattcttatgtttgcctttcaccatctggtaatctctgaagctagctgttataattgtctctggttagagcttgttcctcgggtgactctgttagcctctataagcagacctgggaggtagctctctccttagtttcagtggtcagagtattctctgcaggcaagctctcttcttgcagggaaggtgcccagatatctgatgttcgaacctgcctcctggcagaagttgtgttccactcaccagaggtcttaggatcgcgtggggaatcctgtgtgggcccttgagggtgtcggaagactccgctggcgaggcaccctggtgctcgagtggaccggaagggacttgtgccccaggtcaggcccgggtcatctgcttccctagttaatgcagtctcaggttccgcacaattggattggggcagacactttgttccactcaccagaggtcttaggatcctgtggggaatcatgtgtgggcccttgtgggtgtcgggagactccgcttgcaaggcaccccggtgctcgagtgattattgttttaataaaacaaatatcaacaataactaagttattattaaacacaacataatttagacattctccaacattatatattttgatttgcttttacagcttatttttatattttgttgttttgaaataataatacaggcataatctttttctgttacagctttcacatacattatggttaacgaagaaaccatgttggttgttgctaagctccagct

SEQ ID NO: 785 - DNA, 1000 bp, mus musculus
gcagagaatgacgtaaagaccatccagtgaaaggctcaactttggatccaccctgactctattactgatgctatgccgtgcttgcatctagcatgtctgtcctctgagaggcattaccagcagctgacagagacagatgcagatatttatagccaaatattgaactgaaattagggacccctattgaagaattaggggaaagattgaagaaacttaacagaatagcaacctcataggaggatcaacattatcaactaacccagatccctttggatcccccagagacaaagccaccaaccaaagagcatacatcgtctggtttatggccccgagctcatatgtagactgggttgtctggcctcagtgggagatgtgcataattctgtagagacctgattctacagagaagggggatggagataaggggtcagtggtggctgagtgtgtgggtgagggggtggaagggtgaggtggtggataggtgttggatcaccctctcaagggcaaagaagagggagacagaatgaagaaatctgatagggtggcggcaagaagaggggcaacatttggaatgtaaaaaatgaataatttttaaaaagtaaaaatgctgaacaaatacaaatttaaaaggaaaaagaaggaaatgctcacaactcattagtttaaaaatttaggccagagctgactgtgctgttccaggaggttattgaaaccttgggactcattaatttgctagctgaagaaggtcattctggattggacattaaaattatattcatcttcactcccagccaaactgtctagttttgaagcacaaagacttgagaagggaagggagaattaggctcactgccatgacagcccaagcatctgaccatgtgagacaaatcaacctcttccttaatatttctgccaaaacttgtattaaatgagcaacttagcttaaataaacagtaaaaataagccaaagtctaaaagcatgaagaagggaaatggtgag

SEQ ID NO: 786 - DNA, 1400 bp, mus musculus
ctagagctttaataaggccaagaaataccaatactgcgtatgaatccaaaaagttaaaataattaggttgaagaaacatcctcaaatatttattctagcattattcccagaggaatataagcaactcaactgaaagttaagaaatggactaggaatatactaatggaatgctacttaaactcagtaaaaatgatttagattttcagaaaagatgattcttaaaaacattatattgagaaaacaagctgggtacaggaacacaagcactctattatgtcttgtgtgaaatttggaaaagttaaactaagaaatagagagtagagttgtatctaaggctgagaaaagtgtcatcttagggtttctattgctgtgaagagacaccatgaccaaggcaactcttctaaagggcaacattacagattcagaggattagttattattatcatcacggcaggaagcatggcagtgtccaagcatggcactggagaggagctgagacttctacatcttgctttgaaaagaaccagaagactgtctcaagggcagttaggaggaggttactttcagagccactcccagagtgacaggcttcctccaacaagcccacatctgctccaacaaagccacacctcctaatagtgacattctctgggtcaatccacaacaggagtcaaggcaaaggaggaagtgctgaccaaagtacagaaagttgcacttagacaagaataacttcataatttattgcacagcatggtatagagctaacagctgtatttcaaactgctaaatgggaaaggattaaatattcccaatattcaattcttattataaaatgtgatatgtatgtgtgtatatatatatatgtgtgtgtgtgtgtgtgtgtgtgtgtgtaatacaaatatttattaaaacataattgaatactgaaattgcacataatcatttgttcatttacatagagatcataattctgtattattattcattgttattttgatattaatttattgggctttgaatggtctttacataagctatttcaacaatattttctttcaccctttgtcccacatttatgaaggtacacctttacatataaaataaaatattttttgtcatattgctttcaaataatacaaatgtaatactttgaaaattatgtttaattttcagttaagaatgttttaggcatattactttttacattaatcttggattaacagtcagtgtatctggaaaatattctgttttaaaatattttggattttaacaatatgtgaatttctaaattatgtgtcaaatgtatgctactataagcactgtcagccaaggaaatgaaattgatgcacatttctttacctcctaaattcttttatattttaaataattttaaaacttgc

SEQ ID NO: 787 - DNA, 1000 bp, mus musculus
agtgtttttatccactcaagccacaaccacacctcaacctttcaccacaggtcacagcacctcaccaggcaggcttgttcagccaatcagggattaagggcgagccatccaccaaatatgggcttgtttactgcctggcacagatttctgtccagctagccagggagtccggaatggcttcccacaattcccccttttatattctttgaagcaagctccatgggtgaagatagaggtctgatgcccagtgtgcagaaataggggccatgtacaggattgactcttaggctcacaggtttttacccagagcaaccctgacctgctcccatgccgtttatcctgggggaaggacactaggacactcaaccctcattcaatcagacatacctcccagagattgtcaaacagcttccagactaacctctgtgcagtgcttagccttataaccctgcggagcgatggcttcattgttcattcttcatggcaacaagctaaatctgaggtgactgccctgcttcctctgtggcaaaagcttgcaccaccatggtggcagtgtggacctgggcattccacaaccgacacatacaccatacacacaacatgcatgccagaacaagggccacaatgagggcaccaatcccagcccattctttcctgatgccaagccaggatccactagggtagaattcacagtgacaatcgcctagtgaagcttattcatcttgccatcaaaatttgcagtccaatttaaacaccgacagtatcccccatctgggttccgcacccatcagaggcagacacatgctcatcaccagcaagatcagcttgttcattttgacagcgtcgcactagctactacaaaacccacactggctctgctcaattctgtggaaacatgcaaacagaccctctcgcccaggccaacatgggatccggaccattccatgatcctgtaagcacatccttccatttagcataccccagtttactggggctggta

SEQ ID NO: 788 - DNA, 1000 bp, mus musculus
aaaagaactacaggcaactaaatcgtgctaagcacaggaaagagctatcactccttttttctcattttttgaccatgtatgcacaccatcccagttcctagctggcatggcatcattcctcacctaaactctataaaacctcccttgctttttagcccagatataggacttgactgacttccatgtgtaagatcggtgaacccacttgagagttgtcttctaataaacctgcctgtatctactttttatctcatcaaatctgccctagatctgcttcatggatggagagaaaattcctatcatcttggttcaaaatgcgggagaagttgagcctgcagcccagcgggcagggaccatggctgcatggggtctgctcctttctctccctttctctcttcatctgaaggatcaactttgaacttaccaagatcctctgccaagccatggcctagtatttggattctgagatatcctttacaaggtttctttactcctcactgttttaccccaggctaccaagtgggacactgtatcataggtcgccacaagtctaggagatgggcaacacggagtctaaacctgatcctcagacattcctggggtgactgctacaaaagttgtccaaattaggactgtctcagactttgttctatggcctcgcttcagtaaacggccacaagagagcattcttgatgttaaaattctccacggatcttaagcttaacatttcttttggtatgcgggcaaatggcctgaatcccttctggccaggtttgttgggaaccacaccctgtcccttcctctgtagccaatgttctaaggctcacgtcctactagcaaggatgttcactccaaaagaccccttgcctccaaggacctggatcccaaaccccaaacccctgtattgacagagcccagactcttcccacttcttctctttgacacactcaaccttttgtaactgcaatggttgctccaaaccatgctaatcctcccaaag

SEQ ID NO: 789 - DNA, 1200 bp, mus musculus
aaagagtcaaagatccatccactcagatgttaggagtcccacaaaaaacatcaagataacagccttaacacacatacagagaggctggtatagagccatacaagccatttttacagtttcagcctttgtgagcccacatgagccctgcttagttgattcagtgggccatgttatcctcttgcccttcacccctttgactctctcagtctttcctcctcttcttaaggactttcctggtctacaagggtaaaagcctaacaaagaccttatgtatcctcatgatttctggctgtgggttgctgcatcttctctcatccgctgccagagaccggacaaggcaccaatctaggaatataggagagttggttggctgctcccacatgatgtgtgccattattgccccggcatatcttgcaggcagtatggattataggtataggattctatggctgaattggtgtccaggtttctctttcaggagtctacagagtacttttcacatttaacagtgtagaatatagaggtgaagtttcctctgaggcaccgaatgaacctttcagacagtgagttatgtgaatgttgtcctttggcaacagagccttgctatcagcttttagagaactggccttctgtcctagcaacaacctgggcttcgagggatcaacacaggattccctaggccaaaaattcaatggaactggaagcttttcctttctacaaaagctggccaggtcagactccattattaccagtcctccctaaggtcacactcatagatttcaagaagtttttacagcactaggtttctacaccaccctccagctccagctgtctctcctcatactttcttccttcatccctccccacaagtctgatccttccagagccggtccctacaacacgcccaagtcttctttcaaaatcctttatatttccccttcctaaggagatacatgcttcctccctggagactttctctttacctaacctttctgggtctgtagattgtagtatggccatcattcacttaatagctaatattctcttataagtcaatgcacaccatatttatttttctggatctgggttcctcactcagtatgagttttttctatttgcatctttttgcctgtaaatttcatgatgttttcattgctccacattcatgccaacatgagttgtcacttttattattgatct

SEQ ID NO: 790 - DNA, 1600 bp, mus musculus
gaagtagaaaccacaatatatgagcaaataatactctttactctttctcttcctcagagtgcctggacccctgaagggagggatttggtggagatattccatttagggctgagtgttccaggggatgatatcagtattgatgaaaaatcaatcaaaggtaaatattcacattaaagagtgtttatgaaggccttgtactctaggcctaagaaactggaaataccacgtaggctcaaagacagtggaaagaacagggctattttattggagagtagcaagtaacatggcaagaagaaagagataggggaggcattaggaaaaattcaactcctaatattgattatacacccaaataattatgttgaataagcagacagaaagagaaatcaagaaccccatgccttctacaagctggctccagggctcagggtataaaggactgccctcctcagtgacagcactaactcctcttcattttctgagataagctcatgaccgggttgtaacagagtcagagaggttttaagggcagatttctttacagagagcctttttcaattgtgaaccttaaaattgtgtggaaggaaggactaccacttctcttgagtgcagcttcagtatgaccacttcaaaggttgctaccttttcctgttccctatttccctggaccaccagagagcctgttgcacgcagagaaaccatgaccacctgcaggacaactgggtgatctacctgtggaggagtttcatgctgccacaggggatgaactccaacagaactatgagactctatttgacttagaaatgatgcttcttacaagacatcccaggcagaggcagaggaggtcagaaattagatgctcttgagtgagttcaagtgcagagctgagaaaggtcccaaggctgcctggaaaatcaagtacaagacatgatcatgaggcacacagccctccagagggaagagaaaagtggctgaagaaatctcactgtgaatttccttctcctgtgtttggcttcctgctgtgaagaccagtggcacctgtcaggagggtacaaaatggatatggcactatgatacatacaaagcattgagcaccggaggagagccgaagcatgcctgctgtcacagttggcctctcttgccctaataccttctcgttgctatctgtatttatcagataaaagttcaacaggaagtcttggctgctcagccttttatccaggcaaggaaggctatgcctgcttctctttgaatctagcaaagactcttgtaaaaaacacatgttctaccagaacaacagaatgaaatcatcaaaagctctctgtaattttacagaggggaagtccttccacagtgatttaccaattggtttacagagttgcagtctcactatttagtccaggctgatcttacattgtacagtttctcttccttcagttctgagtactaggattggatatgggcaccactatgtccagctgaaagccaacattttgacctccattggtttgtccactgtggttcttttctcagttcccgtaaacccagtggtgaaaagcatatgtagcagtcgataaattcaaacttcaacaacatagga

SEQ ID NO: 791 - DNA, 1600 bp, mus musculus
gacatgttcctggcagatgccccctctgccctagcccccaccccacactgtcccctcattctcggccttctttcctccctccccaccctcccctgactccctgctctctgatcgaaaaccttcaagataacataccacagacccacagagatgaaaaggagtgatagggctgagccataaacctgatgcatcaggttgacccctgagcggaatctctggagtgtcattgagtggaggaccagagggggtcatgcatggcctttatcagggcgtggcatataacagataactaagaatcacatagggacaaaatgagttgaggtcttttgttaggagggtggggtggggtgacgtccttcctactccctacctgcctccaccccagctgagatcttatcaggggagggggtacagagacgccatagaaatggaattttccagagagtctttccattcctttacgaagcagaccaagttgctttttagtttacataatacagataatcccatcagaagaaattctgccccccagctgtcccccagaggagaaacagagcagaacctactgaaatgtctaggtcttggttcaagtgtgatgagtctgctttggagacctctctgcccgtggggtcacagtggcaggctgacagggtcatggcttttctacaagcttcggcagttccctgcccgtctgcccctctatactgcagctgtggtttctcagcacggcagcaggtgggctatgctgggcatgctcctgtgctggggctgcgggggctgaggcaggaggatcactgagagtttaaggctaacctaagctaagtatctctatcctgtgtcagatttccctctccccctcttccctcctccctctccatttatccaccccccccccccccatacacataacacaaatcggaggctatgtatttccattctgtgaatgatttggaagaaaatagcacctctagcttttagaaacaaagcaatttcctcccatagattcagtaaattcagttgggaggaatcttggggttgcctaccaagtatgggctgagccctctcagatagagccttccctgaagccaactaatcctcctttctggtcattctcagaccacccttccttcctctccttccaggtcaggcaacagcacgcagcctcagttttcaccccagagaccttggctaaaatctaccctctcggccttttcagaaagagcaaggaaactgcatccctttttagccctgcctggagaattggcatcggggctaactcagcatgggtttgggaaggagacccagagatcgtcggaatacagagggtaggatggcagcgttacagcttggctgccccttggcctttgtccccaggtactccggacgccattccatcatctccttcttactctgagtcctctctagctggtgcaaaccatttactttaagagtgccccaaggtggagagatggcagccaaacggtgaacgcagccctttccccagcattttttggttcagatgaggtcaagtcgagaagcagcctcccctgaggtgagatctaggcagctcagggggggccctgatccaaaatagtttcca

SEQ ID NO: 792 - DNA, 1200 bp, mus musculus
cagtttttcactttgttctttcaaaatctcagttcttcagtctggaggtttaggggaaaaaaaaaagacattcagaagtaggaacacatacttttttatgtctgaaaatattttggaagtagtaaatacacagttaaaactacaaagccaattttggagaggggcaaagtgggttccattcacacctggagttaggaatgaacgctacgtggagaaggctggcttccggggaaaggctttccaaccacggaaagaacgtcaggaaagtctaaagttaaatcgatagcatcgcaaacttcatggcaaagtgctgaataaagatgtggttacagattaaaaattgactctggctcaggggaaattcgtaaagaagggactcagtgcactgtgtcacgtgggtggcgcagcagcaggctggggggcgggagagggggtgctctccccgcagaacttgggacacaagttaagactttagaccaaatcagaaaggtgtccctctacccttcttaaccaagcttaatcttagatgaccctgggtgtcttcgtcactgttctattgctgtcaagagacaccatggccaaggcaacatacatcaaaaacatttaatggggagcatgcttacagcttcagagggttagtccacgtctgatcgtcaggaaagggcgcagggcagcaggcagggaggggctggagtagtgaggactggggagaactgggcctgatgtggccttaaatcctcaaagcccacctggagtgacacactgtctgccgcaaagcctcactccaactgcttcaaaacctacctgggatcaagaattccgatatcggacagccattgtcattctaagcaccacgctggagtgcttgctcagtccacacctctgctttgtgttggtggtggggactttgtttagtttcctttggtttttgggacagggtctgtagctctgccagtcctggaacttactatgtggacaaggctgaccaggaactcacagatatcttcctgcctctgcctgcctcccaagtactgaactggttgtatgccaccacaaacacctaggttacacttctgttttaagcataatttcagttaagagtaatatttgggctgaggtgaaatatgtatggttgtctttgtttatttttgttgtttttgttgtttgttttgttttgagacagggcttctctgtgtaaca

SEQ ID NO: 793 - DNA, 1200 bp, mus musculus
aacatctcatcttggaaactgtagaatgtcataatgtgtcccactgtgttcccttctgttcacacatcttcacttaagcatgttcattcagtgagtcattggtctgctttgagatctctgtcttctgtgataccatcaatactggatccttatccaaactcctggttatcctgttattgacctgtattatgaagatctgcagctctggaataacaatgctggcctttcacatgtcacaacagttcatagacaatgtagattctggagtgggccaattcaaaggccgagatctgttcttggttggtaggtgagtagtcatctaccttctcttttttatttgtatcaccagtgagagctctccagaactgctcaggctaggccacccaacgccatcattggcaagaggcaatgctctcattcccttagggctagatcaccagcatctaggcctccaaagccagatccaatgtgctgcccagtcaaggtatgggacctactctctcaagtgctgcagcctgacctagctctcctgctctcatacccttggggttgcctcccctgtgccttctccatcagggtcagctccattttggtgtccaggcaaggatcaggacccgttctcctggctactgcaggtggaaaagaggaggtgagggagggtatttatcttcacaccccatcaccttactccagaagagtggcggggccagctttcccttgctctgtcttttggctggctcagttgctcctccttgaccacggtcaacactactgtattgcccaggcaaggcgagggacccactctcctaatgctggagctggtgatggacagggacaggttacccagtctctggggtatctggagtattgaccaatctctgccggctgcagggagtgaggagtgagagaggggtggggggggcatcacccaaacacccatgttacttcaaggtaggcaagaggagggccagctctcctgcacttttgttttagtagtacgctagtatttcatgtgtcatatttttatttagcaaatatatgggttaccggtctcttctgtagtctgttttgtctgtggctgaagctctgttgttgcctttgatattcactgccagagtggatggtatagtctcccacttatttactttcagctcagcactgtctaccttttgttttataaacacatctccacgaaaatca

SEQ ID NO: 794 - DNA, 1600 bp, mus musculus
ttccccttgtgccaatgagttcaaggctctttctcactttttcttatattagattcagtgtatttggttttatgttgaggttcttgatccacttggacttgagctttgtgcaaggtgacaaatataggtctattttcatttttcaacatacagattgccaattagaccagcatcatttattgaagatgctttcttttttacattgtatatttttgccttctttgtcaaagatcaacagtgtggttttatttctgggtcttcaattttattccattgatcaacatgtctgtctctgtaccaataccacatggtttttaaaatttattttatttttattgtcttatactccatattttatcccctccccccatccattctctgactgtttcacatcccatacctcctccccacaccccttctcccacatggatgtccccatccccaaccccaactgacctctaaactccttggggcctccagtctcttgagggttaggtgtatcatctctgaatgagcacagacttggaagtcctgtactgtatgtttgttgggggtctcatatcagctgatgtatgctgtctgttttgtggtccagtgtttgagagatctcggggtccaaattaattgagactgctggtcctcctacaggatggtccttctcctcagcttctttcagccttctgtaattcaacaacaggggccagctgcttctgtccatttgttggttgctaatatctgcatctgactctttcagctgcttgttgggtctttcagagggcagttagagaagaaagcaatcacaagtgggaagggagggagggacctgggagggaaagtgagcagggtgagtgtagtgggggaaagaggggaacctgatctggtattgggtgagggaaaaggttgaagccctgagggccagcaggaagaatggaaactggcaaccttgtgaaataggaggttgggtagaccctccagagttcaccagacacctggcaggtaagagactcttaggactcaaaaagagggatcttagatgaaatgactgacattagggaatgggaacttatagagcctacctccaacaggaaggcaggacatcaagtgagggatgctcacagtcacatttctgacccacaattgttcctgtcggaaagaattacagggatgtaaatggagaggaacctgaggaaaagaagattcagcaacaggcccaaagtgggatccagctcaaagggaggtccgaaggcctgacactcctagtgaggctgtggagtgctcactaaaagggacatatcatgaccataggtgggtctttttgtttgtttgtttgttttttatcactattgctctgtagtatagattgaggtcagggatcgtgattcccatagaagttcttttattgttaagaattattttgctattgtggttttgttttttcattttcagatgaatttgagaattgctcttcccatgtctttgaagaattgtgttgggactctaatggggattgcatcgaatctatacattgcctttggtaggatggccatttttactatgttaattttgccaatccatgagcttgggagatctctctactttc

SEQ ID NO: 795 - DNA, 1000 bp, mus musculus
ttcttaaatccgagtcttgcttttctggcgtgttggggtatccaggactcatggtgggggtactgggttctgatgatgcccagtgttctttgtttctgttagtacgattcttatgtttgcctttcaccatctggaaatctctggtgttaatgttcaagctttctctggttggagcttgatcctcctgtgattctgttagcctctgtcagcactcctgggagtcccactctcacctgagttccagtggtcagagcactctctacaggcaagctctcctcttgcagggcaggtgtccagcagtcgtgagctctgatccacctcctgagttctgggggtcagaacccttcctgtaggctgactctcctctggcaaggaatgttcccaggagtctgtttctaagctccacctccttgctgaggatgaaggtcagaggggaccctgatcaagaagctctgttgcttctatagcctgtgtgctgtcatgtgatcaggaggtcctggtgtgcttgggatcctgcggggtggagagtcctcttgtgtcctagaagctcttgaccgagttcatgcagaagatggcggggctggccccgacctgaacggatcccagcctctgggtgggcagggttcctttgtccctgttcctgcagccatagaccctcagtgattctttggagctgatgttgcattccactcacaggtgatccccaggtgatcccgaggtcctgaggtgtggagagcactctagaacccttagcagcccccactgggcccagaaggaagatggagggggtggccctgactggaaaggatcccagcctctggttgggcggggttcctttgtccctgttcctgctggcacaagaccctctgcgattttttggagctgaagttgcattccactactggtgatctcgaggtcctatgatgtggagagcaccaatttcagtattttaaaaagaaatattttactgtcctataaaagaaacattttactgtccttt

SEQ ID NO: 796 - DNA, 1000 bp, mus musculus
ggtgcagattgctacccacctcagtggtttatgttcctgaatgaaagacacacacactctgcctcaggatcagcgggcgccatcttggttccgggactccgccaaacttaggaacttagtctgcacaggtgagagggtgcaccacagaagcggacagcttcagggacaggcggagccacagagccactgaggcagcacccttttcaggccgcagacagccggccaccctcccgaccagaggacaggtgtccgcctgactcggaagccctctgactcaggagcagtgggcaccatcttggttccgggactcagcctaacttaggaacttagtctgcacaggtgagagtgtgcaccataaaaacggacagattctgggacaggcagagccacagagccgctgaggcagcacccttttcgggccacagacatccgaccaccctctaggccagaggacaggtgtctgcccagcccgggagccctctgcctcaggagcggcaggcgccatcttggttccgtgactccaccgaacttaggaacttagtctgcacaggtgagagtgtgcaccacagaagctgacagcttctggaacaggtgggagccacagagccgcttaggcagcacccttttccggccgcagactgccggccacccacccccaccccccaacccccccccccagccagaggacaggtatccgcctggctcagaagccctctgcctcagaagcagcgggcgccatcttggttccgggactccaccgaacttaggaacttagtctgcacaggtgagagtgtgcaccacagaagctgacagcttctgggacttgccaaagcaacacagcttctgggaaaggtcctgttttgggccttcttcttctgccaggaggagatccaaacgcaagatatctgtgcaccttccctgtaagaggagagcttgccatcagagagtgctctgagcactgaagctcagaggagagatcctgtctccatggtctgctgat

SEQ ID NO: 797 - DNA, 3400 bp, mus musculus
gctatgaatatatgttatacatgtctaacatcccaccaccacaatatttgtagccaaccaacacgtctgcaaactaatgtagtttaaaattgagtttaaatgagttttttttttttttaaataagtcttcttatttaggtgcggcaatgcctgtcagtaacttgggaaggcgtggcagaaaaattataggtttaatgccaagtggggctaaatattaagacattgcttctaaacaagtaaatagtctgtatatttgtaactcttaagaattaccatgtaatgatgggaaaatttaattttcatgtatagtgctgtgtctatcaaaggaaaattgcactggaaaacagacaggcacagagaactgtggtcttgatgattgcaatgtataagagagaaaaaaaccccaacttttctgaagtgatggggaaggtaaagtgctggggtgactagcagagagcagtggatggtactggatcagaaggaacttgctggtgtgtctctgtttgctaatctgcacctgtcattcaaatgtagtcaatcccaatgggactgggagtatgttctgatggttatagttaagtgccccaaaggttactctctggtcctcgaaaaagacattgcagccttgttaaattctcaatagtttaaggaaaggttagtatttaaagacaagaaacgtctagcagaatgatttctttttttcaaaagtaaatttttattagacattttatttatttacatttcaaattttatcccctttctcatttctcctctgaacctccccatgctatccccctccccctgcttactaacccacccactcccacttccctgtcctgccattcctctactctggggcattgagccttcacagggccatgggccttttctctcattgatgtcccacaaggccatcctctgctacatatgtggctgaagccttgagtccctccatgtgtactctttggttggtggtttagtccctgggagctctggggttactggttagttcatattgttgtttctcctatggggctgcaaatgatttctgaagcaaatggcctaagtaaagggagacaagagcccactgtcagggacttacttgaagtcaatccaggcagaaagaaaagtagaactctcctagtcagtcaaaaatttatacccttttcttttctttacccttctctctatttattcatctattacccttctctctatttattcatctatctatctatctatctatctatctatctatctatctatctacctacctacctatctatctatctatccatccatccattcatcatccatcccctctctctctctgtacatacatatgtatatatatgtatacatatgtatatatgtgtgtatgtatgtatgtatgtaaaaagttttggcaatccctatctgtctgtctgtctatctatctatctatctatctatctatcaaaaaattgtcaagacatagaaagtactcctcatttgtaacatccaaacaataaatactcataataaacaaatagagaagatgaatgtctagctatattatcagtagaaaaaagttgtctgtagtagtataagttgcatatgtacataaataagtaaatgttatatatatatgttaggtatcaatatgctcttaaatgtctccaaatattgtggaaaagtgaaagcagtaaacataaagaatatagaatttacatgatttggggattggctatttggaataactctagacaacacaaaaataagtaaatgtataatatatatttgcaattcagtatatgggaaaagatttatatatttctatttaactgtatacacacacacatgtgtgcttgtggttatatacctgtgcatataacatgttaaaataaatacttatacatctaaatatgtatattctaaaatgctcactataattttatttcctttcttctgattacttactaattgttaacatataattttacaaatcaacctgaataccaacacctcactttttcccttcctacagtccttcctttttcctaatcttcatttcattgttttgtcttttctttaatttattttttcttggtggtagtgatttgttgtctggtcctttaatatgctaagcatgcagcccacatcttaacaacaaacagcctctcaaatgttaaaatttcaatttttcattgttagaagaaatgatacatgttatgtgttttttgcttccactgctgagaaagttggggttagatttaaatttagtgcatagtagttatagtgtaggtttatttattttctttctttgcattattggttctgagcaggggtgtgaaacacagaaagacatagcagaagggatatatccatgacacctttccacagattacttcaagtgtttataaaaaatggttgagcaagatacatttttttttgttttttgttttgtttttgtttttgtttttgtttttcgagacggggtttctctgtagccctggctgtcctggaactcactttgtagaccaggctggccttgaactcagaaatctgcctgcctctgcccaggtcatgttttattttattatctacaagtttaatagctcaattattcatatgacttttattcatttatgtcaaattctctccaggataatttatgttctatgatatttgctctaaaagcttatatagtttcttcttggacaattctagttaaaatgtcatttagaaagtggagtatggttaaggtcaacaaacagttattggacattatgatctgtgctgtgctgtatatagatatcagaatgagttggttttccttctgataaagtttgataggtagatgagtgtatcagaaagactaatctaagtgaagtgttgtacattgaaattatcatctgcagaggggtggtaactaaaggattatgggacaaggctaactgaatataaattctttgctttgcacctgaatatttatttggtgtttgtcaaaaggattaacttttctgcattttaatttattatgtatcatatgatgacaatattaactttattgtgtttatctggaatgcatacttactggaggtaacaagcttaaaacagtgctaagttatattgttagtaatattatttatcactgtggctgaagagatggctcagcggttaagaacactgactgcttttgcagacgtcctgagttcaaatcccagcaaccacatggtggctcacaaccatctgtcatgggatccgatgccctgttctgctgtgtctaaagacaggtacagtcccacataagtggaataaattatttatcaccgtgactagtagagattggatggttgaggagggctagggactgtttcttaggatgtgctcttgcagagatgattcaggaccttggagg

SEQ ID NO: 798 - DNA, 1400 bp, mus musculus
cagcatttaaaagcacagacataaactgtgctcaatatgactgatggtcatccttaatcattgtctccatgcccttctgagatcttgtgtacaaatgtgaggaacattatgtcggccagcagtgatgttgagggagacagggtgtgttaacagtggaaagaggcagtgaaagtatttaagaaatttgtaattaaaagtaggaatagtaatccattgtaatttcctgctttgttgtgggaatgttgtgccattctgttcacttcccataattattttaaatttaaaaaataagtgtattactgtgtatatgtgaataggagtgtgggactgtgaaaggcagcctgttttttggttgagctaggtttaaaccccagtgactcagcaggtgttcctgcaaggaactgaaggctgtttgccatgctcccagacaccaggctcctgataagagacctcagctctccataattctgtggccattagtcacatagggcaatgccccaagtccctggtattctgtctggaccccacccccacagttatctgacaacatccaggcatgctcctctccacagttactgggcaacagtgatgtaggcctggcccactataaaaggggcttcttgttccctcctccctctcttattgcctctcttgctcccagtctcttcacattccctttccccctctcttcacatggccatggccagcctacttctctactctctccctctctctgcctttctctgcctctcttatctccctttcagagacactcctccctgcaaaaggtttttaacctcaggtctgccctgagaaagtggggtatgttttcactcaaaataactgcctgccataacaataaagccttaaaaccatccactgcctcttctcattgggaccaattggggaacaatgaagcaggtcttcctctaaagagcaacacttctagtttcccccaggaggtctctctgcattcacagccattgtctccaagccaagccgcctgaacaatcctaggacactctcatcctcacgggacccagccagagctttcctccagcccttttcccttctgcctgggctagagcctgcccgtgggcacccagtggtgtctgctgtgccaagagcaagaacctgccttctctggcttccatgcagccaggggacccagaagcccaacttccgcagttccttggggacctcagactgtgcctcccaggcccccagagcagggtcctgctgtttttcacagcctgatgcttgcatggtggtggcatggggtgcacacagtcaaacttcccatgtcccacctggcccagaggccggagccctcttaacgcaggaccccattttaactcacacaggagtgtgcatgagtgggtatatatgcaacggaatac

SEQ ID NO: 799 - DNA, 1200 bp, mus musculus
gagtctcatttccagaagactcaaatttcaataacacaaattacagagtacaagaaaaggaggagcataccatttatcaggaaggcagaaagaacgtgtatgctgtgctgccagaaaaattagctggaaagacataaacatgaactgcctaaaaatgtagcactcaactaaaacctgagagtcagtgtttggagtttataatgcaatgccttgtggctattttgcacttggattttcaaataattaaatattactataattatatttttaggtgaaaattttctacttactagattgataagagcatataaagttataatatagaaatatgagttgcggtattctgcacaggcctcagacatccggccactttccccgccagaggaaaggggtccgcccagcaagggagcgctttgcctgagcatctgcagcagatatcttggatctgggaccccgccgagtgatttctgcccaggtgagagtacagaatacagaagctaaaagcttctgggacaggcaggagccacagagcatctaaggcagccccctttttgggccccagacagctggccacctcccaggcagagggtaggggtcctcagggtccaggagcgcttggcctgagcatcggctgcagacatcttggttccaggactcctccgagagtattctgaacaggtgagagtgtagaatacagaagctaacagcttctgggacaggtcaaagcaactcagcttcaggacaggtcctgttttgggccttcatctttggccaggagggaggtcctaaggtcagatatctgtgcacctttcctgtaaaaggagagcttgcctgaggagagtgctctgaccactgaaactcaggggatagagctagtctaccaggtctgctgatagaggctaacagaatcacctgaggaacaagctctaaccagagacaactataataactagctccagagattaccagatggcgaaaggcaaacgtaagaatcctactaacagaaatcaagaccactcaccatcatcagtacatagcactcccaccccacctagtcctgggcaccacaacacaactgaaaagctaaacctggatttaaaagcatatctcgtgatgaaggtagaggacatcaagagggactttaataactcacttaaagaaatacaggagaacactgctaaagagttacaagtccttaaa

SEQ ID NO: 800 - DNA, 1200 bp, mus musculus
agctctttcccgagagtaaatgataaggcgttacacactcacagatgatgttcttaaagctttggtacagaaagcttgggtatgagatgtaggggctaagaactaactgcaattgttgctagttcttgtattgttgtttttacacatttctccaaagtttatattcttttttaaaaattaatttattttttacactccatattccattccctgccctccatgcaacccctgactgctccacatctgatacctcctccccaacctcctgtctccacatggatgcccccacccctacctcacctgacttctaatttccctggggcctccagtctcttgagggttaggggcatcatctctgaatgaacacagacctggaagtcctctactctatgtgtgttgggggcctcatataaactggaatatgctgtctgtttggtggaccagtgttcgagagatctcggagttccagattgagactgctgatccttctacagagtcacctttctccagagcttctttcagccttccctaattcaacaacagggttcagctgctgctgtgcattggttgggtgcaaatatctgcatcggactctttcagatgcttgttgagtctttcagaggacagtcataatagagtcctttttgtgggtgctcatgtcctcagtgatagtgtcaggccttgggaccctcccttgagctggattgcactttgggcttgttgctggacctcctttcccacaggatcctctccatttaaatccctataattctttcagacaggaacaattatggatcagacatgtgactgtgggatggcagccatatccttctcttgatgacctgtcttcctgctggaggtgggttctgtaagttacctctccctactgtcagtcacttcatctatggtccctcactttgattcctgagagtctcttacctcccaggtctctggtgcattctagagggtcctccaaccacctatttcctgaggttgcttgtttccattctttctgcttgctgaccctcagggcttcagtcttttcccttacccaataccaggtcaagttcctctctcttcgcactccaccccttatggactttccctcccaggtcctcctctacctccccacttgtgattgctttcttctctctccccagagggacttagatgtcctcacttgggcacttcagcttgttg

SEQ ID NO: 801 - DNA, 1400 bp, mus musculus
ttgttttgttttgttttgttttggtgtggtgtggtgtggtgtggtgtggtgtggtgtggtgtgctttgctttgctttgctttgctttgctttgctttgctttggttaggtttggttttttgagacagggtttctctgtgtagccctggatgtcctggaactgactctgtagaccaggctagtcttgaactcagaaatccgcctgcctctgcttcgcaagtgctgtgattaaattcgtgtgccaccacttcctggcagttcagtgtttttagcagattgtagaatgtgttaaacatgggtctgtgattcttttgtccaattttctgaggaaccaccagactgatttccagagtggttgttcctctttctccacatcctcgccagcatcttctgtctcctgaatttttgatcgtagccattctgactgatgtgaggtggaatggacctggagggcatcatcctgagtgaggtaacccaatcacaaaaggactcacacaagacgtactcactgataagtggatattagcccagaaacttagaatacccaagaaataagatacaatttgctaaacacatgaaactcaagaagaacgaagatcaaagtgttgacactttgccccttcttagaattgggaataatacacacatggaaggagttacagagacacagtttgcagctgagatgaaaggatggaccatctagagactgccacacccggggatccataccataatcagcctctaaacgctgacaccattgcatatgccagcaaagttttgatgaaaggaccctgatatagccttctcttgtgaggctatgccggtgcctggcaaacacaagtggatggtcacagtcagctatggatggaacacagaatcccaatggagaatcttgagaaagtacccaaggagctaaagggatctgcaaccctataggtgaaacaataatatgaactaaccagtacccccagagctcatatggctagctgcatatgtagcagaagatggcctagtcggccatcattggaaagagaggccccttagttttgcaaactttatatgccccagtacaggggaatgccagagccaagaagtgggagtgggtaggtaggagagcagggtgggggaagggtatgggggacttttgggatagcaggatagcatttgtaatgtaagtgaagaaaatacctaattaaaaaattggaaaaaaaagaaattgagcacatatgcaaagagaaattagatatgagataaaaataaaaaatattcattaaaatgtgatcatattttaatataatttttagtaataaatacaaaatacatgctttattctgtattcattcagttcatgatttttttttttcttttagcaagtaacagctactaaaaaatgccttcaac

SEQ ID NO: 802 - DNA, 1200 bp, mus musculus
gtcttttatgtaattttgtcatgataatcaagtaaacactaaaggtcttcagactgtatgtttgagtggattgatgcatacaaatatttatatgtagataacactaaagaaaatccactgtgttacatatatatatgatatatatatatcatagactgtagaaattttttttactttttattaatctttttttatagtccagttgttatccccgccccgtataccctctgactgttcctcatcctacttcttccccttctcccagacgatgtccccacacactaccctacaagccctccccaatccatgggtcctcaagtctctccagggttaggtgcttgttccctcactgaggccagaccaggcagtcctgtgatgtatatggatccagggcctcagaccaactcgtgtatgctgcctggttgatagttatgtgtctgagaaaatatctggagtccaggttaattgagactgctggttttcttgtgggttcaacctcctcctcggcttcttccagcttttccctagtgcaatcccaaagattcttggcttctgtccattggtgaggtgtaagtacctgcatctgactctttcagctccttgctggatctcctgtctctaagcataccatagcatgagtaatagtgtcaggccttggagcctctccttgagctggatcccaacttgagcctgtcactgaacttcctttcccccaagtctcttctccatttttatctatgctgtttgtagtggctattcctggttgtcaacttgacaatatttggaatgaactacaatccggaattggaaggctcaccagtgacccttatctggaggcttggagatccttatctggatcttggtttgaagatcttgagccatagtggctatggattccagaagattgaatctcagagtttaaggaacacgcctttaatctgggctacacctttcatctgggattaaaggtgtggtggaacacacctttaatctgggctacaccttctgctggagacaatataaggacattggaagaagggagtctagctcttgctcttgctccttcgcctgcttgctgcgtgagactgagtaactgctagatccttggacttccattcacagctgcgactgaaccattgttggaaattgggctgccgactgtaagtcatcaataaattcctttactatctagagactgtc

SEQ ID NO: 803 - DNA, 1200 bp, mus musculus
tgtccgcttggtggcgatcaaggtctttccctaatttgttccatgatgcaatagtaagggaaccccactctgtccacttccttcacaaaacttcttaggatcttggttccaatttttatgccacatcgccctagaacggcctcaagtgtaggaatgactgattgtgatgatcccatagcgactgcagcttatctatgtcagtcttacaaccgccgagaaaatgaaagtaaacacaccatgcctgcggcttatctgcgtctgtcttatgggcagcgacttacacacaatgaggcccacacaccattcctttatctacaggaggtttatggtggagtcccagagggtgttgccgctcatatacctaggacttacagacaccgactgggtcaacaaaaaccaccgtggaaacagatgactaagagaatcaggacgaggacgacaaacatcacagcaaagatcaggctgaaccgttcagaaacagacatgcctctcctaacttacctccctgcagttctgaatcctccttgtatccaaggggtcttgttaggtgctaaggatgttgaagtctatcccgggttttcagcaccagatgatgtcccgcgctacctcccgccagcaggattaacagggcacacaggattcttctgcagtaaagctttaatgtgtcttgagagggagagcatcagcttacagagtgaagaccctgaatggcaaaaccccgtcccttttaaggagaattatcctcagtctcggatgtgtcgctccctgattggctgcagcccatccgccaagttgtcgtcacagggaaggcagagcacatggagtggaaaactaccccggcacatgctcagattacttgtttactacttagaacacaggatgtcagcaccatcttgtaatggtgaatgtgagggcggctcctcacagaacaacaatatgaactaaccagtaccccctggagcttgtgtctctagctgcatatgtatcagaagatggcctagtcagccatcagtggaaagagaggcccattggtcatacaaactttatatgcctcagtacaggggaaggacagggccaagaagtgggagtgggtggttgggggagtgggtgggggagcatgtgggggacttttggatagcattggaaatgtatatgaaatatatacccaattaaaaaatttaaaaaaaaagaaagaaagaa

SEQ ID NO: 804 - DNA, 1000 bp, mus musculus
gcgccaccaggctgggcttgaatgatttgttaaaagcaatccctttagactatgaaaactttggtttttacttaactcaatcgaatttatctggaaaatttacaattattgtttttcatcattttctttctttttattaatttatgtattttacttaatcattttccatcctgctcactgctgccctctctgccaacatctcccacaatccttccctcatacccccttctcctctgagctgctggggccaagctgggtatcctcccatcccccaccctgacactttatgtctctgctaggctaggtgtttcttctctcactgaagccagacaaggcagtccagctagaagaacatatcccacatataggcaacagcttttgggataggcaacattccagttctttaggaactacataaaggccaagctgcacatctgttacatatgtgaggggagtcctaggttcagccagtgtatgttcttttgttggtggttcagactacctgggataaaggaagcacccagaaatcagtggggatacttttagctgtaactcacaacagcgggatatggaacctgaaaaatccacctcctaagccagacaagaatcccaatggaacaaaagagacaccaacccacacagcaaacatttaaccctgaatatatcctgtttgtaagtgatgcagatattgggggatgaagcagagattgagggaatgagcaaccaatagctgtcccaacttgatacccatcccatggacaaacaccagtatctaatactattaatgatatgctcatgtttgcagacaggagcaagtgtactctgtgagacagcacccagcagctgactaaggcagatatagacacacatagccaaacagtggatggagcttggagactcttatggaataagagtcaactaatcaaaaggatgttaacatagacataacatgataaatgaggaaatttcagaaaaatgaaacattaacttcttactatct

SEQ ID NO: 805 - DNA, 1400 bp, mus musculus
agcaagttatattcttgaactttgtgagttagggaacgaagctctccatagacagtgcttccagagtttcacattctgaaggaatgtggaagagtctccaaatagagcactcttgtgtgtcagctcatcaatgtcttacatagcacactaccatttgtgacttggttgggaaggcaggctagcagaagtttttgcaggctggaagtctggtgttcagatttcattacacatttcacgctcagggttagcctactttgatgtgttatctgtgtttgctttctctcccctgtccagttcttgctgagtttttagatggcacacctgtgtgacattcactggtagagacaattgacaatgatccacatggacaggtgagcatagcgccagtcacggtggctgccagaagtcctacatgttagatgttcatttgttgtaatgtgtctgcaggtaacgcactggcagagacacataagggtaatctactctgtgacactggttattgtgagcaataaagttggctccatcaacaggcatccaaaactgtctgtggtaggaattctctggcatcagatcaaagctgatcagtccctgggtcagggattcaggaagaaaagattggtctctggaacagaagccctaggcttcctcctttccttcattacattcatcccatcaacactctgctttctttatttcaaagtgtaaaatgtggaatgcaaaataagattggcttaagttgggtgttttatattattttctgtgctttattttctcaaaaggctgtggatttgtgggtcagaagaacagtatgaattcatgtatatagggaagatcagtttataactatcagtgattgtctccataaggagtgtgtccttggaagtttcatcaaaatcaaaatgtagaacacctcctgttgatgggaaaagggaggttttatactggtttttgtttgtttgtttgttttgtttttttattgttcatcaaattatatactaatagaaacttataagaaaaatgatttaacctctagtctacaaatggatgcttgactagtaattcagattcctaatctcaatcactcagaaggcaaaggcataaagagcagaagagccaagacctgcctgggacaatcaatgactttaagcatagcatgggtaaataaaaagtgtgtcaagataaaaagtgaacaagaagctgtatggtagaacagtagaatgcatagggtgtttatctagcatgagtgtaacttagtctccctaccctgctacaaaagaggggtgagggaggggaagaaggaaggaaagaaaagattattcaaatggagccagaatctaactttcctactcaaatggcaaatagaccaatgtgagctgacatagccagttaaatttagagac

SEQ ID NO: 806 - DNA, 1000 bp, mus musculus
gatattatcatctgcgtgcaccaccacctttttgaggaattgtcaagatacaagcacttaagcagcttaagatacagagcttagtactctggtgctgcctttctcacctagtataaagaagcaatccatacagcaagtacatcggaaagccctgtataagcattctttattaggtatttcttcatttctcaataatggagtcacaacatctgtggagacttggctatctcatccagaatgaatcactgttccccacaataccaggaatgtcgagattctccggaatctttatggatgaacaaaagctaatgattgtatataccagatttttttttttttttttttttggacagggtttctctgtatagccctggctgtcctagaactcaatttgtagaccaagatggcctcgaactcagaaatctgcctgcctctgcctcccgagtgctgggattaaaggcctgtgccaccactaccggacatatagcagatttctatatatactagaactttggtgcaaagaataactgtcatggtttctaaaatactacgtgaataaaaggttcatagaatctgaattaatttgtgtatagcataaactgggctaagcatacatagtataagatgccttgtcatgcaaaatagccaaaaacatgagccatctgcttcatagaattcaagggaaatgattgaatgatagtactgaagtagtggcttgttggacaagtatgtctctggcagaatccagtggcatcccttgatttttccagccaatggtactttaaaacatttcttcatgttaaccctatcacactgaaataacttatcaggacttgataagacattgagtctgagctgggcagtggtggctcaagcctttaatcccagcacttgagaggcagaggcaggcagatttctgagttcgaggccagcctggtctacagagtgagttacaggacagccagggctacacagagaaaccctgtctcgaaaaacaaac

SEQ ID NO: 807 - DNA, 1000 bp, mus musculus
ttcctaaattcctccatcatcatcatgagaagtgactttagatccatgtcttgcttttctggtgtgatggtgtatccaggacttgctatggtggagagtttggttctgatgactcaaagtaaccttggtttctgttgcttcttttcttatgcttgcctcctgccatctgattatttcaagtacttgctgtcctcaatatatctgattggagcctgtccttcctataatctcagttgatttaggactcatcagattctatctttctctgtgattctttgattgtgggctcctgtgaacctgagattctggttatgtcagaattcttggcagtaaagttcctctgagaccatgaaatactggtccgacccagctcctgttattctgggatactgttgtcctaagatcctgggtgtgttacagtggtgtctcctttgaggagcgtggagctgtctggtcagtggtcataagattacgtggagtgtcctctaggaaccttgggggtgtctgccaactctgtgtccaaggtgaccctgtactggagccaactggaagggactcgtgtccctggtcaggccagttttctgcttccctaatgctttctcaggtcccgagcaattgtattggaacagaagttgagttccactcaccagtggtcctaagatcgtgtggagagtcctctagggactgtgggggtgtctgtggactctgcacccaaggtgacctggtggtggcaccaattggaagggacttgtcagcttttcaattttatgaggtcctattgatcaattcttgatcttagagtgtaaaccattggtggtctgtttaggaaaaaattccctgtgcccatatctatgaggttctttcccactttctcatcagttagattcatcacatctgcttttatgtgaaggtccttgatctacttggacttgagctttgtacaagaagataagaatggttcaaactgtgttcttatacatgctgagagctagttgaacca

SEQ ID NO: 808 - DNA, 1000 bp, mus musculus
ccgagttgggacagggactcctcaccaactgagggcctctctcttgctcagtatacttgctggggtgggtggtccagggttttttactccttggaggccatgtaggccaggaggtccaccaccctgtttctgtagccatattcattgccatgacaggaaatgagctttacaaagttgtcattgagagaaatgccagccccagaatcaaaggtggaagactgagatttgctgttgaaatctcaggaaacaacctggtccccagtgtaaccacgtgatgccctttagtgggccctcagatgcctgcttcatcaccttcctgatgccatcagacttggcaagtttctccaggaggtgtgtcagatctacaacagatacattgggagtaggaacacagaaggccatgccagtgagctaccctttcagctctagggtgaccttgcccacagccttcacagcaacagtggatgcagtggatgttctgggcagccccaatgccatcacgccacagctttccagagggaacatccacagtcttctaactggcagagatggcatggaccatgttcatgagcccttctacgatgccaaagttctcatggatgaccttggggggggggggggcgctaagcagttggtggtgcaggatgcattgctgacaatcttgagtgagttgtcatatttcttgtggttcacatccatcacaaacatggggacatcggcagaaagggcagagacggtgacccttttggtcccacccttcaagtgggcccccgccttctccatggtggtgaagacgccagtagactccacgacatactcagcaccagcatcaccacgtttgatattagcaggatctcgctcctggaaggtggtgatgggcttccggttgatgacaagcttcccattctcagccttgactatggggttgaacttgccatgggcagagtcagactggaacatgtacagcatacggttgaggtaaatgaacgggtcgttgatg

SEQ ID NO: 809 - DNA, 1200 bp, mus musculus
agaaaaatacatttcttctcatatacagaacttaaatttaaaatggtgcatacgtgaatgtatgtgcaggcatgtacatttgaaagtcataaataagacgagggtaatgaagaagagaccttaagggggcaggaaatagagtaatggaatccatataataggaaagcagaaggactaaggggaagaaacagctgtagaagggaaggccacaaggagaaccagtgaagaggataataaatgaaaccagaatagtgacatctacatgtgaggatatcgtgatgaaaaccattgctatgagtgctactttgaaaaaaaaaaaaagtcaaaatggaaaacattctcagttccactcttccagaggaggaaaaattagttacatactatgtatgctctttttgtaagtagctttgaaaaggcaaaacagaagagtataaaactaaaaatcattccactacacattccatgtgtaaatacagtctgtacttcctgtttgtaattattggatatagactttcaaaggcctttgcatcatcggtcatgagtgctatgagcaggagcatttaatcataagaggattaactatccttgaaacatctttttcagagctcccagggactaaaccgccaatcaaagaaaacacatgatgggactcatgactctagctgcatatgcagcagaggatggccttcttggtcatcaatgggaggagaggcccttggtcctgtgaaggctctatgccccagtgtaggggaatgccagggccaggaagtgggagtgtgtgggttggtgagcagagggaggagagaagggatagagggtttttggaggggaaaccaggaaagggattaacatttgaaatgtaaataaagaaaatatctaaaaagagagagagagagggagagagagagagagagagagagagagagagaggaggttaaaaaaaaggaaacatcttttaacctagaaaatgcagaaggtaaatgtttgtatgctgcgagcatttgaaggaaaaatagccaaacttgaatttagaagtgtggcaacaaagagttatgatatagaagcttttgatggaccactagctcaagggagatctaacctttgaacgttgatatcatctataatctttgaataagatgatttagtaaaactcactcagttatgcttgaagacataactcagtattagggcacttattta

SEQ ID NO: 810 - DNA, 1000 bp, mus musculus
tttccacccacacagtaacattttaggagaagaattggatagagaccaaggtctgtacaaacttctgaacaaggaaacactgcatacttcctggttggcaaaagcaccattgtgctagttacctgaggtaacttggagactgcctccagcccagacctggagggttatttcttctagtgtggtagtcaccagctgtgccctttgtgataaattaggaaacatcaataaaatgtctccctggtgtcagtgattgcagcaaagatgggagctaagatagagttgtgagagctataattttgtagccagttgatcaaaagtacagctgggggacagaagtggggacaggtagcaaccacatgatacttcacaaccacctgtaatgggacccgctgccctcttctggtgtgtatgatgacagtgacagtgtactcacataatcaatcaatcaatcttaaaaaaaaaagtataaaaaataaagtacagctgggctgggattgagaattgttttctgaagtagaggttgcttgtcggattggatcttttaacttatggactaaaactaagattgtgacacatcagggctcaattaaaataaactggagatgttggcaaatgggagacatagttgacattagaaaacactggcacataggggatggttcaaagttaatagtagattaaataaccaattctgataattattttctgctctctaataaagtactaaaaaaattaatttcacagtggatggatcatggggactcttatggaagaataggagtaaggattatagctccaaaaaggataggaactcctcaggaaggtacaacagagtcaactaacctggacccttggggctctcagagactgaactaccaatcaaagaacacacacaggctgtggcctccccactcatatgtactcagggggtcccctacccactcagaggagaacgggagaggggatggaaaaagcattgtgggaggggggtgatcgagag

SEQ ID NO: 811 - DNA, 1000 bp, mus musculus
aaccctctgcttcctgatgttgtcttctatcttgcttctagaagagcttcagaaattactactgattacagatgatcttgcttcatccaaactagatagatctagtgagaatttcatacaagccttgagactcctaaacatacagagattgtgtgctcttcccccagccttgagttggctaaacaagactcctccgatgctggagccagcctcccaacatttacatcttcctgcctgagaagtgagcaactacctgcccgctgagctgctgaagagctagcttgttttgaaacagaatccagctgacacaaagcaacagaatccagccagaacaaaggatgggcttttgggtttccccctataaattcagagttaaaaaactaaacattgagccttggtcagagaacttttgtagccgcctgtggccacacggactgggttcccgagtggaaggccggagctgtaaatgagggaacagcgagagaagaaacgagaccaacacaaagtgctgatcaaggtccagtgtttacaagcagtctgtgcttataaagggggaaagcccatctcccgctgatccactcttgttgcctgtcgccagcctgtaagcaattaggttgacagcactagttcggcagtaaggtgtcaggcgccagttgctggttgtctcaggaatttctcaggaaggcagattcagcttctcagcaggtagcagcgtcttggaatagagcagcagcaggtgacagacaataaagccatctaggtaggaaggctccaccccaggtggtcttattcacagtggcagacaggtggtcttattcacagtggcagacaggtctgaatcgggcctgctcaaggctgggagaggctacaaactttgtcttggcttattgtttctctcatctgcccattctattccatccccagctcttcttccagatacacccggttctccatggccactggacagttacaaaattggataactgatgccctattagct

SEQ ID NO: 812 - DNA, 1400 bp, mus musculus
tctccatggtgatctgtatctatcatcccttctatcattgttattcctttcttagcctgttagtttaaggacattagaagcccaaaatgaccaagggaaaatcttagcttccagttcaatggaatgcttgttgtggattctgataggagtattcgcccttccggatccaaagctcctatgccaacaggacctaggattgtgaggaaaggaagaaaaactttcctatagggttactaggagtgatagtgagtgtaactattcctttttacacaccttgattcccagacctgtggatcctggctatgagagacactttaccatataccagaagctgatgcaaaacatatactttcttctgaagaattctgcccagccctccatgctgttgctacgtcattagcactgtatctgtgtctacaagaggccattccatctttctatcatactagatgcttcaggatggtggggagcattgtagataagaccaacagactccatgattattgacccagagtcacacttctgtgaaatgagttcattggtcagaagcaatactgtgtggaataagatgacagcggataaggtattctgtaagtccatggatggtggtttggggagaagcattaaatgcaggaaagggaaatccattaccaaaataaatatgtacttcaataagaagagactgttgccctgtccacagaggaagtggtagaatgtaatcaacctgccaacaggttgctggctggtcacctcaaggaatggcatcatatctgggattcagtgttggtctctgctgttggcagatctgacattcagcagcagctgtagccaggtcaaccttggtaagtgtaagtcaatattgttgagctttacccattcggagagatctatttacatactaattacccaaatgtctttcctcacaaattttccaatcatgatcttcctaagtccctaaccagccagccaatccattggctatagcccatgaggcactgaataattgtacatctgaacccttcttcttccaaacaaagtttaaaaccatttgtactgcctggacttctgtccactgtgaagattttctttcacctgtatttttcaggcttgtcccagataggggttgtaatgctggagctgtccacttctgggtagcacgtacataacattcagaaaagtcagtaaaccaagtcctggaattctcctctttggtcacccaatcagagggactagaggtgcatgcttgacagccgatgacattgtaaaaggggtagaaaccataagcatttgaagagtatctttatgtaacttccttgttccagcaggacctgctgggcttgattgcatatacagtacttccattagctaatagactaccagtgtgcatgtcctactttata

SEQ ID NO: 813 - DNA, 1000 bp, mus musculus
aaaatggaaaaaaaaataaattaaaaaaaaaaagatcaggtaaactatctaaacaggaccatatcatacaaggaaatagaagaagtcattaaaaacttcccaactggactccaccaaaagtagtctgcacaggtgagagtgtgccctacagacgctaacagcttctgggatgggcgggagccacagagcttctgaggcagcgcccttttagggctccagacatccggccaccttcccggccagagaacatgtgtccaccctgcccgggaggcttttgcctcaggatcggcgggagccatcttagttccaggactccaccaaaagtagtatacacaggtgagagtgtggactacagaagctaacggcttctgtgacaggccaaagcaacacagcttctgggaaaggtcctgttttgggccttcatcttcagccaggaggaggtctgaacaccagatatctgtacaccttccatgtaagaggagagcttgcctgcagagagtgctctgaccactgaaactcagaggagagtgcttgtctcccaggtctgctgacagagggtaacagaatgaacagaggaacaatctctaaacagagacaactataaaaactaactccagggattaccagatggcgaaaggtaaatgtaagaatcttactaacagaaaccaagaccactcaccatcatcagaacccaggactcccacttcacccagtccagggccccccaacacacctgaaaagctagaccaggatttaaaagcatatctcaagatgatggtagaggacatcaagaaggactttaataactcacttaaaaaatacaggagaacactgctacacaggcagaagaaattaaagaggaaacacaaaattgccttaaagaattgcaggaaaacacaaccaaacaagtgatggaattgaataaaaccatccaagtcctaaaaagggaagaagacacaataatgaaaacccaaagtgaggcaacactggagataaaaac

SEQ ID NO: 814 - DNA, 1800 bp, mus musculus
ttttttttctctatttgtacagttgccatgggcactcttttcttagtgctctttccctactgctattaatctgcctttccatgggtccaatatcaagtggacaactgatggatcataagatataaaactataaatcatctctttattagctatagaaattgtattcctaataattttattatcaggaagctttctaacatagatactggactttgattctaaagtcttgttttatggtatttgtaagcagcttagaccactattttgagagatgatgtaatattagaaagttgaagtgaaatttctggtttctttggagactcagttgtgtcatgtgatggttttctgagagttgtttcataagaggatattttgataaatcagactggtgagaggatactttactgagagaagacatgtagtcttttctagaagttctcgtgtgaaagggcatttgatattttgctggaacagatgcttggcagaacagatgatgttgaaaagggtataagacaaaggaaccctgaccaaccagaagctgggatccattccagttcgggacaccccgccatcttctgcctgaacccagcagaggtcactaaaggctccagagtactctccatgccataggacttcgggatcacaggtgagtggaacacagcatcagctccaaggagggtcttgtgcccacaggaacagggaagaaggaaccccgcccaaccagaggcagggatccattcaggtcgagggccagccatcttctgcatgaacaggccaaggacatctaggaccccagaggactctccatgctacagcacccttagcacacccaggacctcatgatcacctgagagcacatggacgacagaagcaacagagcttcttggacagggtcctgtcaggacttaatcctcagccaggaggcagagctaagacccagacacctggtcaccttcattgccagaggagtgtcagcctacagggagggctctgaacccaggactcaggaattagatcagagctccagacttctggaatcctgacctgaaagaggacagctttcctgcagagagtgctttgatcactggaactcaggtgagaattggactcccaagagggctgacagaggctaacagaatcacaggaggatcaagctacatccaaagacagcttgaacattaacaccagagattaccagatggcaaaaggcaaatataagaattttactaacagaaaccaagaccactgggcatcattaaaacccagtattcgagtcctgaataccccaacacacctgaaaagcaagatgcagatttaaaaccatttctcatgatggtggtagaagattttaagaaggaaattaataaagaaatacaggaaatacttaaagaaatacagcagaacactgctaaacaggtaaaagtccttaaagaagaaatacaaaatcccttaaagaattacataaaaacacaaacaaacaggggatggaattgaacaaaatcatacaagatctaaaaatgatagtagaaacaatgaagaaaatccaaagggagacaactctggggatagaaaacctaggaaagaaatcaggaagaatatatgtgagcatcagcaagagaatagaagagatggaagagagaatgtcaggtgcagaagattccatagggaacatggacacaacagtcaaagaaaatgcaaaatgcaaaaagatccaaactcaaaacatccaggaaatccaagacacaatgagcaaaccaaaactacagattataagagcagatgagaatgaagattttcaac

SEQ ID NO: 815 - DNA, 1200 bp, mus musculus
caccaatccctgactatttcaacacagctaaatcataacaaaaatgatcataggtcctgaacaacttggaataccaggggaacctccattctgcatccacctctcacactaccttcatcagtaatgcaggtcctgagccatataggtaagcttccctttacagttccatcttcactgcttgctgagccctctgttctaagccaagctgtaatgacaagctggtatttcagggagacctccattcagctgccacctctcccctcaccttcaccagacctccagatcattaaccacacagataagcttcccttttcccaccaatcatgccttctctctgaatcatttgggctacaccaagttgcctaaacagtctgttatcccaggggacctccattctcctgtcaccattcctcctaccttcatcagacatgtgacatctgaaccatacaggttacctttacttcacatacccatcattcctgaaatctgagccctctgggctaagccaagtgctcttgatcagcttgctagcccaggtggaacattatttcttcaccacctgccctccactttcatcagactcctgaggaatacatgtaagcttcctttagaacactcatcattcctgatctctgagccctctggtccaagccaagctccaatgaggggcctgctggcccaggaggactttcatttttctgccacattaaaggcagctctctggctacattcatcaagtcctgcagctcctgtactgtatagacctgcagattcagaaccacacaaccaaatgatatccatcagtggcctatcacatcgggaccattgatgttcaccccctcctaatacatactacaacaagaaaatccaggacaaaaaccagacagatgacgactggacttttcaagaacatagtcaacaaaagcaagggcaatatgccaccgccaaagcacagataccccaagaacgcaagccctgtgtatcataacacaactgtaacacaagaaaatgacattaaatataatattataaagatgatagaggtcataaaagagaaaattaatagatcccttaaagaaatagaggaacatataatcaaatggatagagctctttaaagacaaaacaaacaagttgcttaaaatatatacaactaaacaagtgcagaaacttatttgaagagctgtgcaagacctgaaag

SEQ ID NO: 816 - DNA, 1600 bp, mus musculus
tctcaaaccaaatcctggaacacattaaacacattatacaccaaggttaagtaggtttcattccttggatggaatgcagggatggtttaagatatgaaaatccatcaacctaatccaccatataaaaactgaaagaaaaaaaatcacataattgtctcattagatgctgaaaaagcctttgataaaatccaacacccctttatgttgaaggtattagagaaagcaggcataaaggaaacatacctaaacataatcaaaagaatatatagcaattcaatggccaaatcaaattcaatggagagaaatttaaagctattacactaaattaagggacaacacaagacttccaactctctccctacctactctaggacttgaagttctagctaaagcaatacaaaaactaaaggagatcaaggagatataaactggaaaggaagaagtcaaagtatcactatttgcagatgatatgatagtatatataagtaatcccaaacttttatttgatcattcagaataatcaaatgaatttatttcttttttttctgtaaattatcttcctttatttattagatattttctttatttacatttcatatgtaatctcctttcctagtttcccctccaaaacccacctatcccctccccgctgcccctgctcaccaacccacccactcttgcttcctggtactagcattcccctacattgaagcatccagcattcacaggcccaagggcctctcctcccatggatgaccagcaaggccatcctcagttacaaatgtagctgaagtcatgggtccctccatgattactccttggttgatggtttagtccccaggagctctgggggtactggttggttaatactgttgtttcttctaggggattacaaacccctttatctccttggatcctttctctagctcctccactgggaaccctgtgctcagtccagtggttggctgagaggatccacatctgtatttgtcaagcaacagcagagcatttcaggagccagctatatcaggctcctgtcagcaagcacttagtacttaaagtcaagccagagcaattagataacaaaaggaggtcaaagagattcaaactggaaaggaagaagtcaaaatattactatttgcagatgatatgatagtatacttaagtaacacccccccctcataccacaaactttctaccaggatctcctacaggtgataaacagcttcagtaaagagtcgagatacaaaattaatgcaaaaaatcactagctttccttcacacaaataataaatgggccaagaaataaattacaaaaacaacaccctttccaataaccatgaataatataaaatatcctggaggaactctatggagcaagtgaaagatctgcatgacaaaaacttaaggtccttgaaggaaagagtgaaggagatattaggagatggaaggatcacccatacgcatggataagtagaactaatatcgtgaaaatttacattttcctgaaagcaatctacagactcattgcaaacctcatcaaaaatccaatacaattttgaaaaaaaccttgaaagagaaattctcacctttatatatt

SEQ ID NO: 817 - DNA, 1800 bp, mus musculus
cctcttgagttcatggaagtgagaaatttatggatggagaatagaaatgcaattgtttgaatatgttctttagttctccatgtattttaatgacttggtccctagaacagatttagtagaatattgtgaaacctttaagggaagagattggggaagtctcaggtggcttgtgacattccttctatgggtactgtggttcagtgttccattttttttctctatttgtacagttgccatgggcactcttttcttagtgctctttccctaatgctattaatctgcctttccatgggtccaatatcaagtggacaactgatggatcataagatataaaactataaatcatctctttattagctatagaaattgtattcctaataattttattatcaggaagctttctaacatagatactgcactttgattctaaagtcttgttttatggtatttgtaagcagcttagagcactattttgagagatgatgtaatattagaaagttgaagtgaaatttctggtttctttggagactcagttgtgtcatgtgatggttttctgagagttgtttcataagaggatattttgttaaatcagactggtgagaggatactttactgagagaagacatgtagtcttttctagaagctctcgtgtgaaagggcgtgtgatattttgctggaacagatgcttgacagaacagatgatgttgaaaagggtgtaagacaaaggaaccctgaccaaccagaagctgggatccattccagttcgggacaccctgccatcttctgcctgaacccagcaggggccactaaaggctccagagtactctccatgccataggacttcgggatcacaggtgagtggaacacagcatcagctccaaggagggtcatgtgcccgcaggaacagggaagaaggaacctcgtccaaccagaggcagggatccattcaggtcgagggccaggcatcttctgcatgaacataccaagggcatctaggaccccagaggactctccatgctacagcacccctagcacacccaggacctcatgatcacctgagagcacatggaagacagaagtaagagagcttcttggacagggtcctgtcaggacttaatcctcagccaggaggcagagctaagacccagacacctgggcaccttcattgccagaggagtgtcagcctacagggagggctctgaacccaggactcaggaagtagatcagagctccagacttctggaaacctgacctgcaagaggacagctttcctgcagagagtgctttgatcactggaactcaggtgagaattggactcccaagagggctgacagaggctaacagaatcacaggaggatcaagctacatccagagacagcttgaacattaaaaccagagattaccagatggcaaaaggcaaacataagaattttactaacagaaaccaagaccactgggcatcattaaaacccactattcgagtcctgaataccccaacacacttgaaaagcaagatgcgaatttaaaaccatttctcatgatggtggtagaagattttaagaaggaaattaataaagaaatacgggaaatacttaaagaaatacagcagaacactgctaaacaggtaaaagtcgttaaagaagaaatacaaaatcccgtaaagaattacataaaaacacaaacaaacaggggatggaattgaacaaaatcatacaagatctaaaaatgatagtagaaacaatgaagaaaatccaaagggagacaactctggggatagaaaacctaggaaaaaaattagga

SEQ ID NO: 818 - DNA, 1000 bp, mus musculus
ctctattgattatggaccaaacaataccataatatgataagacttttgctacgtggagggtcccaaactccccagaggaccctccacaccgcaggcacactagcacacccaggatcttgagttcactggtgagtggaacacaacatatgttccaaaacacatggagggttttgtgccagaaggaacagggacaaaggaaacccattcgaccagtggctggggttcattcaggatggcgccagctccatgccatcttgggcatgaactcaacaggccctagcacacccaggatcttgggatcactgagaccagtggatgcaggagaacacatgggcaacagacataaagagaatcttggacagggtccctttgggccttcattctcagcaaggagttggagctgagacccggaaccctgggcaccttctccatcagagagttggcctccagggagggctctgactccaggaatcagaaggtagatctgagctccagacttctaggcaccttccctgcaagaggagagtttgcctgcagagagtgctctgaccactgggactcaggagatagttgaactcccaggagtgctgacagaggccaacagaatcacaggaggaacaagctccagccagagacacctagagcatctaacaccagagattacaagatggctaaaggcaaaagtaagaatcttactaacagaaaccaagacaactcagcatcatcagagtccaatactgccaccacagcaattcctagacaccgcaacacacccaaaaagcaagattcaaatttaaaattatatctcatgatgctggaagaagaatttaaaaaggacattaataactcacttaaagaaatacaggagaacactgctaaagagttagaagtccttaaaaaaattataggaaaatacggctaaagaagtagaagtccttaaagaggaaacacaaaattcccttaaagaattacaggaaaacacaaccaacaggtgatggaa

SEQ ID NO: 819 - DNA, 1000 bp, mus musculus
tcagacccaaaaagacatgcaaagtatgtattcagtaataagtggatattagcaaaaaaaaaaaaatagagaatacccaagatacagtccacaaaattcaaacagatggacaaactgatggacccatgtgaggtagtctcagtcccacttgggagggagaaacagcaatcacaagtgtggagggaaagatggatctgggagggaaagtagacagtgtggaagaagaggggaccctgatcaggtattgggtgagagagaaggagtgaagccctgagggccagcagaaaggatagaaacaggcaacctcaggaggtaagaggttgagtagaccctccagaatgcaccggagacctgccaagtgagagattcttacaaccttagatgaaatccccgacagtagggagagggaaattatagattccacctcccactggaagacagggcatcaagtcagggatgctatcccaccaccaaaactctgactcataattgtttctgtttaaaacaacagcagggatggaaatgcagaggagcctgaagaaaagaagttccagcgacaggcccaaagtgggatccagctctaggagaggtcccaaggcctgacactactactgaggatatggagcactcacaaaaaagggacctagcatgactgccatctgaaagacccaacaagcaactgaaagagtcagatgcagatgtttgcaccccaccaatgggcagaagctggtgacctctgtgattgaattagggagaaactggaagaaggtgaagaggggagcgaccccgtaggaccgccgagatctctcaaacactgaaccaccaaccaggcagcatacacagctgatatgagtcccttaacacaaatacagcagaagactgctaggcctgggctcagtcagagaagatgcacctaaacttcaagaaacaggaggccccatggagtttagagttatgtttgagtgggtggtttgtggtggggacatcttcgtggagacag

SEQ ID NO: 820 - DNA, 1200 bp, mus musculus
tggaaaataaatggtcataattaaacattatgcaaaacatatagttgttaataaaggtgagaatatccccattgtcagagtagacctctttattattcagacttacattcaaattataatataaattttgttccaaaattctagcaaaagagatgacttctctaatggaaataattgaaaaattctccctaatatattcaaaatccttcagggaacctacgttttagagtacagaaataaggctagaaaatggacccttctcctttctgaaaatggttattgagtatacaatactttagagtctgttatatgtctaggactcagtgggctcagcaggggctgtggacagaggccctctgcactctgtgcattccagaaccacactagctctcaccttttagtgctcccccaggatgttcccgctatgagaatgattaatcttaactttgtcaataaaggaattgtctgttttgccagagactccctaggacatttgcttcacttgggtctgatttgaacagcttggttgatgagaacagaaatcacacatttaatgtgcggctgtgggtttctgcatttgtttccatcagctgcttggtggagccacacagaagacagttatactaggatcttgtctgtaaacataacggtgtactgttagtaatgtcagggactgtttctttcccatcagatgggtttcagttagagccagttggcttcatttgtccctgaaatcttgtaggtaggatacattttgggttgaaggttttgcaggtgagttgctatccttatcccataactgggagtcctgtcaggcaacagagagtggccacttcaggctccatatcccctattgctaagaatctcaggtagattcacttccatagactccctctggacagacatgccccacccacccccatcctaagtatgaggtcccttgcacagcccagatactccacacccatgtccatggttatttctgttcttgcttccttaaaagtgattgccccgaggcggaagcacagaggcgctgaggcagcaccctttgtgggccggggacagccggccaccgtccggaccggaggacaggtgcccgcccagctggggaggcggcctaagccacagcagcagcggtcgccatcttggtccgagacccgccgaacttaggaaattagtctgaacaggtgagagggtgcg

SEQ ID NO: 821 - DNA, 1200 bp, mus musculus
aatttctatcagagaattcctacagctgataacaatatctgcaacctggctgggtataaaattaactcaaaaaaataagtagccctcctttataaaagtggagaggatatggagaaagagggacactcctccattgctggtaggatttcaagctggtacaaccactctggaaatcaatttggctgttcttcagaaaattggacatagtatattatctgaggatactatacttctcctggacatatactcagaagatgctccaatatgcaataaggacatatgctccactatgtttatagcagccttattgataatagccaggatctcaaaagaacccagatgtgctttaacagacgaatggatacagaaaatgtcgaacatttacgcagtggagtactactcagcaattaaaaactatgaactcgtaaagttcttaggcaaatgaatagaagtagaaaatatcatcctgagtgatgcaacccaatcgcacaagaaaacacatggtatacattcactgataaatggatactagccaaaaagctacaaataagcaggatacaattcacagaccacatgaggtgcaagaagaaggaagaccaaagtgtggattcttctgtccttcctagaagaacaaaatacatacaggagcacatatggagataaagtgtacagcagagactaaaggaaaggccacacagagactgtcccacctggggatacattccatatacagtttccaaacccagacattattgtggatgccaagaagcacatgttgaaaggagcctgatatggctgtctcctcagaggcctggccagagccttacaaatatacaggcagatgttagcagccaaccattggactgagcatagagtccctaatagaggagttttagagggacttgaaggggttgaaggggtttgcaaccccataggaagaacaacaatatcaaccaaccagaactcacatggactaagccatcaacaaaggggtatatagctccagctgcatatgtagcagaggatggccttgtcatgcatcaatggaagcagaggtccttgatcctatgaaggctcaataaatgtgtcaatgtaggagaatcgagggtggggaggtggaattgggtgggtgggtcgaggaacaccctcatagaagcaggggtagagaggatgtgatagggtgtttctgggagaaaagga

SEQ ID NO: 822 - DNA, 1200 bp, mus musculus
ttgtctttctgggtctgcattatctttctcttgttgactattttataaccttacctttgcctgcaaatttaatgatgtcattatttttttagtgtgacacttcactttattacttagaatgttctgtaatcaaatctttttttattagatgttttctttatttacatttcaaatgttatcccttttcctagtttcccctctgaaaatcccctatcccctccccctccccctgctccccaacccactcactcccatttttggccctggcattcccctatactgggccatagaaccttcacaggacctggggcctctcttcccactgatgaccaactaagccatcctctgttatatatgcagctagacccaccagtcacacagtgtgttttctttggttggtggtttaatcccaaggagctcttggggtactggttagttcatattgttgtttctcctatggggctgcaatccccttcagctccttgggtactttctctagctacttcattggggaccctgtgctccgtccaatggatgactgtgagcatccacttctgtatttgccaggtactggtagagccactcagtagactgctatatcatgcttctgtcagcaagctcttcttgacatctgccatagtgtctgggtttggtggttgtttatgggatggatccccaagtggggcagtctctggatagttgttccttcagtttctgctccaaactttgtcactgtaacgccttccattggtattttcttcccccttctaagaaggattctgtgcttctgggctaatatccagttatcagtgagagcatatcatgtgtgttcttttgtttttgggttacttcaattaggatgatgtgatagtttggatattcttgcaccagagagtggcaccatttcaaagtgtggccttgttggaataggtgtgacctggttggattaggtgtgtcactgtgggtgtgggcttaatactctcatcctaggtgcctggaagtcagccttccactaacagtttttgggtgaagatgtagaactctcagctctgcctgtgccatgcttgcctggatgctgccatgctccctatgaattgcctatattatgcttagatatgaccattgtctccttaatcacttcacaacattgatcatgaaaggttagaatattttcaaatgatgttttcagcacctaatgag

SEQ ID NO: 823 - DNA, 1400 bp, mus musculus
ccaaactctagatagaccagagactatctagaaaatcacaaataccactggtctaaacaaagagaaataataataatacaatgaccccttattgatattctgttatattcacagatcagtgccttatttagccatcttcagagaggtttcctcctgcagcatacaggaacaaatacagaatatgcagagaagcaggggaggaagaggggaagaaagttcggaacatgcagctcactaggaggtgtctgcttcaaatccctcccctcagagcacagagaacctcaaaaggcaacaaaagagaacaaggccctcctaaaactcagacttacacagcaaacagtgttttctgttcagtactttttttttttcgagacagggtttctctgtgtagccctggctgtcctagaactcactctatagaccatgctggcctcaaactcagaaatccgactgcctctgcctccgaagtgctacgatcaaaggcttctgtttagtagttttatggattcactgcatatgggaatgagttggtctttgattctttatttttacactccatattttgtcatgcccccccccaaactaccctcctactgccccacatctcacacctcaccaccaacccctctctccccttggatgtccccacccccatcccacttgaccgctaaactccgtgaggccttcaatctcttgagggttagatgcatcatctctgaatgaacacagacctggcaatcctctgctgtatgtgtgttgggggccccatatcagctggtgtgtgctgcctgtttggaggtccagtgtttgagagatctcggtggtccaaattaattgagattgccatcctcctcagcttacttcagtctttccctaattcaacaacaggggtcagatgcttctgtccattggttgggtgcaactacctaccagacactttcagctacttgttgggtcttccagagtgtgtggtcatgctttttgtgagtgctccatagactcagtaatagtgtcaggccgtgggacgtcccgctgaactggatccctgttctggcctggcactgagccttcttttcctcaggctcctgtccacttccatccctgtaatacacacatgtccgtttggttctgaattaagtcaatcagggtgatatgttacacttccccttggagctctcttatttttcttttggcttagcttctccgacttcggtatgattttttttttattttcttatattttattttgtcatattttgttgtcttttcgaagcctgttcttttctaaagacagaaatggagtggttctggatgggagatgaagtagggagaaactggggggagtagacggagggtgaactgtattcagattatattgcataagaaaagaatcgatgttt

SEQ ID NO: 824 - DNA, 1400 bp, mus musculus
aatttcataatttaatttttcttagtagctgaattatatatttttctctttaaatacagctggtttcacttgttcacaccgatttgtagacatctagtttttttgttttgttttgtttagctttgtttccattacctcgctattatggatagaacaacagcgaagatggatgagaaggtaccccacagtaggtgatcccttggctatatcaccaagaataatatagctggattgtgtggtaaatcttcttattttctgttttgtttttattcattcattcatttgattttggaatttctatattaatttcagtagtgggttttcattgctagcaccagcgaataagtgttcccctgtccttatatccatgccaatatttgtcatcatttggcatatatgagtgtgtgtgtttgtgtgtgtatgtgtgtatgtagcatcattataactgtgataagatgacatcacaaattagatttaatatgcacttagtttatatttctcactgattttagtgtcatctttgtttaattccatgcccatttggttgggttgtctggtttataatatttagccttctatcaaaattatagctggtaaagaaaaaaaatcttgacccaggagtgtggacacacccaggcacacaggtgagaccaccattatgacaccaatatatgacctgactaggacctgctcagagcccaagggactcagataactccatgcagcaggggacccaatccttccactttccatccacactatggaccagaacctgtgctacaggcttcaatacccaagtccctctgagagaaaacttaaccccaaaagtgctgacaaaccaagactcacaggcccacagaaagagcttgaccttcaggagttctgacacacccagactcacagactcacagaagaacgtaggatccagtgacaatctgcaaggacaactatcacctgagaaaaccagatggtaaaagacaagtacaggaacataagcaacagaaaacaataccacttggcaacatcagagcctagttctcccaccacagaaaaccctgaatactccaacacacctgaaaagcaatgttctgatcttaaaaaacccatctcaagaagatgatagaggactttaataaggaaataagcaattcccttaaagaaatacaggaaaacagaggtaagaaggtagaatccttaaaaaggaaacacataaatctattgaaaaaaatataggaaaacacaatcaaacaggtgaaggaattaaacaaaaccatccaagatctaaaaatggaaatagaaacaataaagaaaccatgaagggagacaattctggagatagaaaacctaggaaagagaacaggagtcacagacacaagaatcaccaacaggatacaagaaat

SEQ ID NO: 825 - DNA, 1200 bp, mus musculus
gagtctcaggcatagaagatatgatagaaaaaattgatatatctgcaaaagaaaatgttaaatctaaaatttcctgacacaaaatatccaggaaatctaggacactatgaaaagatcaaacctaagaataataagattagaagattttcagctcgatggtccaaaatagatttttaaaaagtcacaaaagaaaatttcccaaacctgagtaaagacatgcctataaacatacaaaatatttacaaaatagaggaatagaaaagatcatcgtagttctggtcagcgccagcctggcacaatcttgggcttgaaatcagcaggccctagcacatccaggatcttgggatcactggtgagtagaatgcaacatctgttccaaaaaaatcccggaaagtcttgtgctaacaggaacagggacaaaggaaacccaccaagcagtggctggggttcatttccaactgtgccagccctgcaccatcttgtgtgcaaacttggtggagggtcccaaggtcccaagaggatccacgctgcaggcaccctagcacacccagaatcttgagaacactggtgagtggaacacaacatctgttccaaaaaacccagagggtcttgtgctagcagggacaaaggatacctgcccgaccagtggctggggttcattccagtcagtgccaacaccgagccatcttgggcatgaacacagtgggccttagaacaccaagtatcatgggatcactgagaccagtctacacaggagagccttcatcctcaggcaggaggcagagctgagacccagacccgtgggcaccttccccaccaagggagagtcagcctccagggagggctctgaccccaggactcagaaggtgaatctgagcttcagacttctgtgcaccttccctgcaagagaagaacttgcctacagagagtgttctgaccactgggactcaggaaagagttggactcccaggagtgctgacagaggctaaagaatcacaggaggaacaagctccagccagagacagctagaacatctaacaccagagattgccaaatggcattaggcaaatgtaaaatcttactaacaaaccaagaccagtcagcatcatcagaaaccagtacgcccatcacagcaaatcttggataccccaacacacccaaaaagcaaaatttggatttaaaatcatatctcatgatgct

SEQ ID NO: 826 - DNA, 1000 bp, mus musculus
tagtaaaaacaaacaaacaaaaaaccagaatacccaagatacagtgcatggaactcaaaaaggtcaacaagcaagcaagcaagccaaaatgcccaagtaaggacacttggcttactcaatcccacttgggagggagcagaaagcaatcacaagttgggagggagggagggacataagagagaaagtggatggggggagtagttaggggtagaggggaatctgatctggttttgggtaagggaaaatgactaaagccctgaaggccagcagaaagaatggaaacaggcaacctcaaggaaggaggttggggggacgctccagaatgcacaagagacaggggaggtgagagactctcaggactcaaagggaaggaccttagatgaattgcctgacagcagggaaagggaacttataaagcctacctccagcaggaagacagggcatcaattgagggcggcggcggggttggcgggggtgggggggggacggggggggcacgggaggtgggggggcatggcatctcacagttacaactctgacccataattgttcctgtcagaaagaattacagggatgaaaatggagaggagcctgaggaaaagaagttccagcaagaggcccaaagagggatccagctcaaggggaggtcccaaggcctgacactattactgaggctatagagcactcacaaaaagggacctagcatgactgccctctggaagacccaacaagcagatgaaagagtcagatgcagatatttacactcaaccaatgggtagaagcagctgacccctgttgttgaattagggaaagaccgatagaagctgaggagaatcagcagtcccaattaatctggacccctgagatctctcaaacactgaaccaccaaacaggcagcatacacataagcataagaccccaacacacatacagcagaggactgccaggtgtgttcattcagagatgatgcacctaaccctcaagagacaggaggccccag

SEQ ID NO: 827 - DNA, 2800 bp, mus musculus
acaaccactctggaaatcagtctggtggttcctcagaaaattggacatagtactaccagaggatccagcaatacctctcctgggcatatatccagaagatgttccaactggtaagaaggacacatgctccactatgttcatagcagccttatttataatagccagaagctggaaagaacccagatgtccctcaacagaagaatggatacagaaaatgtggtacatttgcacaatggaatggtacacaggtattaaaaagaatgaatgtatgaaatccctagggaaatggatggacctggagggcatcatcctgagtgaggtaacccaatcacaaaagaactcacatgatatgtactcactgataagtggatattagcccagaaacttagaatacccaagatacaagatacaatctgtaaaacacatgaaactcaagaagaacaaagaccaaaatgtggacacgttgccccttcttagaattgggaacaaaacacccatggaaggaattacagagacaaagttttgagctgagatgaccatctagagactgccatacctgggcatccatcccataatcagcctccaaaatctgacaccattgcatatgccagcaagattttgttgaaaggacccagatatggctgtctcttgtgagactatgccagggtctagcaaacacagaagtggatgctcacagtcagctattggatgggtcacacggcccccaatggaagagctagagaaagtacacaaggagctaaagggctctgcaaccctataggtggaacaacaatatgaactaaccagtacccctacacgcccccagagctcgtgtttctagctgcatatgtatcagaaaatggcctagttggccatcattggaaagagaggcccatcagtcttgcaaactttatatgcctcagtacagctgaacgccagggccaagaagtgtgtgtgtgtgtggggggggggggggggagatgagtgggggggagggtatgtgggaacttttggtatagcattggaaatgtaatgaagaaaatacctaattaaattaaaaatgtaaaaaaaaaaatacgtgatttcttgcaaatgatctttgctgtacctattaagttcttcatgagatttctgaccttgagcctctttatatgctatattgcacttaatgctttgtttatattgatagttctttgtatatcggcagggaagccaacttgattgtggtcaatatcttctctattttgaatttagttcataagaattttattgatgcttttaaaatgcctgttcattggaaaaatactctataattttatttagagttgtgcctttatcttattttcaatcatggtaatattgatattgtaaaatgagcatgatagcttacgtttcaattttatggggtagtttgagcagcattaatattagatcttaacgagctgatggaaatcagttgtgaatatattaggtctgaacttcatctaaatagctttaatttcatttactgtagaccaattaaatttgtttacattctttttatttaattttggtagaatattcatgtctagaaatgtatctatatcatagatatttaaaattgtcaaaatctacattttctttttttttcaatttttattagatttttcttcatttacatttcaaatgaaatcccaaaagtcccctataccctcccccagccctgctcccctacccactcccacttcttggccctggtgttctgccatggcccgggcctaatcagtccccctcaacccgtgggaatcagtgtttcagacagatggacatagagttggcgggaattgacagaacaaatgtcaaatcaagcatcaaactttttatacagtagaaaatagggatgttgggtgatacactggcaaggtacaaagaggttactgtattcttacacaaaacagaggaatgcaaacacggaaggagtgggaggaaccaactggggtaaaactctatgttatcaactgggatcaaaaacagctccacctaaggtccacttaatcttagaagccaggggcaagggcttcctgcccttgccatagttcctactctagtctattgtatagtccaccttccccctaggccatcgtaaatacttgtgtatgggtgtaactcagctacctatagttctaagtatctactctggttcctctttaggtcacaaacttccttcttcctagataatggtaaatttcagtgtagggcagtgacttagctatccatgcccaaggtcggatcaaggactgcctagaatctaacttagctatatgtcaaaatatcaatccttaggagcacttgtagtaaagcaatattaagggaaagcacacagatccgtttaccaactaaagcaaggacattggaacattctttatacaggatgccacgattccaggagactaagtttccgtgaacttttcgcctcgggacagtgcctaggttttgggggggcggggagggagggctgtcgccttgtcactactggagtggatgtagcagtgttcccctgtactggggcatataaagtttgcaagaccaagggacctttcttcccactgatggctgacagcaatactgggatggctgagtggttaaggcatttggcttaagatccaatgggcagagatgcctgtgtgggttctaacttcactcccaatatcagcggctgtactgcttgtctgactatgaaatctacattttaaatgcatgccttaatgatccttaaattcactgggatctagtgtaatgtttccctttttacctataacta

SEQ ID NO: 828 - DNA, 1000 bp, mus musculus
tttcagattctggacttctttagagttaagagtgtagctcagctgggtcaggcagaagccacagagcttctggggcagactgtgtttcaggctccagacacccagccacctaccctgccagaggagaggtgtctgccccgtccgggagggctttgccacagcatctgggggagccatcttggttccaggattctgcctagactagtctgcgcaggggagagtgtggactgcagaagctaacagcttctaggtcaggcagaagccacagagcttctggggcagaccacattttgggctccagacatccaggcaccttccctgccagaggagaagtgtccacccacccgggagggctttaccacagcatcttgggttcctggattccatcaagactggtctgtgcaggggagagtgtggactgcagaggctaatagattctgggacaggcagaacccacagagcttttggggcagaccacgttttgggctccagacatccaggcaacttccctgcaagaggagaggtgtccgacccgcctgggagggctttgccacagcatctgggggagacaacttggttcccggatcccgccgagactactctgcataggtgagagtgtggactacagaagctacacaaattctgggacaagccctgtgttgggccttcatcttctgccaggaggcaggtccgaacgtcagatatctgtccaactcccctgcaaaaggagagtttgcctgcagagagtgctaaaccactgaaactcaaaacagagctagtcttccaggtctgctgatagaggctaacagaatcagaagaggcaaaagcactaaccagagaaaatataacaactaattccagagattagcagatggcaagaggcaaatgtaagaatcttactaacagaaaccaagaccacacaccatcatcagaacccagcacttccacctcagccagtcctgggcaccccaacacacccgaaaagctagacccagattta

SEQ ID NO: 829 - DNA, 1600 bp, mus musculus
atatatccagaagaagccccaactggtaagaaggacacatgctccactatgttcatagcagccttatttataatagccagaaactggaaagaacccagatgcccctcaacagaggaatggatacagaaaatgtggtacatcctcacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaggatggaccatgtagagactgccatatccagggatccaccccataatcagcatccaaacgctgacaccattgcatatactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacacaaactttatatgccccagaacaggggaacgccagggccaaaaagggggagtgggcaggtaggggagtgggggtgggtgggtatgggggacttttggtatagcattggaaatgtaaatgagctaaatacctaataaaaaatggaaaaaaaaaaaaaaaaaaaagtgggtcaaagccttgaagatatgagcacagggggaaaattcctgaatagaacagcaatggcttgtgctgtaatatcgagaattgataaatgggacctcataaaattgcaaagcttctgtaaggcaaaagacactttgaataagataaaaaggccaccaatagattgggaaaggatctttgcctatcctaaatcagatagaggactaatatctgatatatataaataactcaagaaggtggactccagaaaatcaaaaaccccattaaaaaatggggctcagagctaaacaaagaattcttacctgaggaatacggaatgactgagaagcaactgaaaaaaaaaaatgttcagcatccttaatcatcagggaaatgcaaatcaaaacaaccctgagattccacctcacaccagtcagaatggctaagatcaaaaattcaggtgacagcagatgctggcaaggatatggagaaagaggaacactcctccattgttggtggaattgctaccttgtacaaccactctggaaataagtctggtggttcctcagaaaattggacatagtactaccagagggtcctgcaatacctctcctgggcatatatccagaagatgttccaac

SEQ ID NO: 830 - DNA, 1000 bp, mus musculus
atactaaaccaaaagctcacagtacctatgatacaacccacagaccatgtggagcacagaaggagggaagaccgggggtggggtgggtgtgcttcagtcctgcattgagaggggaacaggatgattgtggaagatgggaggggagggggaaaggaggaggaggaaacaaagtggcagtatcagtttctgaaaggagaggtgagagaggtacagagggtctggggatcaaataaaaataggtagaaggggatatgaagaactggggacaaccactggagggtcccagacaccagagaaacatgaggatcccaggacccaatgggattgactttaggtgtaatgcacagaaaagggagaaatagaacctgtggagaccacctccagtagataggaacagcccctggttgagggatggggccacccacccatctcaaagttttttaacccagaaatgttcctgtcatggaacagagactgaaggaaggaccaaccgggaacagccccacctagggacacatcatgtctgcagacaccaaatccaacattgttgcagtggtcaagaggcacttgcggacaggaaccaagtgtggcagtttctggggaggccaggctagcaactgacccatgtagatgcagatgctagagccaattatcagattgaactcagagaatctggtcagggagctagcaggactggaggagcagagggccattgcaaccccattggaagaacaacataggctggtctgaccacccagttctcccagagactagaccaccaaccaaggagtgtacctagacagatccatggctccagatatgcatgtagcagaggatggccttgcctgacagcaatgggaagggaggcccttggtcccagtgaggtttgatgccccagagtagggggatgctgcagcagtggaatgggagagtgtggtgggtgggggatcactctcataggggcaaaagggagggtagatgtgggatggggggtttggtg

SEQ ID NO: 831 - DNA, 1000 bp, mus musculus
cctgggggggtgagtgacacctgtcaagaaataccttggtcaggccgagtagttcagactgcatccacaataggcaatcaaataaaattcttcccaggagacctagtaaacagcctgatatgtggacaagaattgtacatttcagggagttagaatagcctgggttatttgaacacaacgttatttgaattaatgttggggactgctgaaaacagggtgtgctaattccctagtatttccacactcacacacacaggaaaaaaactcctagaagaatccccagagaagtatcatctcagccacgttggtattgaattccttacccagggagggtttggagtccagaagaagccaagctgctggtgctgaaggcattgagggcattctattctctaaacccctgaagacttaaatttataatgattaatccatattttaggctaaaatttcctaaaacattaccaggtctagaatttcctttgtgaatccttttgtgattacaacattccatattttttttccttaaaatattgactacattttccattttgtcttagtttgaggcattgatttacaattagtgtgcttttatttttagcatgtttaaaaacaacaataatattgtttattttcctgataatgattacttgagtcttacttttttttgtgttgagccattttaggtagccttatggtgcccagtaaattactgttcatcaaggagctggcatgtagtcttcctgagtttctggtgtgtgttccttttctgtcatcagtgtcccttttattattactataccgtatcctctgcatttatctaagtatactaaactttgtagataaagtagcaacttgggcttgggaggcggcctcagcctcagcagcagcggtcgccatcttggttccgggactcagcagaacttaggaaattagtctgaacaggttagagggtgcgccagagaaccggacagcttctgggacaggcagaagcacagagccg

SEQ ID NO: 832 - DNA, 1600 bp, mus musculus
tatgccccagtacaggggaacgccagggccaaaaagggggagtggtgggtaggggattgggggtgggggtatggcagactttcgggatagcattgaaaatgtaaacaaggaaaaatacctaacttaaaaaaaaagaaactttactaaagctcaaaacacacattcaaccctaaccaataatagtaggagacttcaataccccactcaccaatggacaaatcaaagaaacagaaaataaacacagtgaaactaacagaagttaggaaccaagtagatttaacagatatttacagaacatttcaccaaaatccaaaagaacagagatcctctactgcagggcctcatacccaaatagcaccaggagggagtgagcctctcaggagtgcagagaggtctctgagtacaggtaacatgaccactactgtatagaagaacccaccaagaaccctcaggacacaggaacataagggtgccctggaatgggagccttctattttccttcatctccatctgtaccagatttctgccacagagatcacataaccacatagtaatatatccagagagcaagcctcccaagagtgcctgggaaaggagtcttgcagtatccaacttcactcaaagctgatcatgtgccacagaactacatatacaaatactaccaggagagacctggtctcccaagaatacctacaaacctgcgatcacaggtaagaccaccaattctcttcaaattcctgcccaagaaggaccctcacagagccatcagaacaaaggaaccaagggtcagctggggagaggatcctactggtctctgtctgtaccttacagctgaccctgtaacatagttctccatacctaatttccacctagagagaactggtctcccaggagtactgacacacaggcttgcaggagggacaagccaaagttagagacagcaagaccagctaacaccagaggtagccaggtggcaaaaggcaagagcaagaacaaaagcaacagaaaccaaggctacttggcatcatcagaaccaagttctttaactacagcgaaccctggttaccccaacacacaaaaaaagcaagactctgatttaaaatcaaatctcatgatgatgatagaggaacttaagaaggatataaataactcccttaaagaaataaacacaggaaaacaggtagaagacctgaaatagaaaaacaaaaatcccttaaagaattataggaaaacagaacctaacaggcaaaataactgaacaaaaccatccaggatctaaaaatggaaatagaaacaataaagatatcacaaagggagataacactggagatataaaagtgagtaaagacaccaggagtcatggatgcaagcatcaccactagaacacaagagatataaatgaatatctcaggtgcagaagataccatagaagacattgacacaatagtcaaagaaaatgcaaaatacaaaaagctcctaacccaaaatattcaggaaatccaggacacaatgagaagatcaaacctgatggtaaaaagtatagaacagagtgaagattcccaacttaaaggtccagaaaatatcttcaacaaaattatag

SEQ ID NO: 833 - DNA, 1400 bp, mus musculus
ctgcagaacaatagtgataaaaaccacatgttattggtacagagacagacaggtctatcaatggtatattttgaagacgcagaaataaacccacatacctaagacaattgcttttttataagaagccaaaaccatagaatggaaaaacaaacaaacaaacaaacaaacaaacaaaagcactttccacaattggtgctggtctgtcagtctgcatatagaagaattgaagttgatccatatttttaacattgcacaaaactcaagtaggtcaatgacctcaacataaaaccagataaactgaacctaacaaaatagaaagtgggaaatagacttgagcacattagcacagaagaaatttttctgaacagaataccaatggctcaggctataataccaaaacttgaaaaataggacttccagaaaatgaaaagcttctgtaaggcaaagaaaactgccttctggttcccgccaggaccagggtagcttgggcacggagtctgctgacacctgcaagctacccacaagacccgccacgagaccttcagacctctggtgagtggaacacagctgctgctccaatccaatcacaggggacctgagactgcattaattagggaagcagaaaaacccggcctgatgaggggcacaagtcccttccgtttccccaccagcaccagggtagcttgggctctgagtctctggacacccacaaggtatacacaggaccctccacgggattttaagacctctgtgagtggatcacaacttctgccaggaggcaggttcaaacaccagatacctgggcaccttccctgcaagaggagagcttgcctggagagagtactctgaacactgaaactcaggagagagctagtctcccaggtctgctgatagaggctaagataaacgcccaacgaacaagatctaaccagagacaactacaacaactaactccaaacattaccagatggtgaaaggcaaacctaagaatcttactaacagaaaccaagaccactcaccatcagcagaacgcagcactccaaccccacccagtcctgggcaccccaacacacctgaaaagatagtccctgatttaaaagcatatctcatgatgatgatagaggacatcaagaaggactttaataactcaattaaagaaatacaggagaacactgctaaacaggtagaagaccttaaagaggaagcacaaaaatcccttaaagaatttcaggaaaacacgaccaaacaggtgatggaattgaataaaactatccaagacctaaaaagggaagtagacacaataaagaaaacccaaagttaggcaacgctggagatagaaaacctaggaaacaaatctggaaccatagatgcaagcatcagcaatagatgatggaatacaa

SEQ ID NO: 834 - DNA, 1000 bp, mus musculus
aaagcatataagttttgaagtattaggtcctatataattgtattatgatttcctactgaaaacaaggtagccagaccaaaagaactttagcatgctctatgaaaaatcagattcactaagtcatataacttttacctaatatttttgtgtgtgtgtgtgtgtgcccgcgtgcgcatgcacatgcaagtgtgtgcagtgtgcatacatgaatattgattgtacttctctatcacacttcattctattcccttgaggcaggatttctcactgaacacaagggccactgttttggctaggatgactcccagcatccacctggctttgcctccctacactggagatatagatataatcagctatgccttggggaaaacaaaacaaaacagaaacaagaaccatgagattgagaaattcaaactcagacctttaagccatcttctcatcctttaaaaatagttttcagagaagaagctctgctcacaggtgctctaacatgcccaggatcataggatcagaggtgaggaggacacaatatctgttgcaacaccaggaggaactgggaccagtgggatccggggacacagtaaccatgcccaaccagtggcatgggttccttccattctgggccagtgccctgagcagaccttgggcatgaactccatagtcagtcccacaacacccagaggaagtgtcactcccaggcactctaacaagcctaggagcccaggagcccaggatacaaggagcttacgcacaccaggatctcagggtcccagaagcagcttgactcccaggagctttgacacacctaggatctcaggatcccaggatcccagaataacaggacaaaacagaaagctggactttgaagagtactgacacaagcaggattacaggaaggacaggttccagtcagatatagagagggcacgtaagactatagataaccagatggtggtaggcaagtgtaagaacacaagcaatagaaaccaaggttact

SEQ ID NO: 835 - DNA, 1000 bp, mus musculus
aagaaggaagaaagaagggaagaaattaaagacattttaaatttaatgaaaatgaagtagcatcataccaaaacctatgggacaaaaatgaaagcagtactaagaggaaaactcatagctctaagtgtctccaaaaggaaactggagagagcttacactagcagcttgacagtccacctgaaagctctagaacaataagaagcaaatacacccaaggggaatagatggcagaaaataatcaaactcagggctgaaatcaaccaaatagaaacaaaaggaactatacaaagaatcaacaaaaccaggaactggtttcttgagaaaatcaacaagatagataaacccttagtcagactaactaaatggcagagacagcatccaaattaataaaatcacaaacgaaaagggagacataacaatggaaaccttggaaattaaaaaaaaaatcatcagatcctactagaaaagcttatactcaataacattggaaaatctgtatgaaatgaacaattttctagacaggactgtagcctcttgtagctacatgaactggtttcctcagtgggaggctggagctgtatgggaggaaaatggagggagaaataatgagaccaagacaaattctgatcaaggcccaagagcttactaagagtctgagcttataaaggggaaaggcccatcccccactatgccaggctcttgatgctttgttgccaatctttcagcacttggtccaggctgttgcttatctcaggaagacaggttcagcctgtcatccggtagctgcttcttgaagaagagcgcaggtggcagaacaatagacctatctaggtcagaagactccaccctaggtggtcttgttcagagtggcagaacaggtctaagccagcctgctcaaggctgggggaggctacaagataccagttgccaaagttaaaacaggagcagataaaccatctaaatagtcccataactcctaaaaatgtagaagcagtcatta

SEQ ID NO: 836 - DNA, 1400 bp, mus musculus
ttcttttttcttctggccagtttgttgctatttgtggtttggtttttgtttgtttgtttgttttgtttgtttgttttgtttgtttgttttgttttttccccctcttaaagaattagtgcagtttgactgattggatgtatggttgtttatagccttacttagtttcacagatttctgccttaatctttctcttagtcagggtttctatacctgcataaacatcatgacctaggagcaagttggggaggaaagggttcatttagcttacacttccatgttgcttacacttccttccatcaccaaaggaagtcaggactggaactcaagcaggtcaggaagcaggagctgatgcagaggccatggagggatgttacttactggcttgcttctcctggcttgctctgcttgctttcttatagagcccaagactaccagcccagggatggtcccacccacaagggacctttctcccttgatcactaattgagaaaatgccttacagttggatctcttggaggcatccaaaaccagccagtgcaatcttttaacaccgtctaccacctgccgttctgtttttgttttggattactcttactgtttttccaggactttggagtgcattgttagttgatttttgatccccctccatttcggctcacatggacaaggtacacctgagtggcaggccggagctgaaagagggaaactaggcagaagagagaaaaatggagctaagtcaaggttcctgatcaaagctcaaatgtttaatggcaaatgcgcttataaagtgggagggagggggaggaggcccattcctgccaattcatccttggagcccagctgcaggcgacccaggtgcaggatagggtgtagcctaccagcaagtagcagaatcttgaaggagaacagcagcagtggctgaacaatagagtgatctagggaggaaggctccaccctggtaatctcctttgtggcagcagggtccaggtctggctcagcctgcttctggctggggggaggttacacccctccccaagtaagcactcactaaaaactgtcctcttagaactgccttagctgtctcacatgacctagcttttattagctttcatgtccataatctagaggctcttttctttactgaggttctcagtggtcatcttagggtgttttgttctgtctccatgtattcctgtagcttctttagttttctagtaattagtttctaattttattgcatgttgatatgatggataagagcggttaatttgatccttttgcttttggtaatagttggtttgtggtctgcaatgtgctctatattaagttttccttggctgttgagactgtttttgtttctgttggagtctctctgctgtaggtagtggttgcacacacta

SEQ ID NO: 837 - DNA, 1000 bp, mus musculus
ttgatttgtgtaaattttttgaatattgtaagagctgtcctgttgtctgtgttttacagtagtatatattaattatgcacagttcttacacgcgttctcgtgaccggccaggaaagacgcaacaaaccggaatcttctgcggcaaaagctttattgcttacatcttcaggagccagagagcaagagagcaagagagcaagagcaagagcaagagcaagaaaaagaacaagaacaagaaagcaagagagagcaagaaagcaagaaaaagaacaagaacaagaaagcaagagagagcaagaaagcaagaaaaagaacaagaacaagaaagcaagagagagaaagcaagagagagaaaaagcaagaacaagagagagaaaaagcaagaacaagagagagagagtggcaaaaccccgtcccttttaaggagaattatcctccgcctaggacgtattactccctgattggctgcagcccatcggcccagttgtcatcacgagaaaggcagaacacatgacgggaaaactgcccctgcacgtgtgcagattatgtttaccacttagaacacagctgtcagcgccatcttataatggcaaatgtgagggcggctcctcacagatcccccttttcttttaataagagcaataggccacccatattaatgagagtggagatagaggtcaaatccccagtgtgcacgtaaaggagccatgtacaggattagctcttaggctcacaggcttttacccagagcaaccctgacctgctcccgtgtcgtttttcctggggagaaggacacttggacactcaaccttcttgaaagatgacatgtctccctagaataggctcatatatgccgcagagcccttctactgcagtgcttagccgtgcaactctctcgggctgctgaagcacactcactctatcccgtgcaatgagactagcctcgtggggtgcaagagctgaatggccagcgacctattgcttaagcatagataaccat

SEQ ID NO: 838 - DNA, 1200 bp, mus musculus
atgtactggctaattttctgccaatttgacacaagctagggttatctgaaagaagggagcctcaattgagaaaatagctccataagatacatctgtacttcagtgacttgatatggcaggatgggttggtacacaggggcccttcctcttctcagaggaaaaatgggtgggagatgtattggagaaaagactatgtgaggggtagaatggaaagagagggggtaataaagaagtgaagttaataaataactaaattaatggaaaactatgatgtgaggcatttttttaaattagtaaccaataggggaaagtccaggccattttgggtggtgccaaccctggatgggggtcctgggttccacaagaaagcagggtgaccaatccatgatgagtaagtcagtcagcagtagccatccatggccttaacatcagttactgcttctaggttacctctgagtgtgggaactaaaagggggctaggggaaaagaggggtaaggaaggatagcccacatctggtcagagttcctcctatgctctgggcaggcagacactgcaggactaccgtatgctttccactcagcccctggtaaacatctaagccactgacaccacgcaacagggggtggacaaggggcagcccccaaaaccaggggcctacagcaacatcctgttgccctggggttatagaacagagggctgaggagagaggttcccacacaagtgagagtctgcacagctggccttgatgagcagagaccttctatgattttcgagctttattatagaaaggcggtgtggggggggggaaggtagaaagagagagagagagagaaaggggaaaaggagagagagaagaaaggttagagagtaagagggagagagggagaggagaggagtaagagcaagagagtgagagaatgaggaggggccaacagcccctcttatagtgggctgctttatcttactgttgctaggtaactggggaggagttaagcctaaaggtcagaagcttgggacattgcctatgtgactactaaccatgcttctcttgtgggggctgagggggtggtaacttagacaggagccagagttccaggagtcatgagagaactccttctgtcccatgtaggtcaattatcatcaccgggtcctggggttcagatctcagctcgtctggagatcagactgtctttgcatag

SEQ ID NO: 839 - DNA, 1200 bp, mus musculus
gaacattttttattcattttctgcaactgttcatttgctttatcttggctttctttaagaaattcattcatttcttcacattttttttcttgatttttttaaagggatttgttaattttctctttaaggacccctaaaaatctcagtttaagtctttttcttgtgcttcagccagatgtgttggacttttcagggcttgctctagtaggttagctaggatctagtgctgccatattgctctggctctgcttgattgtcttcttatgctgctatctaggcatctgagttgggggcaaatataggtctaggtggcagtaactgaatttgtccttgttggatgagtgcccctcccccccctttggtttctgtttcctcaatggtattcttgtcagagtggcctgtggttgagtaggaaattttatccaggttgggtgctagagttcagacagctggagtgtactctgttccagatgagattccttcctggagttaggtcttgtatgtggtgatggggatgtatggggtgaatggggacaggccagatgggcactcagtaaggacagctctgtggtggatgggttacctcacttactgagtgtcattgtgcccatgccctctcatacaacagggtgcttcttctggagttggagaccaaaacttgggggtgggataggagaacattgagaaagtgggacttgtctgtatgtaaagagcctacttggagtcctggtggctagagtggtctctactggggtatccaccagagttgtagaaagagagttggtgctaaagagaagggggtctgagggaatgttagtagtctgtgtgtggggtgggggctcaactggggttctgggtgttggcttcagatagaacaagagacttcttctgcatgtttagatcccatttatttttgaactttgatcattatatttactcttctttttatgcttaagtgtactcttgattctaccttaaatgacctaaaatatatgatatatatgaacctatgagatactttgtctctggaggtctcagtaattttgttagcataatggtacaaaagacaaaagtcttattctttggtgtccttgaagcaactaaccagctgttctttttcacaccctctttctctttcaaagttatggccaggaagcaccacctggactgggaaaaaagttaataagtgtttcatttccc

SEQ ID NO: 840 - DNA, 1400 bp, mus musculus
acaggtgaaatttctgataaaaaaataaaagaaataatctgcttccatgtcttagcagcaaattctccctgatgtttctaaaaattaagtgaattttcttaaaaatacaaattctagattttattacttaagggatttttttgacaaattgaaagttttaacacttgcttaggtttgtgtacagaatatacctttagattcaaaaatatttaaaagtttactttctgtggttaatgttgtgtctggaggagagatctgttgttttgtttgttttgattaggttttgttttatttaaccaaatgttttaaacattatttttttaaaagatttatttattatatgtaagttcactgcagctgtcttcagacactctagaagagggcatcagatcttgttacagatggttgtcagccaccatgtggttgctgggatttgaactccggaccttcggaatagcagtcgggtgatcttacccactgagccatctcaccagccccaaaagttttagtagactgtgaagcaatttggttttaaaagatagcagttgtcaggagtgggattcgaatccacgcctccaggggagactgcgacctgaacgcagtgccttagactgctcggccatcctgacctactaaacattattttaaattaaatctttgagaatttaagacaatatatttgagtacattcacttattctatagacattcacccataccttctgaccttttagttttcttttatgccctcccatccattttagtttgggttacccaactagtcttaggagtagagcctgccttggcaagtgtttgatcagtcacaggtcacaaccttaaagaacacagactctcttttcagaagagttaaatgtcagtagctcctatgttggtggtaggatttcttccattatgtctaaaaaataagtttctgaatgaggaggattgaagcaggctcacttcatttactcacggagcattttaattgagaataatgccttttacaacatagaaagggaactggattaatcaaggccatgtgctttttggattcttgaatcatttctttaatactattattttcatatttaagaaagtcaaattattttgttcaagaacagaaccaacctagtcactcaaagtcaaagttcattccaacatcattcgaaaatgagaaacaacactaagcaaggaaaagtgccaacagacaccaaactcatcccagaggatacctgaaaggggtgttcctttttcttacttttttagaacaaaacttaaattcatttaattacttacaaaaatataaagtgttcaagttattaatgacaaccatcattgctgtgggtgaggaataaattgtaaaatgacatttaacatttaagtaagctgccttctgaattt

SEQ ID NO: 841 - DNA, 1400 bp, mus musculus
atttgttatagtagtggaagtttgaagccattaatttgcaataaaaagtttcacaccagattgtaatgagaatatattactttgtgagcctgaatataagagtgggcagaaaagtcataatttgacatttacatattgaaaaggtttctttctcttttcaacagtttttcttttgttattattaattattttatttatctatatcccaaatgttttcccagtcccagcaggccctcacagagttcttccccctcatcttccttcccttttgcctctgagaaggtaccccatctggactccatactccctgggacatcaagtttctacaggattaggcccatcctctcccactgaggccagacaaagcagtcatatggtacattagtgtagggtcctcaaactagcctgtgtatctctagtctccggaagcccccagaggtccatattaattgacattgttggtcttcctatggggttgccttctcagtcagttacttgaatccttcccctaagtcttctagaggggttcctaaccttggtacaatgcttggctatgagtatctgcatttgtctcagttgagtgctgggagaacctctcagaggacagttatgctaggcttctgtctgcaagcacaacatagcatcaataatagtgtcagggtttgagatgatgcctacccacattgggcctgtcactggttgtccattcctacagtctctgctctttttttttttttttttttttttaatgtccctgtatttcttttagacaggaacaattttgtgttgaaaaatttgaaggtgggatgacctccccatccctcaaccggggtctctgtctactagaggtggtctcttcagattctgtgtccccacagttgggtatttcggctaaggttacacacactgactcctggaggcctcccacaagtcaggtctctgggactttctgagtttccaccaacccctccccctagcagctgcacatatccatttattctctggctctctgctttctctcctgtctcacccacacaactgatcatgtaccccttttctccccccaccccgccatcccactcaggtccctccttctctctgcctcccataattattttgttttccattctaagaaagattgaagcaagctctcatttggccctttcttcttgtttaacttatttgagtctatggagtgtatattgggtatttagtactttttggctaatatcctcttatcagtgagtacataccatacatggatttttgggtctgagttacctcacacaggatattttctagttccattcacttgcctgtaaaatttatgctatccttgcttttaatagctgaataattaatattccattgtgtgaattaaccacattttctgtatcagt

SEQ ID NO: 842 - DNA, 1200 bp, mus musculus
tttaaatgattcaatccgtagtttatttcaagaagagaagttaactgctatacacagctattgaatgtttattcaaaatgtccaaaatatttatccaaaatcatatatatgcttgaaattatgctttccataaaaataggaataataaaaacaactgacaagagtccattgtactagacagtgctaaatcctttgtcaagtgacaagggggactcttcctgcattcaaaagaggcaaggctatttgaaagttcttgctggactttcagataatctcattaggactaatgatcctgatggagcagctagatgagtcactaaggagtttcttagctttcctgagatacattcaagttggtataccagatgtcatagttactttttatattgttgtgattaaatatcctagtaaaagatagttagtggaggtaggtttttattgactcagccgtggtagggattgggtctaatgctgtctcaattcaattcggtacccaaaggaagaggttctccattctcagctggatttgactggcaataaagaattgctgtacagccaatggctgggtaggtagactgaggcgtgacatggagattcacggtcctgggatcccagggacagggagcagaaatttgccatgatttgagctgcaaaaagaaaatcatcagaaatgtaggtgagaaggaatgtgccctggaagggctgcccagaagtatcctaggcagtaatgactagatagccacccagaaggggccagggcaacaaagataaaatatagaattaaagggctttaagccaggattacaggaggaaaatgtgtgctactggtggggaggattagaactgtccagcctttgagctagtcaaggcacattataattaactctctctgtgtctctctctgtctctctctttctctgtatgtgtgtgtgtgtgtgtgtgtgtgtgtgtgtgtgtgtgtgtgtgtgtgtttcatgtgcaaatccagaaagctcctgagtaggtgtgccctggtgcaacttgccaggaaccaaatcagtgtagctaaacttgtagcaacagtagaaacccaaagcacctgatcacatgacatctaaaatcaagaagtaggcaatgaagagtgcatgtgctcagctcattttctctttgttttatagtagagatcatagcccagggaatggttcaacctagagtgggctg

SEQ ID NO: 843 - DNA, 1000 bp, mus musculus
taaatttgtatgtatataaactatcagttgtatgtatatcaacttaaacacaatagtctaaaattttgaaggaagaatgcacatacaagaaaggatcttggagagcgagatgattggcacaagatcagactagtccccctttcgctgtgcacagagggaagacatgctcctgtggtttcaggtgtcactgacagagcaatgggtgctgtgggcagggatgtctttttcttcagtggggtagtcactgataaattacccttattttagtaaataccctcccattattgctccagcaaaccaccttaattatgatcagtgggttgtttaaaaaatgacattaaataggaggatgcctgtagggaagtgaggttctgtaggaggagataatgcatggatttaaatgacaaagactcagtaaactcatataaaattatcaacttatgaaacataaaggtcttttattgttccccttgaattgaaattagattatttttaatatattacatcctgattagagttttccctccctcttcttctcccagttccttcccacctccccttccatctggatctactctctttctgtctctcatttgaaaggaacagatttctaagaagttacagcaaaaacttaactgactatggtagctgactgtaacatctggaatcccactggttgctcggattgattcagctgatctggctggtgaggtgggtgtccccttcctccctcactcctccatttgtgttccccttggaactacatgcttaagatggcagccttctctgagtagaaagagaatgttcttcagtcagttcttcagtagcttttctcccctgctagaacctccaaacaaacctgctaatggtattttgttgttgttacttttgctgttgttgaaatttcttctttttcttttttcatcagtttgtgtgtgggggtttgtagggtgtgtgtgtgtgtgtgtgtgtgtgggtgtgtgtgggtgggtgtgtgcat

SEQ ID NO: 844 - DNA, 1000 bp, mus musculus
taagtggacattagctcaaaagttcagaatatccaggattcaattcataaatcatatgaagcccagtaagaaggaagaccaaaatgtggatacttcagtgcttcttagaagagtgaatgaaatactcccaggagaaaatatggagacaaagtatggagcagaggatgaagaaaaggccatccagagactgccccacccgaggatccatcctatgtacagctaccaaacccagaagctattgtggatgccaggaagtgttttctgatgggagcctgttatggctgtctactgagaggctgtgccaaagcctgacaaatacagaggtggatgcttgcagccaacctttggactgagcttggtgtccccaatggagaaggtggagatgatactgaaagagttgaggggatttgcagccccatgaggagagcaacagcatcaacaggccagatatcccagacctctgggggactggaccaccaactaaagagatcacatagagagacccatggctctggccgcatatggggcagaaaatggccttcttgtacatctgtgggaggagaggtcattcgtcctgagggtgttccattctccaatgtaggggaattccagggaggaaagccaggagtgggtgggtgggtagggaagcaccctcatagaggcagaggtagggaggatgttataggaggttctgaaggggagacacagaaagcagaaaacatttgaaatgtaaataaagaaaatatgcagaagtggatggtcacaattatctattggatggaacacaggacccctaatgaaggagctagagaaagtacccaagaagctaaaggagtctgcaaccctataataggaacaatgatatgaactaaccagcaccccccagagctgtgtctctagttgtacctgtagcaaaagacggcctagtcagccatctatgggagaagaggcccttggttttgtaaagatcatatgccccagtacagggtagtgccagggc

SEQ ID NO: 845 - DNA, 1400 bp, mus musculus
ggtgcagccttgcaggaggagagaccttactttgggtgagctttgagggtttatatattcacaacactttcagtttgctaacttagcttcctgctttaattagagatgtactctctcttaaactcctgctgtgtcttcctatagtcatttctctccagctactatgtgccccacccccaccccccaagccataagcccaaagaaaccaatcttcctagggatgcttcagcttatggtattttaacacagcagcagaaaagcagtaaaacattaagtaaaagctagagtctgttatgttgtaagctttttaaataattaggaaggaagtttttaattaagttgttcaaagtttcttttatatatcctcaaaatgaagaaagtgtaatatgtgtgtgtgtgtgtgtgtgtgtgtgtgtgtgtgtgtgtattaattatagtgatttttaagcaataaacatagaagtaaattcaattctgtgtatattctttattttaagataacaatgagaagctgaacaaaagtgtttccataagaaagtaggttttcctcccagtcctttctgttggggcagacatgtagctggtctgctcctgggaagacatcacatcctgactcatcccagaagatccactgcactcagagaagtcaggcaactaacaccacagtctgaggcatcctgggaaatatgctgcccacaaggcaagaaagaaactgattgccagctagagaaagtacccaaggagctgaaggggtttgcagccacctggaaggaacaacaatatgaactaagcagtacccccagcgctccctgggactacaccaccaatcaaagagtacacatggctccagctgcatatgtagcagaggatggccttgtgggtcatcaatgggaggagaggcccttggtcctgagaaagctcaatgccccagtataggggaatgccaggacagtgaagctggagggggtgagttggtgagccggaggagagagaatgagatagggggttttcagagggtaaacgaagaaaggggataacatttgatatgaaaattttaaaaatctaattaaaaaaaaagaaaacaggtttaactgaattaaaacactagtactttaaaataataataacaatttatagcagatattttaaggaaatataaaatattgtgccaaatttaggggaattaaacttgttaatattaaaaataacactagttgcttaaaaaaaattctctatactacatagcttagcaaattttgggttttgctatggctgagccaaagcctgtgacctgctatttattaagtctttatcctctctggactttagtagaagtacaaaaaaattccaataagaattttgagcttgtgaggaataaccatacttgcatccaacatgga

SEQ ID NO: 846 - DNA, 1000 bp, mus musculus
aaaacacttcacaccaacatctctgctaaatggttactatgtgtcagaaattacaaacatgcaagaacagagcctgtggtgtagttcagtggtattttgcttgccttacaggcaaaagcatttgatctctgaagcagactttttttgaggaaaaatattagactgtgggtgtagggggagaggggaggaagagagcccacatcctgccagagttccagtgtgggcagtccgggcagacactggaggactgccagatactttccatgcagccccgggtgggcatctggctgtgtgaagccactaaccccacacagtggggggtggacaaggggcagcccctggtaccaggttctcagtctctggcatcccatgctagatacagcaaaggagctgagaacaggataggggccgcagggcaacactctggtcccagaggggaaagcaagagaggtcaggagagggggggcttgcggttcccacacaggcgagtgtctttagttcaggccttgatgaatagagatagtctatggttttagagctttattgtagaaaggcagagggaaagagagaagataaaaagagagagagaccagcatggtcaagagaagagaaggaggaagggcaagagagaaagagagttagagagtaagaaagttgaaggtttagagagagaggtaaagcttagagagagagtaaggaaagtaaaagcttaagagagggaggaggggccaagcagcccctcttagagtgggctgtattatcttgctgttgctaggtaactgtgaggaggagtctagccagaaagcaagaagctttggacattgtctacatgactgctagccaaatgcttctcctgttagtgctgtgggggctgtgggggcagtaactttgacaggagccaggggtccaggagacatgagggaacaccttctgttccatgtaggtgaaaattaatcaccaccaggtcctacgggggttcaagacctcagctcaactggaa

SEQ ID NO: 847 - DNA, 1400 bp, mus musculus
ttagaaaaatacttttttcccccattttagtctttgacttctatggtatcagtcaaccttgagtttgagatcaactgtggagtcaaagtcttaaagaacaggatattgaggaatgcttctgtttgtgtgaaagaggatgttccaagcataattcatcactcaccattgccacccaaattaagagccctgaatatgggaagaggaccatgagaaatcatgtttgaattttttctaaagctttgccctacaaatacctcttgctggttttaatttgtattctttttctagccatgagtaaaattgatttcaaagctgtgtgtatgttactgaacctgaaaacgttttgtgattgcctcttcccaatatatagtttgtgacaaaaatgaattcaatttagggaatccctgtcttccatgttagtaattggctagatcttattgtatatgtttgaaaacatagctgtgatgctttgtatatacttggctcaaggagtggcactattaggaaatatagccttgttggagtgagtgtgtgatggtggccatcctggctgcctggaagctaatcttctgctagctacctttggaacaagaagtggaattctcagtgtcaccagcccaaagtctgcctggttgctaccatactcctgcctttatgataatggaatgagcctctgaaattgtaacccacctccaattaatagtcatccttataagaattgacttggtcatggtatctgttcttagtagtaaaactctaactaagacagaagtttataccaagagtaaggtattgctgtgatagccctgagcgtgtttttgtttggaaaaaatatggatttgaggacttaggaaagcagtgaaatgctttaagtgggggcttaatgagctatcatagaaggaatatggaagcctttgttgctgaggctgacttgaactgtggaagcctagctctagataatttagaagagaagagttttaataggttgctgagagactgttcttgtgatatgttggtgaagaatgtggctgccttttacccctgtctgaagagtctactgaagctaagatgaaaggatttatataaatttttttggcaaaggaagtctcaagaaagtccagcagaaactttgttctctgattaaatctcatgaagggctttttgaacaaacatagcaagcttaaaaaggaaaaaaaatatataatatatggtttgagtattaaaggggcaccaggaagtggagctgaatccagtgtttaaggatattaaattgaattaagggagcagtgactttggggcaaaatcctacctagctaagtttaagtccaggcatggtactgcaccatttacaatagccccaaataataaaaaaattcattgtgtaactctaaaccagcaag

SEQ ID NO: 848 - DNA, 1600 bp, mus musculus
agtcatctgtgggactgtgataggcagcctatttttgttgaatgaggcttgctccggtgacccaggagaaaactctacaagggacagaaaagtgagccacaatcccggtcaggtgcctgacaccacagagcccccaactccatgattctgtgactataagtcacacagacaatgtcccaagctttggcattctggctagacttcacccccacagttacccgactatcgccaggtatgctcctccccacagttacctgatagcccagcccactataaaaggagctgcttgggccctccttgttcttttcaagctttcacctttcttactctcctctttagacctccttctttctctccccacccccacatagccacagccagcctctctctctctctctctctctctctctctctctctctctctctctctctctctctctctctctctttctctctctctctctaacttctctccttccccctgcctttctacaataaatctctaaaaaccatagactgactctgctcatcaaggcctgccatgcttgaacgatggggataggctttcccctacagagctgcgtctggaaggccttcctgtgctcaagccacagaccggaccaaggactcccgctctgatgggaaccatccagcgcccctctatccccctgcccattcctccttttggccccagggctaactgagccgccctggggtactcattctgttctccacccttccgcagtgtccagcagtgtctgggatgctcgcagctgagaacctggttcctaggactgccccttgtccacctccactggctgggtcagtagcttcccacagccaggcacccgcccggggccgtgtggaaagcatgtggcagtcctcctgtgtctgcccgtccagaacaccagaactctggcaggacgcatatttttttcccattccctttattcccctggagcccactgccccgcagtcatccaccacttctgcctctcacatttttttagccttctttttaaatagccttaggaggatttcatggtggcatcccatttagttctactctgtgctccaatgtcatttatattctttacatagttcaatagtgggtctgtgggttaattaccacctactgcaaaaagttgtttttccgataagagttgaacaatcctctaagtcattgggagtcattttattgttaaattcctttagcagaataataaaaggtatttctcaaaccccataacctatttagtttcaaatacttggttactttttcagtatcaggtatgggttgcatattatggagtgtgctttaagtctaattttttattggatattttgtttatttacatttcaaatgttatttcctttctccgaccccccctcccggaaactccctattccatcccctccccctgcttctatgaggatgctctcccatccacctacccattcccacctcacagtccttgcattcccctacactggggcatcaagccttcacaggatcaagggcctctcctctatttgggaccctgtgctctgtccaatggttggcaggaagcagcggttggttatttccatagcatttgtg

SEQ ID NO: 849 - DNA, 1000 bp, mus musculus
atgtgtgtttctatacttacacacatgaatacacaggtgtacatgcacaactacattaccccatcacctgaaatatctccactgcagcttcatggacagtaatgctggatagggactttgtagtagagatgaatacaatactctggtatgtaaagtcaacggaactgtatgtttgggtggctgatgctttagctgcagtacaacacccacagagtctggacttctagcacgtccagggtaccaaagagaacaagggaaaactaatacgcagtcactcccatactcagtgtattgctgcaatcttgcccatttttgagcacagctggcatgcctactcatggaccattctgccataggagtctgaaggcaagctttccactcctcctctccactgcatgtggagatgccttgaaatcattgaagtcatggctcctattctgcatacatcctcaactcagtccctgcctttccttggtccttgtgtcctgtgtatgacatttacactaagtaattaaagtatttccttactaaattttatgttagtttcttgagtgaaatagtaagagctttctttctcctttttttgtgagtgtgtaagtgtgtgtgtgtgtgtgtgtgtgtgtgtgtgtgtgtgtgtgcatgtgactatgtgttcatgtagaggcccaaggttaacatccagaattctcctctatctttcctacttcattcttttgagactaagtctcttgatcaaaccaagttgcatatacagctaatctccctaggcagtttgctccacagtccccctgtgttagccttaggaagctgcatccacagtgaggccacatccacccagagttgtgtgagttaagaatgtgaactcctgtcccctgtttgtccagccagtgctttaacctctgattcacttcctcagccccagggctttcttaattaaccttgatcgaataaatagcatagattaattgaagctctcaatcttttgacttctttccaacat

SEQ ID NO: 850 - DNA, 1000 bp, mus musculus; identical to SEQ ID NO: 849

SEQ ID NO: 851 - DNA, 1000 bp, mus musculus
acttaggataggtaaagatcctttcccaatctgttggtggcctttttgtcttattgacagtgtcttttgctttacagaagctttggaattttatgaggtcccatttatcgattcttgatcttacagcacaagccattgctgttctattcagggatttttcccctgtacccatatcttcgaggcttttccctactttctcctctataagtttcagtgtctctggttttatgtggagttccttaatccacttagatttgaccttagtacaaggagatagaaatggatcaattcgcattcttctacatgataaccgccagttgtgccagcaccatttgttgaaaatgctgtcttttttccacaatggagaccttaggttcttgatgttattttaatgtaaaaaaatagaatttgagcaatcaaatgttttcttcttattgctattatatgtctctgtcagttcttcagaaaatagagtccaacttaagccttaataatgacttagaccgcccggcctgggagggctttgcctgagcataggcttgcagacatcttgattccgggactccatcgagagtattctgcacaggtgagagtgtgcactacagaagctaacagcttctgtgacaggccaaagcaacacagcttctgggacaggtcctgttttgtgccttcatcttaggccaggagggaggttcgaacgccagatatctgtgcaccttccctgtaaaaggagagctagcctgcagagagtgctctaaccactgaaatgcagaggagagagctagtctcacaggtctgctgatagaagctaacagaatcatgaaggaacaatctctaaccagagacaactaaatcaattaactccagagattaccagatggcgaaaggtaaatgtaagaatcttactaacagaaaccaagaccattcaccatcatcagaacccagcactcccacctcacccagtctagggcacctcaacacacccgaaaagctagaccca

SEQ ID NO: 852 - DNA, 1000 bp, mus musculus
ccattgcaggaatctataactagtcaaaattcagagaacttatttgggctgaccagccccagaagataaagctacaaaacaactgtacacatgaggctcaggaaacatcttggaagaggaagaagaagaagaaagattgtaagagccagagcaccaagaagtctctataagacattgtcccctagaaatgacaagggacctacatctgtgatacctcaacaataaggctttctaaacaacacatgaacaatgacaactaaataagcatgctaatgtggaaaggggaagtctcatgatgagactacccctatacaaagaacaacacacaactaatgactactgggagagagaaaattggtctttaccagggatgaatcacctgatccatatcaatttgtcagccctgaaagtgtgtgtgtctgtgtgtgtgtgtgtgtgtgtgtgtgtgtgtgtgtgtgtgtgtgtgtgtgttttctacattttgcttcactgctgaggtgtcagaatgccactcggggaaatgaaatgcaggggtgcttggctacattccattgtccttgttggtgtgctggactcctctaacactgacacagctcaagggagatgaaacacagcttaagataggtgccctagcccaacataggtgccccagcccatatttctctgagagagaaacaagcagacactggggcaaaaccaagctgaaggcctgaggtgagcccgaggcagggtgaatctgatttagctcagggtgagtgcctggagtgcagagggcccttctgcaatatgaggaaggcttcctctcagcatggcagtccttgaagaagaagacagtacttgctttgtccaatctgtttatttatcttcttggaaatggatgcatactacaaaataagggtgaaccagacatttgcaaaaaggaatgtccaggaagagaagcttattggataaacccttggagcccatctcattatcacggagaactctaggttctatgtta

SEQ ID NO: 853 - DNA, 1200 bp, mus musculus
taataagtttttcttggaggatcactgccttccctgagttcttccatgaaagtctccaaggtcacttgccacagaagagaacagtttattcctgggaataccagggatttcagtcctgattaaaggctctattttcttttctcttcttttttcttctcttcttttcttttcttctcttttcgttccctttcttttcttttctattctgaaagatttacttattttatgtatgtgagtacactgttgctctcttcagatacaccagaagagggcgtcagatcccattacggatttttgtgagccaccatgtggttgctgggaactggactcaggacatctggaagagcagtcagtgctcttaagcactaagccatctcttgagcccaccatctctattttcttatgcagaatgagaccagagattgtgtgagtgggaaagaatgaataaaatgtgtgtcaaaaggaaataaactgtgtgcacccgaggcaggcccagggctgcctggcagagctcccctgacttgtttactgtgtgtacactgatgttcgtgcatggacaatgaaaacttcctgagaaagactttggagttgccttgaggtacagatgggccaggcctgaaggtgaaggaggccttccattcggaagacaaagtgacgtgtctaccaggccctctttctccagtgaccgatcaggctaccctccagtggtccagtgggaaagtgctcctttggactatgctgtgcaggctgaaatctactttaaaccattctggtgtcttctgatctcctgccctcatcccctttcccctggttctttgacatggatggatggcatgttcactgttggggtctattggaaagataagggttttgttgctgttgtttttttttgtttttgtttttttttttgttttttgttttttgtttttttttttgttttttggtttggtttggtttttgctgttgttgttgttgttgttgttgttgtagttttgtactctgaggaactgttagttgaattttcttattcactatggccaggcctcgattaagaaattatatttggaaattaactccaaaaatataaaaaataaaaataaaaaaattagtctcctgctcctgacctttcctctttgaatttgtagaaatgctgccaaagccatgactctaactaaggaagtgaaagatctgtatgataag

SEQ ID NO: 854 - DNA, 1000 bp, mus musculus
ggccctcagaggccacttgctgcaaggtactcacatccaagagggcaaggctacatctcaagctgacagctgaccttggcattgcccacttggggcccttctcacaggtgtttataatataggagttcagatatatgaagtcttgtatcaaggatacagaaaagaatccaaggaggccatatgacatatagcaggcgcagctcgctccactgaggttcagaaaggctagagcctgaagctgtgtgttacagtagagacaccagggtgctagagacgccgagaacttttactatggatttttacaagcatcaagtttagtagctgtaccaaaagtttagtatctataccaaaagcctatgtgtgttgtaggcatgagggttaggggacccaaacctgttagagggcaaatgatgccaccatagtctgcagaccctataggctttggagctggccctcctcatctgtgctgttcttttggtttgatttgtgctcactggccttccagttctccttttggaactagaatgtattctctgtcccagtgtatactggtagtaacttacttttaatataccagttaatgatagaagcagtgtgaaagttagactaaatgtactctgcattatgagatggtggagcctgcaggtctgggagcactgtgttcaggtttggatcttacacatcctcaacaggttcatgtttgaacatttgtcccctgtttcctttatgggaggttaggggacctttaggacatgtggcctagctggcagatacagaccaccacttcagagctaggtcactggttcctagtctgataaaatgtaaaggaacggacacacaccatcactgtttgatggagcttgaccagtacccacactgtcctaccatgagagacacctccgaacccatgagctgcttctgtccagtggttttggtcacgtgttaggagaagtgatgtaacgagcacagtagcattatgacgatgaaagtgttttgagca

SEQ ID NO: 855 - DNA, 1000 bp, mus musculus
aactcggatcccacctcagaaaaccctcctctccccacgagaattgagaagtttgacagaagctcttggttacgacaggaagaagacattccaccaaaggtagcatcagtgctgctgggtgtctgtgtcactgctgccattgccaccatgtgccaccatcccatcccttttacagtttagagaatttgactgtgcaacaacaccttccttctcacatgcgtctcttcctaagctgagtgttggctagtcattaatcatttctgatcttcatcttcccaaggggacaaagacagagaagtatgtcttaaaacagaattataactctcaacaccaaacattctaggccgttttgctgtccgcattagccaacagactagtgggtattttcagtgattattgcatttcttgctagacaaaccaaatcaataaaagaaaatgtgcttacccttatatttaacaacacaaaacttgagcagatttcaagggttcagaaaatggtatgggggctgggtagatgactcagtcagtaacatgcttgccatacaagcatgagaatctgggttcaggtccctggcactcaagtaaaagccaggcatggtggcatgtgcatctaagcctggtgttgaggatgcggaggcaagaagatccttagccaaaagagtctagctagattggtgagtttgtggttcaatgagaccctgttatacacacagaaagagagacagacagagagatggagagacagcaggttggagagacagaaacagagacacaaacagaaacacaaacagaaacaaacagaaacagaaacagagccagagagacagaacagagccagagaaaagcagaggaaggagagggagagattgagaaagatacccagcattgacctctgacctccataggtgcatgcatgtgcacgcacacagacacacacacacacacagggtgtcacactcatgtatacacatgtgaaaacacacatacatgcacagacagg

SEQ ID NO: 856 - DNA, 1000 bp, mus musculus; identical to SEQ ID NO: 855

SEQ ID NO: 857 - DNA, 1000 bp, mus musculus
aaaaaaagaaaaaaagaaaaaaaagcaagggtttattttaactgctagtttccagaaataaggtccatagtaaagaagtcacagttgtgttacctacaatggaataggattactatggaatagcttgttcaatttcaaaagtttcttaatttgatactattgctatggtaaaacactgagaaaaagcaacttatggaggacgggttagacttcaggatatacttctagttaccaactgactactgagaaatgtcagggcctaaactgaagcagggcaggaacctggatgcaaaaactgaagcagaaactgagtaggagtgcttcctcctgtcctgtacctcacatatttcctaactaaagctcaagggtggccccatcctagagagcttggccctacaaattccattgttaatcaagacaatattccatagacttccctacacaataggtcaatgtagtggaggcattttctcaactgtggtccctcttctcaccaacctcttctcttagtcatttttctattcctgtaataaaacaccaggactaaggtaactcatagaagtaaatgtttatttgagaattagagatgtagagagattagagtccttcaaagtcctgacagaggagcacggctgcaggaaggaaggacaaccaaacaggaagcagagacctatggctttcatcttaggcagcaaacatgaaacacagagagtatactacaaatggctcctgaattctgtaaacttaagttctaaccaatggcatacttcttccaggaaagccaagccacttaacccaccaaaaatatgtgtcaaagataatatcatatactgtgaagtctggaattagacaggcatcccattcaaaccatcaaaatgaaactccacctcctcttcacacccctgcaaaaagtcaccagttcaaggaaactttgaagccattaatttgattcactcacagttattctggcagcatgtcagttctgaaatgttactttgct

SEQ ID NO: 858 - DNA, 1200 bp, mus musculus
actgcatggatcaacagtttctcaattagaagaagatagacgagaagataaagtattcggtgactgcgaagctttagcagcagctgagaaatattcggggaacatctggctggaatctatttcttcttaggtaagcactcctttttgcaacaagcatacataaagcatgaaattggcatccacacctcttcccaacaagaaggaagcttgatttagtactcctctgatgcaggtatgcaaaaactgaagtgtcatgaggcatggccactaaagcccctccaaagctttgagctcttctctgggggtagcatttgtcaactatatgcggcctggtttttaagatcctatctagtctgtcagtataaaaaaatagctgagaaaaataaaaagaactcaatttgtgatgattttagatttttttcatgaacttttttttgtgtgtgtgtctgagcaagggttattattaatactaaatttcttttattttttttgaaacgggcacttttcatagctaatttattctcttgctttgctaattcaataatgcctgccactttaggcaatgaaggcaaatggttttctctatttccagcctcaattgtgtgatcacaataccctgaaacctgggagccgtattgttgctttaatatgaaagattgtaactgggagattccctattgctcatcaatcaaaccaataaccagtcattttctatatgtgtgcatacatatgtgctgagatccatgccttctctttcgtgggtgatgaggacacacatatgtgcatatgtggaggggagaagttaccatcaggtgttcctcaagacctttctaccatgtttttgtttgtttgtttgtttgtttgttgttgttattgttgttgttttaaggctctctcactggtactgggagcttgcaaatcaggctaggctggctggcctggtgagccatctgtctcagtctccccagtgttgaccatgatcatcaccaggttttgctttgttacttgggttctgaggctcaatctccagtcctcctgccggctctccaagaaactcaccaattgcattatttctgcacccccttgctgcttgcttttaagatgtatcggtgtgctacggaaaggggagctgaagtcaaaccaggttcattcagttcatggaaaaatatgaatacttaggccagctcatgtagtgatgta

SEQ ID NO: 859 - DNA, 1200 bp, mus musculus
ggaaacagtgcagataacccgaattgcaccagagccatttcatttaaccagcttacatataaaatactattttggggtgagtttactgggtcttttcttgctttagtcttctatcttctgctgattctatctatattcccagatgtgctcttgtggcccatgaaatcaagcttgggtgagacctggtgcagaacaggaaggcgacccatacttggtttcagtggctgcaagaatgactgcatggtcgacaggatgcctttgatgttgcacaggccttccaggaaagaagccattgaaaaccttcaaccagtgttactacactcagatacacaaaagaaatgaacacagtccatgctccaacatgatcatttatttctctaaccagattggaaccagtagcagtgaatgacactgttcatgatatttgaaaagcagtgttcagggcctagagctatggcttgggaaactgcttgcaaaagagcataaggatcctagttcgaatcctcagcacatgggtataagcttagcatagcagtacacacctataatcccaaaccagggtctcagagaccagcagacaccgggggcttactagccagccagcccagcctaactgacaggccagtaagagatttgtttcaagaaacaagatgggcagctccttaataaggatgatggatgttgacctcaggcctctacacatatccttcacctacccaatactgtttgtaacacaggagcttcttcatctcggaagagttgagttgtgtcccccacgtgcattctgaccttcctgttcagcctgtccctcttcctccacttctgctgtggctgtcactctgtcaaggggtcttttcctgtccttctatgtcagtggcttctcttcctgtacttctactgggacattgagtttgtccaaggtcatgggatagttccttggtaaactacagatgagcagacagatatgcaaaatatcagccaactctttttctcaaaacctctactcacatattctgcctataaggtcacatttgtttgtttgtttttaaagaaaaacccagttagagatctaccagaagccgacttttctgtgtaggtgattgaaattatttcaaattatccttttgagaggatcaagagaaacaaacaccctcagggaaataaagtttgcatcattaaatatttgttcatgtatgtatt

SEQ ID NO: 860 - DNA, 1200 bp, mus musculus; identical to SEQ ID NO: 859

SEQ ID NO: 861 - DNA, 1000 bp, mus musculus
tagtaagattcttacgtttacctttcgccatctggtaatccctgtagttagttattatagttgtctctgtttagagattgttcctctggtgattctgttaccctctatcagcagacctgggagactagttctctcctctgagtttcagtggtcagagcagtctctgcaggcaagctcacctcttacagggaaggtgcacagttatctggcatttggacctccttctggctgaagatgaagggctaaaacagaacctttcccagaagctgtgttgctttggcctatcccagaagctgttaatttcagtagtccacactctcacctgtacagactactttctgtggagtcccggaaccaaaatggctcccttggatcctgaggttagggcctccccggccaggcggacacctgacctctggccgggaaggtggccggatgtccaatgcccgaaaatggtgctgcctcagaagctctgtggctctcgcctgacccagaagctgttagcttctgtagtccacactctcacctgtgcaggctgctttctgccaagtctgggaatcaaggtggctcccgcagatcctgagtcaaatcctagcctcccgggctgggcagacccctgtcctctggccgggaaggtagccggatgtctggagcccgaaaacggtgctgcctcagaagctctgtggctcttgcctgtcccagaagctgttagcttctgtgatccacactcttgtctgtgcagacaactttctgcggagtcccggagccaagatggttcctgacgcaaaaacctccctggccgggtggaaccctgtcctctggctgagaaggttgccggatgtctggagcctgaaaatgtgtaccacattttctttatctgttctttgagtgaggaatatccagattgtttccagttcctgtctattacaaataaaatttctaatgaacatagttgagcaagtgtctatgtggtatggtagaacatccttggcatgtgtgc

SEQ ID NO: 862 - DNA, 1000 bp, mus musculus
tctagagacagtctagtgcaaagtttctgcgtgtatctacagctctggtcttcttttgttctcccccttccccctctcttcctcacccccctccttgtcccaacaatgatcctcaaaacgctcctgggcctggaggatgagcaataacctagaaacagagatcctcaggctgtctcagaccagctgagttaaaacttcccagggctcagactggtactctgtggtccaacagaccctgcaggaacttctaatgcaagctaaaatttaacaactctttcagtccccttctgttgctgtgacaaatactagcaccaaaagcaacttagaaaagaaaagggattgtttggctaatatttccccgtcacagtccatcactgaggaaaggcaaggcaggaactcaggcagaaaccatggaggaatgctcccagacttgagatgttcagtagcttcttctacagccaggatcatctgcccaggaacatgtgctgcccacagtggactgggctctttttatgtaatgaagacaatcaggaaggtctggcacaggaatgccacagaccaacctgatagaggcaatttctcaactgagatttttcaggtgatgctaggctgtgtcaaattgataattgaggctcactagggcaaaaccaagtggcagaaaagcagtttccaccagcccctctcaatccctacggtctgtgcactgcatggagaaacagggagagggccaccaccatcatggaagaggatccaggcccatctgatcccagtactccatccgcaggccttgtgcacctctaagattttatagaaaccttattctgagaattagagttgataacgctcatcatcttaccaccatcttaaccaggcagtctcagtaagataaacacaccctgctaagtctcaaataaatacgtgtatattgcagagtttatagaagtggggctagaaaagtttggcttagctttgtttgaagtgaaccgggttaatttatggg

SEQ ID NO: 863 - DNA, 1000 bp, mus musculus
cataaaagtctgtatacaacttatctaatatcccacacccctttgtaaaacaatgtggtaggatctagagtagggaagagtgttgcccatgatccttccctgtcctctgtccatcatgttgactgctcataaggctgatttcactagattccatcagacagcctccctttccccatatgccagtcaggttctgctgtaggaaccagcaccagatcaaggaatgaggaagaggatagaagcattgattccttcatcccactcttcatccgtcatggagcacacagctcagccaagggttcatctcccatactgacagccacattccccacccccaccccaagtcctggattctcataagcgggctcctctccatatcctttcagacctaggtctgacaaaactcccaaccacagctacatcttgatgtttcccttgatcttcccaacacccgggaaagtttgtgccgtttgtatgctgctggaaccctgcctcagactgcagctagaaaggcttagtaatgagtagcttagtgagacatgtaacagaaagatgtatgtagacacctgcctccaggctaatatagtagttcaggcggcctcctcaaggctattagaactgaaggagtgttgtatctcagctttacatagtagcatgctctttctgcagcacgcccggtgttctgggttataagcagagaaaagatcttgtttgtgagcaatgactttgcagaagaacccagtaactgaagcaaaagaaatcccaacaccagaacagatctgagtgagaaaatgctgtcagctggagcctctggagcgagggatgtaaccggaacaccagtgcccactctcactgctgcctaccaagctcggagacatttgaaaccctgcacagatgctgtgagaacatttagaaatggatgttttccacaatgtgggtcttccacagagacccaccactggacaccatgcagagagactttggagcaagcacccagacctaa

SEQ ID NO: 864 - DNA, 1000 bp, mus musculus
actaaaaaattgaaatccaaaatggaggaaaatatcagttactatgaacagatatgaacctgtggaatgaaatctctgtctgaaatggagacactaagtcttttgcaacttactgaacctaggtaaaatttcatacatattgcaaagaatggaagaactactagagcaaagtaacatttcagaactgacatgctgccagaataactgtgagtgaatcaaattaatggcttcaaagttttcttgaactggtgactttttgcaggggtgtgaagaggaggtggagtttcattttgatggtttgaatgggatgcctgtctaattccagacttcacagtatatgatattatctttgagacatatttttggtgggttaagtggcttggctttcctggaagaagtatgccattggttagaacttaagtttacagaattcaggagccatttgtagtatactctctgtgtttcatgtttgctgcctaagatgaaagccataggtctctgcttcctgtttggttgtctttccttgctgcagccgtgctcctctgtcaggactttgaaggactctaatctctctacatctctaattctcaaataaacatttacttctatgagttaccttagtcctggtgttttattacaggaatagaaaaatgactaagagaagaggttggtgagaagagggactacagttgagaaaatgcctccactacattgacccattgtgtagggaagtctatggaatattgtcttgattaacaatggaatttgtagggccaagctctctaggatggggccacccttgagctttagtcaggaaatatgtgaggtacaggacaggaggaagcactcctactcagtttctgcttcagtttttgcatccaggttcctgccctgcttcagtttgggccctgacatttctcagtagtcagttggtaactagaagtatatcctgaagtctaacccgtcctccataagttgctttttctcagtgttttaccat

SEQ ID NO: 865 - DNA, 1400 bp, mus musculus
taccttagagatatggttatagtatggaccatacttcattgttatgaagcatttcctgactctgcattttatataaaacttatccccatcatcttctggttggtcaataaagagatgatcaccctataactgggcaagagaggataaagtgggatttccatgccctgagagatgggggaggggtgggcacaggaagggtcaccaacatgacacagatataaaagggggtactagagcaagaccaagatgacaggtaaccacgtggttggagattggctggtaagtaggccagcaaacatagtttggctagaatagttctgtatataccctgctatagagtatgaagcttataaacaaatgcaaaggtctctgtgtcattatttgtgaacaagggtgggcatagaatataaccctatttctagatttgcttcccaacatgttaggcacagaatccaaacttgagacagattgaagctcagaaacagataagttcaggacatgggagacagaccaaaaaagccagcaaatagcaggagaggcataacgcagctcctctcagagcctttgataggctagctgctgggtacttggatgggtttcatgaagagctaataatgaacacagcagctaagctcatccatgctgttctgaagagaaggttgacagagtggaggctcagggaaaagctgctacaggttctcttggagttgacacagaaaagtctgcacagtccacccctgtgggaacatgggggctcagctgcagccctcagaagcatttccctggggtaggaaaatttggtagtcaccatctacagatagatatatggagacagtacacatctttcctgtaagcagaagggctagggtagagccagccacagtacaaggtctgagttgaacaacagaagataggtaaaaacacagaagaagaaatccaagcacagctgaacttctaatcaggtaaaaatgtttggagttatgattaaatgctatgaaaaacagagactgagtataacacataataaataaatatgaacagtttggaatcaataaactaaagtccttaaagagaaaactacataaaattaaaaacaataagatatgtaaggatgaaaataacaacaaaacagagtttgtacatgacataatgctattttattttagatggcttaaatatagagataatttggaaagataaatatcttaacagaaagtgatacaatgaaaatgtgttggtttgagagtgcttatcccagggaactatattgttaggatgtgtggctttcttggagtaggtgtggccttgttggaggaagtatgtcacagaggaggtgggttttgagactctactcctggctaccttcagttcaaaatgtaggactctcagctcattctcca

SEQ ID NO: 866 - DNA, 1400 bp, mus musculus
ttgttgaaaagtcaggtataattctaataggtctgcctttatatgttacttgacccctttccattgcagattttaatattttttgttgttttgtacatttagtgtttttattatcatgtaatggatgggtggttattttctggtccaatctgaatagtgtgctgtaagcttcttgtatgtttgtaagcatctcattctttatgttggggaaattttcttctttgattttgttgaagatgttttctgggcctttgagctgagaatattttgcttcttctattcccattattcttaggtttggtcttttaatagtgtcctaaatttcctagatgttttatgtcatgaacttttttgattttgcatttttcgactgatttattaatttcttcaattgtatcttttatgcctgagagtctatcttccatctcttacattctgttggtgatgtttgcatctatacttcctgttctctttccgaggttttgcctcaaattgcctcagtttgtgttttctttattgcttatattttcattttcaggtcttgagcactcttattcattttcttcactagtctgattgcattttcctgtatttccttgagggatttattgatttcttccttaaagacctttatcatctttataacattgggcttaagatcatctctttattactttttcaggatatccagtgcttgctgggctttgttggtgccatgttcctctggctccttttgattgtgttcttaccccggcctttagccttctggttgtccctggtatcggctgtatgttcctgattctgacaggactccttaaggcaggcagagccttgggtctaacattggagttcaaggaacagcatgctgctcatcactttggttgtatgccaggtggacaaggcaggcaggtgatagagtctaacctgggtatttctggcaggcaggtgatagattgggtctaacctgggtatttctgaggcctaaaggcctggatgttcttgggatccagtggcctcctctggagggaaggtgatggagctctggtagacagaattttattgtttttatgactaagatatatatatatatcccacattttacttgtccattaatttgttattaatttgtttatggacaaatagattactccctcaattggttgttatgagtagtgtcacaaagaatctgggtcctgtgatatctcttcaacatactgatttaatatccatggacacacaccaaagaatgagattgtgaccacattgttgttctatttttacttttttttttaaggagcatccatattggtttcatgatgagtatactaacttacattcctaccaacaatgcagacacaattagttttagcaaaattacacaaaagtcattcctgtgataa

SEQ ID NO: 867 - DNA, 1400 bp, mus musculus
ccggacagcttctgggatgggcagaagcacagagccgctgaggcagcacccttggcgggccgcagacagccggccaccttccggaccagaggacaggtgtccgcctggcttgggaggcggcctcagcctcagcaacagcggtcgccatcttggttctgggactcagcagaacttaggaaattagtctgaacaggttagagggtgcgccagagaaccggacagcttcggggacaggcggaagcacagagccgctgaggcagtaccctttgcaggctgcagacagccggccaccgtccagaccagaggacaggtgtccgcctggctcgggaggcggcctcagcctcagcagcagcggtcgccatcttggttccaggactccctggaacttaggaatttagtctgcacaggtgagagtctgcaccacagaagctgacagcttctgggaactgccaaagcaacacagcttctgagagaggccctgttttgggccttcttcttcgaccaggaggaggtccaaaaacaagatatctgcgcaccttccctgtaagagagcttgccagcagagagtgctctgagcactgaaactcagaggagagaatctgtctcccaggtctgctgagagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccaggggaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagtgaggcaacactggagatagaaaccctaggaaagaaatctggaaccatagatttgagcatcagcaacagaatacaagagatggaagagagaatctcaggtgcagaagactccatagagaacatcagcacaacaatcaaagaaaatggaaaatgcaaaaagatcctaactcaaaacatccaggaaatccaggacacaatgagaagaccaaacctacggataataggagtggatgagaatgaagattttcaactcaaaggaccagcaaacatcttcaacaaaattattgaagaaaacttcccaaatataaagaaagagatacctatgaacatacaagaa

SEQ ID NO: 868 - DNA, 1000 bp, mus musculus
attcccctggcctcagtgactctccttaaccgcagaggaatattccccaacccctctattcctatatccctcacgactataaagccagaattgtgtgattcatgctaccaaatttatctgcttgcttaggatagaacctgaagcccacctgttttttttattattatttaattttatttttaatttattttttacactccatatcccattccctgcccgcccatccactctcactctgctccacatcccacacacctcttccccaccccacccctgtctcctcgtggatgccctaccccctcccaccccacctgacctctaaactccctggggcctccagtctcttgaggattaggtgcataatctctgaatgaacacagacccggaagtcctctactgtatgtgtgttgggggcctcatatcagttcgtgtatgctgtctgtttggtggtccagtgttgagagctctcaggggtccagattaattgagactgttggtcctagcccttctcctcagcttctttcagccttctctaattcaacaacaggagtctgctgcttctgtccattggttgggtgcaaatatctgcatctgactcagctgcttgttgggtctttcggagggcagtcatgaaatatccctttttgtgagtgctccatagcctaagtaatagtgtcaggccctgagggccagcagaaagaatgtaaacaggcaacctcaggaagtaggaggtttgggggactcccagaatgcaccagagacctgggaggtgggagactcccaggagtcaaatggagggaccttagatgaaacagtagggagagggaacttacagagcccacctccagcaggaagacaggacatcaagtcagggatggggttgccatcccacagtcacatctctgacccataattgttcctgtctgaaagaattacagggatggcaatggagaggagcctgaggaaaagaaggcccagggacagggccaaagtgggatcc

SEQ ID NO: 869 - DNA, 1600 bp, mus musculus
tcagaggagggcctgaaaatctagacctagaaaataatgcagattgtattttacctgaactatacagtaaaagtcaagtgtctgaagaagtttagtaacttttcaaggttttaagggaatcatgggaaatactatcatagacataacaactcacttaacccaagacttgcaaactttgtgcatggaagctcagatgtctgtggttggccttgttcaacatgaaacaaactcaacaggataaggagtgaaattatggaaggtgcaaaccatcttactatattgtgaggtctgagggactcgcagagcctgtctgctcacgtgtgtttgttctgtgctttcactactttccctgttgctgggaacaaatatttgccaaggaacaacttagaatggtttgcttgggctctggcttgagggccctctgccacggcagggatgtgaggcaactaacaggtcatgttgtgtctgccgtgaggaagcacacagaggccagggctgctctcagctctgtctctcctttgtattgagtccaggacctcagtttatagcatagcactgtcaacactcaagagcggggctcccctcctcaggtaaagtcttctggaaacatcctcagagacaactcagaggagtgctttccatggtgattctaaaatgggcagggttgacaggaagataagtttcacattctaagactcccagcctgcagtcagcagctgtcaatcataaaactaaggtcacagtcagtaatgtaacccctggggcggaatgctctcttcagagtggaaaccactctgaagctcccagcaccctaagcccgactggctgagcctgtggaagccaatccggtatgctgatacccttaccctgggtcattacactctctgaagcttgctatcctctgaagacaccgacctgccagtagctataggtatgagtctcttggatagaataaccacatactttaggtagtaaaatatctttgattaggcatccgactgtgaatgacacacagtcagacgactacagttcaatggagcctcagagaagtggctgggacaaatagaaaagccgtgctgctctcaggtatccaagaccccagtgttaggaagcacaggttgacacatgttttcgataaagccattctacgtggagaatcaggaaactcaaaaatgtgaacgatctttaatttggtgacttgcttctaaagattctaaactggggggaggggggtcctccagggctagagagagagtgcagtgtataaagatgcctgcggccaagcctggtgatctgagttcaatccccagcacacgcacatggtggcgctagagatctgatttctacaagtctttgggtctctacacatgcgccacggcacctgtgcgcctatttccctctgctctgcaaataactgaagagatgtcaatttgttaaatgtaaagacttagttttacaagggaaatattggaaacatctaaaactgttgtcaggaattaataagtatgttttaagggctttgttagctagttctaccaaagttggtaatacaggggacatattgtaatatgctgtagaaatctcgcgtgtgttttacagt

SEQ ID NO: 870 - DNA, 1000 bp, mus musculus
catttatcaaagatgttgtctttcttattagcatataattttggagatctttgtcaaatatgcgatagctgtaattagtcttctgtttgatcccactgatctacatgttcatgtagtttttattacaaaaactttctgaatatggcttgaaatctgatatgatattgccttcaggattgtttcttttgctcaggatttctttaggtatctgtggtctttgtgattccatatgaattttagttattttttctatttctataaagaatattatgagattgagattagagtatattgtaactgcttaggaggatggtcattgtcttagtgtcctattgttgtgaagagaaaccatgaccatagcagctcttgtaattgagaacgtttagtttaatacagtttcagaagtttagtccattattgtcctggcaggaagcgtggtgccacacagatacacatggtgctggagatgtagctaagagttctgcattcagctccagaggcagcaagaagagagaaaaacgctgggcctgccttgagcatttgaaactccaaagcccacctctagtgatgtgcttcctcagcaaggtcacacctacttcaacaaaggtcacattctacttcctgtcaggtagaccactctctaaggaccaaacattcagatcgatgaatctgtgcgagccatttttatttaaactaccggtcactttcacacgataaattctaccaattcatgagcctggaatatctttccattgttccaatctcttcagaggattaaagttttcaccacagtgatccttcaggtagggttacacccattttttgaaggctcttgtgagtgggagtgttttgagggttttttcttgttttattttcccttcccttcccttcccttcccttcccttcccttcccttcccttcccttcccttcccttcccttcccttcccttcccttcccttcccttcccttcccttcccttcccttcccttcccttcttgg

SEQ ID NO: 871 - DNA, 1200 bp, mus musculus
caacaatttcatgccaggatctacacggtaggagaaccagttcctagaagttgtcctctgacccatggctcatgtgtgtgcacatgcagagacatacatacatacatacatacatacatacatacatacatactgttgtgaaaaggaaactgaaggtttaaacaactatttacagtgttttctagttcttgagctacaagcataagccatagcactgaattccctggctacacgctccactggggggaactaatacaagtgtatgagcttctggaaacagatgagctgtagacaagccaaaggaactgtgactctcagaagagcaaatgctttttagccaatttcaggccacagcatctgtattagggcacagcctttcaagtctggtgctgaaaatacataaacaaataaataaatgggaccatttagaataccaacaacaaaatgaaatattcagaggtaaacacaatataacatggaaaacctgaacactcaaaagtataaaaatattgttgagaaaaatcaaagaactaagtagatgtactgaggccacaggtcagcagagtcagcactgcagacagcagctctcaccagtccctcttcagactcaaaacattttctttcattttcccatgaggctttgttttgtttgtttgtttttaagaatagacaaagtgaaaaacatagaaagaaagagactgagtgccttagtgttgtactactgtggagaggcaccatgaccacagtgactcttgcaaaagaaagcatttagttgggacttatttctattttagaggtttaatctatgctttcatgtctgggaacatggcagcacccaggcggacatggtgctagagaaatagctgggaattctacatccagatctgcaggcagcaggaagagagatacactgggcctggacaaagcttttgaaaccccagtgacacacttcctccattaaagctacacctactccaacaaggccacaccttctaatccctttcaagcatcaccattccatgatgactcagcattcaaatacctgactctttgggtaccattcctgttcaaaccaccacagggaagataacctatcttcccatcaggcacccatagagttcctaaaaagtcatttataatttatttggaatatttctccaactgatctatttgcactacaatgattacttaacatattgt

SEQ ID NO: 872 - DNA, 1000 bp, mus musculus
ggcttttttgtgtttcctctttaagagcttctacctatttacctgtgttctcctgtatttcttttgtttgtctgtttatttgtttgtttgttttttttttgagtctcctgtatttcttcaagggagttatttatgtccttcttataaacatctatcatcatcatgagatatgtaactttaaatcagagtcttgcttttctggtgtgttggggtatccagggcttgctgtggtggaagaactggttttcgatgattcaaagtagccttggtttctgttgcctaggttcttgcccttgcccctcgccatctgtttatctgtggtgctagctggtcttgctgtctctgactgtggcttgtcctacctgtgagcctgtgtgccagtattcctgggagaccagttctctccaggaggaatttgattctggagagctgtggcacagggtcagctccagggtgcagacggaaatcagaaggatcctgtgccctactgtttcttggttcctgtttcctgatggttctgggcggatccctggggccaggaatttgagcagaagtggtggtcttacctgtgcacacaggtgtgtcggcactcctgggagaccagctctctcccagcagatttgggtaggtagtgctgtggcacaggatcagctccagatgcagatggaaagtggaaggatcctaaattattacttttaaagttctagccatctcaaacttctcccatgtatgccagaaaggcacagacatccaactgttgtcttcattctatgccttttggatttggctcaatgattcttgacctcatattataatatctaaagacttggtgctgggctaccttcaaaccaataaaatccaaatatccaaggtagcatccacaccccagcattcttagtcttctcaggctatcatacatgcaaccaagagccactgacatgcagatcaataatcttgctgttacttgaagtttcttggaagtagttttgtgctacactgg

SEQ ID NO: 873 - DNA, 1000 bp, mus musculus
gacctcagtatattcaggtttttgcctttgccaatcatttcctattttattcaaggctttataaagacaactgacagaaagccaactcaaattactgcaagtaaaaaaataacacattggcttatgtaatactagtcccagagctgctcaaccttaaaggaacaagaataatatatgttcacgatgctatcaatcattgaaaagtactttccctccaaacctgacctcagaagaacagggccacttcttttctcccaggcttcttaccagatccattaacagataaccctactcaccttctctccacaaggtttctaaatgtgcataacctgatgtacgtaggagaaacaatagccaacgcagttgtgctttcacataccccaaatcccagtatttagaaagctgaggcaagatggtcatggctttgaaatcagcctgcactacataaccagagcctgtcttaccaggtcagaccaaacccaacccaacctaaccccaaagctcaaggcaaagtgatgtcctattgggaagtcatcatcaatgtctgtagtggatttggcctaatgctgcttgtatcctaaggttaatttgggtcccctaaacttcttacctgagtatctgcaagtagcttctggtaacccgcctccacttggttctgattggtaaataaagatgccagcagccaatcgttgggcagagcagatagaggcaggaccttaggattcccaggcttgagaccaggaaaagaaaagggagaaagaagtctgccagactaagagtgaggaggaaagaagagatgccagcctgagaagagtgcaggacaggaaggcatggccaccctgtgaaggaactgggagagtgcagcctagttaggcagccccctgggtcccaggcaaccaaggtagaatatagagtttagaaggaataactcagggataccagcaggaggtagattcacatcatggaggttaggcagtcgcccagctactgcactgttgaa

SEQ ID NO: 874 - DNA, 1200 bp, mus musculus
taataatgtaaaatatatttagatatgagataatcacagttgaagctgttgcactaaattttctgagtaagaactgggcacatagcgatgaaacagctgccctgctaggcatggatgcagaaacgtttgatttagctttagcagaggagaaatggaggaaccatagactattaaggatgaattcaggaaggcctgagaccatggaaaacttgcctgcactgtatactatttttcaaggagaggttgctatggtgacagaattatcaaaatcccaggctgtaggaagcaaggtctggttcatcgaactcccatgtcgtcctgtcgagtggataagccttctgcaatagtggatgttggagacaaagtgtgggtgaagcttattggctgagagatgaaaaatgatagaataaaagtgtccctctccatgaaagttgtcaactaaggtactgggaaagacctcaacaacaacattgtcattgagcaagaagagaggcacagtcagtccttcaggattacactgggcagaagatcacccttgaggccgtcctgaacacaacctgcaagaagtgtggctgcaaaggccactttgcaaaggactgtttcatgcagccaggtggaaccgagtattctctgacccctgaagaggaagaggaaaaagaggagacaaaggcaaaaggacttgagaagcctgatcccacaaagaattcgtccaggaagagaaagaaggaaaagaaaaaaaagaaacatagagacaggaggtcatctgattgtgaaagctctgactctgagagtgacacgggcaagaagatgaggcattcatcaaaagacagcaaggccaccaagaagaaaaagaagaagcagcagcacaaggaatgagggtggaacaagccacagcagccctttctcctgcaaggactcactagtgagagtgtagcctcctaccctactgacttgtcccgacggtctcagatggcttctcctcatgcagcaagcagattggggccccgcagggcacctaccaacattgttttcccttgttgctcctgatcctttgcaagcgaaccctgcagccattgcattcatgcactcagtgtcttcatttcggcagaaggttctagtcccaacccggctgccactgcccaagctggactcctctgcaggagtccatgctagagcctcaggtgctgctgtggagggaag

SEQ ID NO: 875 - DNA, 1000 bp, mus musculus
tttcagggctctcccagcctgcagggtcccactaatgacacagcttcatagggtgttccttgtgcccaggatgatggtgcctttttaatctaggttatctggcagttccaacaaggggtgagctgggggtgggggactgaaagggtaaaagctagttcttgtatgtcttcagatataacagacttcagcaggaggtctaacatgctaacctgaggtagaaaagggctgagcctgtaaggccttcacagaaagtgtagtacagggattcgacatttagcacagataactaaaccttgacagttgtgatgtcttggaacagtgaaagcagcagttagttatgtttgaaacagggatgtgtgggccatcaaacactctcactgagacactagcactgcactgaaggaagtctataggagaggccctgtgagcacctgtgagttgacgtgagctttgggttttactgctatcttgtaggcagtcagattccttgtgtgaccagagaatggggctcctgccatctgatctatctcagcactgcactggagtagttcctaccctcttctgctccatgatagctgttttcttttcaaaacccctttttatcgtgttatggtgggtccattgaagctggaaacacttaaaatcccataggaacaaagaacattccggatctttccagccccaaacttctacaagatagatagtttatctgtgtgtaaattttcctttgtgtttttgttttgtcttgagatgggggtctccactacagcccacgctggcctggaactcactctgtagatctaaactgcaattcttgcctcacattttaaaggataagtgcttcgtgcgacccataattaatcccttctaccacgcagcgtggctccctgagctgctagtggctgtgccaggctcgcctccctgtatctgtaaagttcccatttcatctgccccctactcctgccgagcctgctgcgctgcttcagatccacctttcaag

SEQ ID NO: 876 - DNA, 1200 bp, mus musculus
ctctccagaggcctctggtctgcctccgagctccaccatgaccacatacagctcaggctgcaggcagaggcctttctagggacatgatgctcttgccccattaaaaaacaaagcaaactgaaaaacaaaacaaacaatcggaacagaacataacaagcaaacaaacaaatacaaggtttcatacaacctaggctgggctccacttcactgtgtaaccaagaatgaccttgaactcctcatcctcctgcctccacgtccagtgaattgcagatatacaccgccaccgtctcattgagcagtgctgagactcaaacccaggaactcaggcatgcatgctaggctagcactctccccactagttagttatacttttgctcacgctcaccattgatttattaagttattttgtatgtgtatctgtctatgtgagtgtatgtcacatgtgtgtgatactgtgcctacagaggccaaaagagggcattggatccccagaaccagagtcactagcagtgctgagctgccaggcatcagtgctgggaacagaactttataccctttggaagtgcagcaagtgcttttaaccactgggccacctcccctcccctgcccgcagacatcgttatacacaaaacttctatgactcccacaaatgtgcacagcagggtagaaagctgaactgctgttcttagataaaaaatgaactattaaaagatcaaagctactgccaagtgcactgcaggtcaattatgttagatgctatttcactgttgttcatcaatgtgtttctaaaaactgcccccccccgaattccactgaagggtgggaggaaggattgaaggagccagagaggtcaaggacaccacaaggaaacctatgggatcaactaacctgggcccacaggggctcacagagactgaactgccaacccaagggcatgcacaggactgacctaggccctcagcaagtttgtaacagctgtgtaacttgatcttcatggtgaacccctaaggactggagcagtctgttgcctgtttttggattcctttcccctaactgggctggctgccttgcctaacctcaatagaagaggagcctagtcctactggaacttgatatgccaaagtgtattgatatccatagaagaccttctcttttctgaagagaaagagaggaagggaggatgggggagggtgggcagga

SEQ ID NO: 877 - DNA, 1000 bp, mus musculus
gcttccttcttagcctacagtgttgcactaatggccttatctgctcccagtcaccccaggctctgacctctgaatgcagctggctccatcattctcttaatacctccgagtggggagccagcataagtcttggggtcagaatccacatctgatatgcacaaagggtcatagccgtctttaatctttagcgcactacacagacagtccacatcaagtatctagacatccccaactgcctttgttcctgtcccatagcaaggaaacttgggttcagaaagaagacacatgctttctccaaggattccagcttatgggcaatggtaactagacatctaggcaaattttcctgaatgcaaagtcttacttccttatgagagcatagcagccaaactagaagtcacctgatgtcccccaggactgaggtaagccacacatgcccaaagatttttttctccatatcgagtagccaggaaattcagccatacaatggaaacatttggagaaagccagcctgatggtgaggctggaggggccagcagcactctgtacacacagcagccaatgccagcctggccatctgcaaagcagcttagtatccttgggtactgctcctggcacacacccctttgggagctcttttccatgacacactctccagggatggtctcagaatagcaatgtggtgactagtctacgctgtgtgtatgtgtgcgcgcgcatgctggccacacaggagccacggaaaatatgagaaagagattgtgagacgggtgtggtaggtgtaagcacagccatgcagaagagtccctgaactttggtgcaaagagagagaagctttgttttgtgaagggaagcgattgcagaaagatgccattacagagaaataaggagaaaggaaagaacaaaaaactcagagcggggggagaaagaaacccttcaggtacacagggaaaggaaagtacaatcagattccccccaacctctgctcacgtgcttggag

SEQ ID NO: 878 - DNA, 1000 bp, mus musculus
gtgccttttttttgtttgtttgagaattcagtccactacaccccagcattgtgggccactgggaaataactctgtagagagcctttctctggtattgtcaatctcagagagaaaaagaatggcatttgggttttgttttgtttttaatgagcataagtgtatatacacctgaaattaagagggggagacagggtcaggttctcctatgttttgtagcccagggttgaactgaaaatctcactccgttgcttgactgagcctgtagctggaagcggagctatgagaggaaaagcaagctattgttacagtgtaaataactgtcagcttcacagccatatttagagagccccctcctaatcattaccctctgttctgacatcgagtgtgcagaatactcaaaacacccagagattcaggcctttcagtgaaatagaggcgaaagccacagatatggaaacagagacagagtgaactgttgatacatccctcagaccatgttaaatatacatctctcagcagtcagttctcactttactttcagaatcatattcttgaccccaatctctgcagcaggtcctgctgctctatgaggcaagaaactatatccctccaggaagcctgaaaaagtgacttaatttgatgaagaaataatctcgctgtctcccttcccatcctccctggccaatatcaatcttgaaatagaatactctatcctcatataaatctctcaaatctctctcaaatctgaatagctggggaaggcacattacgtaatctacttgtggacaactgtggctgtcctactaaacaaatacagaacagagaatataacagacgcctatttttatccttcttaaagttatgaaaacttgcaagccccaccttgcatcagaagctgaatttaaaataaacatgttcccaaatggctcagcacaatattccagcaggtagagaccatagcttatttaatcgtaaaggaaaaataaaagcttgaatgaca

SEQ ID NO: 879 - DNA, 1000 bp, mus musculus
tgttttgagttaggatctttttgcattttacattttctttgattgttgtgtagatgtgctaggaagactgccgcctccccaggggatgcccaggggagtggggagagccagagacatctggttgtctccagagatgggtcagagggatcaagttttgtttatgaaatggaagcttatctgcctgcttgtagaagacaagaaagggtcgcatgtgtctagatctgttggtttttgttttatgtgttttgtgtatgtatttagagccatgtgaaaatttagagaagtgctagggtgactggagaagtcctgctgggagctgattgcaaacacagctcttaagggggcaggcagcctttgcttgtaacagaaagttagcttaaaattggtaactcagagttagagtcattctaaacaacatgtggcaggagtgaacccaggaaaacaggtctttaaagatacttcaaaataaggataatcttttggccaggaatctggcagactgcttagattgagaaatgcttgcgtttgggtcaatgcggagctcagcttggagcagcctcagtgaggcttgtgtagcatttcctttgtttcacaaactgtgactagggaagttctgagaacctccccaatccctgccttcagatttcttttagctataagagcacctttacagacgttgttttaaatacagtttaaattctaagtttataaaaggtcaatcaggctgtagaatttatcaaggcattgcgatttgacttgcctactttatataaagttattatagatttaaaagtttgtttttttcttttacatctagataaattgtaatgggtttgaatctagtgagctgtaatcaagaagctaagagtttgactctttcagtgtatattgttttctaggtggaaattattttattagctaatgcatctcaagagaagtttactttaaatccttgctctcacacaagaagtttttaagttctggggagtagctgttgctc

SEQ ID NO: 880 - DNA, 1000 bp, mus musculus
tctcaaaaatatatcctgatcacagtttcccctccttctactctgtccatgtcccacatatctccactacccacttccctagatctactccctctctattctcattctttgtaggcagtcatcaatgcattggggaaagttgtcattttagtgacagcaccagtgtcctttttgactatatgtgcatggatgagaagttaaaatgtaggggatgattaaaggtaagctgtgtgtggtaaattgcatcttttttgaaattctggctctaatcctgtgcccgtgccaacctgatctctgtgtgcagatgacagaattagatccaatgaggtgataaaaacatcagtattagaatataacttccccagagttgcactcaattgcttggttcactgagccatgatggttctgacctgatcctagtatgttgtaggaattttaaatatctcttagccaaattagagaagtggttcatgggatcataatactttcctctctaaacaatcatgtttcttaaactttgaaataaagtagcaacatctattgacctgcagttaccagtcccaaataaaagtgaatcagataagggctgaaatgtgatagatgcaatgctctgtggcttgcctgaaagtgtttagactgatttaattgtctgacattctcctggacatcttcctaccttgtatgtatacttaaggcaccaatggttacttttatgttgatacaggcaacttgttggtcaaagttaatcacaaaatatttacatctctattattccaaattcagacttattacaccagctccaaatacaactccaaatgcaaatggctgtgaccagtgttcagttctgtacaaccttgacaatcatggaggacttagtagagcttagcagttatctgtttgctgttggtcgatgctattgactttagaaaatatctgaaaacagagactgcagggtatttttctctctcaattttcccacaaagtccttcttctttatttc

SEQ ID NO: 881 - DNA, 1000 bp, mus musculus
attagctatggtattgctcccaagatgactctcagggaacaggagagtcactatgcacacaaccctcatagcagttggatcagttttgtcaaaatccttaatcctcaccttcaagaaacataaaccatatcttaggggccagagggtttttgtttttgttttcattttcatatcctcttggttttccttcttcccctcttgtctcactagaagctgccaccagaaccaagataattcacaagttaccttcatctcaagttcaaagccccccccatcatcccaccagcaaacaaaaaacaaaaactaaacaataaaacaaaacaaaacccaacaaacttaaaattaaaaacaaaaataaaaacaaaaaaaaaacacagaatgatcatacacacccatatcccagccaattttatatcagactgtttccatcctaattatgttctcattacttagaatttctggaaccagacaattctttgagataatcaacttaagaagaagactctttttggctcacaaatattagagatttcagcatgtggttggtgaatgaaaataaataaataaacgaaaagaaagggaagtaagtgacatggctgttcttaggtatggtggagggggaactttattgcagaaatgtgagagagcacagccagaaacacacacattagggaaagtcctgacttgtcatgaccccgaatcaagtggagagaggggaagagcaagggagaaagaggaaccaagcagccaggaggccaaaggtacaaaaggaaagccttaggtaaccaaattgtctggattatataggaaagagcagcccaagcttctgggctgaaaaatttagtgtagagagcagggaaggacctgcaatgggtagggactggaggatgctgggaaaacctggaggccaggttctctttgatatgttaaataagcccctgagccacttttccagagtttgaaacttatgctgtccctatagcttctgctcctctggaga

SEQ ID NO: 882 - DNA, 1200 bp, mus musculus
tagtactccattgtgtaaatgtaccatattttctgtatccattcctctgttgagggacaactgggttctattcagcttctggctattatgaataatgctgctatgaacatagtagagcaggtgtcctcaagaagaaggaagaccaaagtgtggatacttcgttccttcttagaatggggaatgtacaataaatatttttttggaatgatgaacataaatggaacattttcttttgatacctaaatagaggaatcaaaatacccatgtaggagttacatagacaaagtttggagctgagatggaaggatggaccatacagagactgccccatccaggaatccatcccatatacaaccacccaacccagacactattgcatatgccagcaagattttgctgacaggaccctgatatagctatctcttgtgaggctatgccagttcctggcaaatacagaagtggatgctcacagtcatctattggatggaacattaggcgaagtgcccctagtgaaggagatagagaaagtacccaagaagctgaaagggtctgcaaccccataggaggaacaacaatatgaactaaccaataccctcagagttctgtctctagttgcatatgaagcagaggatattctagtaggcaatcagtgggaggagaggcccttggtcttgtgaagattatatgccccagaataggggaatgccagggccaggaatcaggagtaggtgggttggggaacagggcagggggagggtataggggacttttgggatagcatttgaaaagtaaatgaagaaaatatataaaaaaggagtcttttatttctacagaatgaagttggacaggagcagtgtaacccagttcacctcattcatgaagtctaggaactctaggaaaagtggtaagagaggtaatttaaagagcatgtacttagacttctctctgtgaccagggtttgctcaatagcctaaagcacacagaaattccacctgaaagaagaatataggcttaatgcagttattcctcagtagaatgtgaactgctgtctcccaaaggtgaaaaatgaattggtcccatctgaatgttatttctctagtatctctttgaatctctaaatattacaaacattcaagtcctctcctcctttacattttattatttttttaagttcataaaatgctgtttaaatggatagaa

SEQ ID NO: 883 - DNA, 1400 bp, mus musculus
gttgtgcaaacattaagaaagataggaagaaaggaagacaggaaggaaggaaggaaagaaggaaggaaggaaggaaagaaggaaggaaggaaggaaagaaggaaggaaggaaggaaggaaggaaggaaggaaggaaggaaggaaggaaggaaggaaggaaggaagaaggagcatataaatgaatatatgtttcataagctaaactgggtcaatacattagttgctcagcaaatgtttacctaggaaatgaatgaatatatttcaaataatagcaagtgatagaaatgaataatatattttccctgttcttagatggctgaaataaaatgtagccttaaaaaaatctaagcatcacagttgattgagtgaatgagacaatatttataaactagttctagatgttgaaacagagttgatgatagtctttcaaatagaaatcaaaataataaattattaaacatacaaggtaaaagagatgagaatgaaatgtgctcaaatcatgatggaagtttttgtattatatttgtgaggagcaggtacatccgcctccccaagatggcgcccgggacagctgccaggtcttatggcctgcgcctgacttcctcattatctcagacttagtcacatcccagctgcctgcactgtgcagatgccatgcctcatcagctcgcctgaggtgtcttcacttgctgtgaacctatggactgctgttacttgactggggtgattgggaggagtcagtagggtatttaaggggcgccccagggttgtttgagggattcctgttcctgcattgcaatgctaagtgttcctgaataaacctgcttgaagaaggacaaagtggtgttgcatctttcctgctggtggggtggatgcgacatatattcaagaaaagctgtatcattgaaccacacatcacacataccgtgattttcttgaaaagtaatcacgaacttgaaatctatttgtccaagtcttaaatttcaatatttgtatgtaaatctcagaattcttgtcaaattaacccaagaaaaagacaactattatttttaatcatttggataattatgtaaaatgcttttaatgatatttatagttatctgttaagttagcacttcacactcatacaatatatgaaattttacaaatcaataatccagatactgccccacatggggatccatcccataaacaaccaccaaacccagacacgattgcatttgaaatgtaaatgaagacaatatataataaaaattttgaaaaaattccctcaagagtgaaatatgtacttttatacaggcaagaatttaaaacatgagtgaatattaattagaggatctactatccagagcaaatcatttacattaaggtatttcttgaacagggcatgtggctgagtt

SEQ ID NO: 884 - DNA, 1000 bp, mus musculus
attattattaatcattccattcatttacatctcaaatgatatcctccaccaaataaccatcccacatctgccctcttcttccactttgcctgtatgagagtgttcccaagcctcgaacaattttctgcaccaacattccaccatccccttatggtggagcttcaaacctccccagaaccaagggcttcccctcatgttgctgtcaagcaagaccattctatgctacatatgtatttagagccatggatccctccaggtacattccttggttggtggtctagactttagaactgggtggtcaggccagcttatgttgttcttccagtggagttgcaaccctgctctgctcttccagtccttctgccagctgtcccaccaggttccctgagctcagtcatatggttggctcaaatcatccacatctgcactggtcagttgatggccggttttcccaaggagccgccacactaggttcctgtcagcaaatgactcttgacacggcaacagtgttgggtttggggtctgcagacatgatggttcccctggttgacccttccttcagtatttgttccattattttgtccctgttcttcctttggacaggaatatttctgagttaaaagctttgagatgggtagatggccctattccttgaacaagggccataagtttctactggaggtgatctccacaagttctatctcccccttttctgcacaatttggctaaagtcattccaggtgggtcttgggagcctcatgtttgcctggggtctgagacaatcctaaaaccactttggaaatcagtctggtggattctgagaaaattgaaagtagttctacttgacgatccagctaaatgactcctgggcatatacccaaaagatgctccaatatataacaagaacacatgctccactctgttcatagcagccttatttataatagctagaagctggaaacaacccagatgtccttcaagagaaggattggtatagaaa

SEQ ID NO: 885 - DNA, 1000 bp, mus musculus
ccctcctccttagcttcttccagcctttccctaatttaatcacaggggtctctgacttcagaccattggttgagtgcaagtatctgcttctgtctcagccagctgcttgttggacctcttggggagcagccatattaggcttctgtctgtaagttcatcatagaatcagttatagtatcaggccttggagcctccccttgagatcagtcccaatttgggctggtcactggacctcctttccctcagtctccatttggttgatgcagttcttttagacaggaacaattctgggtcagagttctataatcttcatgtctgaaagttgtgctttaggatttataatactttgtgcaatttatgaatatgtgcaaacacagccaatgaccatcattcttcagtctattgatcactttttacaaaaaatgagattatctacttttataatgttaacaatatcattaatacaatgtctatgttcttactcttagccctgatgtttatattgttatctttaatttttgaacatttctttgtacatgctcatgtatcattttaaaactaatatttattaagcaaaataagttgtcttacttctaaacaaatgactctcagtcacatcattattcacagatataaattataaagttctaattcatgaaaaaaataaatttctcatctttccttaagtaccacatttaaatacttaacctactgtctctcaggatatctattttattaattatctactctcaaattgggggttttacccctcctttgattattcagttcccagataaaaggcacacaatctttatatttataagcctttataacaatagggctgggcagaatcgaccctctaaactattgtaatttatttcccataaataaccccgagttataacttgccatgttcaatctgggctgctcttaacttcagttggtcagagatcatggccatgctttcataattcacctacctaatggtatctccactctt

SEQ ID NO: 886 - DNA, 1200 bp, mus musculus
ttgctgcaaaataaatagctggtgcaatataaaatgaaacgaaaacctaatgtttattttctaatgtttattctagcattttcttagaaaacacatctaatcaagtctaattttatggaatctatgtatcaccatctgcttttctgctgctttgctattacattctaaaaatgtcgtttaaactattaaattctttcattttactgtgtgttgtggggcattgggctatgcacagacaggctggtcttcagttgaactgaggtctgaaccccaaagggtgattattcaccttcatggcactgtagtcattctctcatgctcctggaactctggctcctgtctaagttactgtcacccacaggtcccacaagaaaagcatggctagaagtcacccaagcttctgaccttcaggctaaactcctccccagttacctagcaacaaggagataagacagcatactttaaaaagggctgttcagcccctgtttgctctcttacatcactctcttacttcttactctcaccctctctcctctttcttttttcttttatcctctctcctcttttatctcctctcctctatcttactctctttctctccagcctcccccccccatctcttttctaccttttctctttacccctgcatttctacaataaagctataaaaccatagtgagtctctgctcatcaagatcccctgcactcactctccctggagatgggaacctctcttgcctcatcactcacttccataaccccctgtagctttagcaaagtagctccagtactcccaggtaggaatgccccttgccttcccctgaagagtgggtcagagggttagatgcccacccgaagatgagtggaaggtagatagcagccctcccaggcctgactgacaagtgcataggtggaactctggggggggggatctttcacttctccattttccccagcccctccccctttttagttcccaacagtgtgtaactcttcccaactcttttattctttcttgtttatttcagttctctttctaatcatagaccactagactgtgagcttataataggcattatttcagaaataattttgtaatagataaatggtttaatgtaaaatttctatgcttctaaaaatgcttcatgttagtttatgaagcaaattctgggggtaaaaaaaaaaaagacaaactataag

SEQ ID NO: 887 - DNA, 1000 bp, mus musculus
tagagaaacccaaacctagtgacacactatagaaattgactctttactgataagacaaaggaaagtaaatatattctaggctacactaacatatgagagatttctcaagataatgtatttttttaaaagtacagttttgaatgaagaataaaatgaattataggtaataaggcaatgatattatgtttccagttttaacaatgatataattataaaaaatgattacattaggcatgccacaagaaagatatatgaatatttcttttattttgaacaatatatttgtaactctagagtgattttcatgtaaatagttaaaagtcaggtaaagtatgttaggattcagtaacataattgtgactttgatgtctatgaaatgaatattgatttttcccttcagtgactctctaagatgggacatctcaggagtgcactggctgtagaagcaacagagcttctgggacgggttcctatgtgcctacatatgcagctagttggtggaccttatcctcagtcatctgtgcactttccctgccataggagactttgcctccagggaggactctgattctggactcaggggaaattgccattttctctccagtgattttctaaggcagctccaatcagcaatgcacagggcataacagaacatctgggacatggttctatgggtacatctgcagccaggaggtaggggagttcttcactcctatgggcactggtcttgacaggagagagcttgtctcacagaagtgctgacatagcatcacagattctcaggaggaagaagctccagccagagaaagcaagagcatataaacaccagagattaccagatggcaaaaggcaacacaagaatcttaccaacagaaaccaagactacttggcatcatcagaacccagtacccccaccacaataaatcctggataccccaacacaccagaaaagcaagattcagatttaaaatcatatctcatgatgctggtagaagatttt

SEQ ID NO: 888 - DNA, 1000 bp, mus musculus
gatttattctttattggatagtttatttacatttcaaatgttatgtcttttctgggtttcccccccgaaactcccgattccatgtccccttctcctgcttctatgacagtgctcccacacctacccacccactcctggcaccccgcactggcatccccctacattgggacatcaaaccttcacagaaccaagggcccctcctccaattgatgcataacaaggccatcctctgctacaaaagtggctggagccacgggtccctccatgtgtactccttggttggtggtttagcctctgggaaatctggagtgtctggttggttgatattgttcctgtggggttgcaaacccatttagatctttcagtcctttgtcctttggggtccccatgctcagtacagtggttggctgtgagaatacacctctatatttgttagactctggcaggagacagctctatcctgtctgcaagcactttttggcatccacaatagtgtctgggtttggtgtctgtacatgggatagatccccaggtggggcagtctctggatgtccttttcttcagtctctgctccacactttgtctctatatttcctcccatgaatattttgttccaccttctaagaaggactgaaacatccacatttttgtcttccttcttgagcttcatgtggtctgagaattgtgtcttgggtattctgagctttggggctaatatccactcatcagtcattccatatcatgtgcgctcttttgttactgggttacctcactcaggatgatatttttacttccatccatttgcctaagaatttcatgaagtcgttgttttttaatagccgaatagtactccattgtgcaaatatataacattttttgtatgcattgctttgttgagggacatcagctttccagcttctggctattataaataaggttggtatgaatataatggagcatgtttctttgttatatcttttgtgtatatgcccagaggtgg

SEQ ID NO: 889 - DNA, 1000 bp, mus musculus
cctgtaattctttaaaggcttctatctgttcagcagtgttctcctgtatttatttaagtgagttattaatgcccttcttaaaatcttccaccatcatgagatatggttttaaatctgaatctcacttttcagttgtgttggggtatccaggactcgctgtcgtgggcataatgagttctgatgatgcccagtgttcttggtttctgttagtaagatgctgacatttgcctttcatcatctggtaatctctggtgttaatgttctagcagtctctgactggagcttgatcctcctgtgattctgttagcctctgtctgcactcctgggagtcaaactctcacctgagtctcattggtcagagcactctctgcagcaaactctcctcttgcagggcaggtgtccagaagtctggagttctgatccacgtcttgagtcctaatgtcagagccctccctgtaagctgactcttctctggcaaagaaggtgcccaggggtctgggtctggctgaggagagctaccttcttgctgaggatgaaggcctgaaggaaccctttccaagaagctctgttgcttctgtagtccacatgatctccagtgattatgaggtcctgggtcttgcagagtggagagtcctctggggccctagatgccctcaccccggttcaaacagaagatggagggctggccctgacaggaagggatcccagcccctggttgggcagggttctgttgtccctgttcctgctggcacaagtccctccttgatctttagagctgatattgcattccagtcaccagtgatcccgaggtgatcccaaggtcctgtgttgtggagagtcttctggggttcttggcaggctttgccagttttaggtggaagatccaatttgtacattcattgtatatttagatataggtttttatgtaaattatattttcattgttccccttttcagtccacttttgaactcatctcatgttcccctgaatatattctca

SEQ ID NO: 890 - DNA, 1000 bp, mus musculus
tcacatcattaacccctgcttggtctgccctccaactgtttctcatcccagtcctcctccttcctctccaagaggatgtcctcaccccctctcccacatcccatctgacttccccactccctgggggatcaagcccctctctagggttaggtacttcttctctcactgaggccacaccaggcagtcctctgctgaatgtgtgttgggacctcttacctgttagtgtatgctgcctggtaggtggctcagtgtctgagagatctcaagggtccaggttacttgatattactagtgttcttgtggacttctgccacagcttcttccaacctttctctaattcaacgacaggagtcactggcttctgcttattgcattaagtatctgcatctgactcttttagatgttagttgggtctctcagaggacagccatcctaggctcctgtctataagcacaccatatcatcagtaatactgtaaggctttggagcttcccattgtgatggatcccaatatgagcctatcactagactatgttttgctcaccctcttctccattttagcacctgcagttcttttagacaggaataattctgagtcagaatttttgagtgtgcaattgcaacccattttttccacttagtgcaactgatctgggaagagctctattgtttttggggtcctccacataaggactaagctgctcatctgctgtatgtatgcagggagcctaggcccaatctgtgctcacagttttgttggtaaatcagagcctccaagggaccagtttttctttcatatatatatatatatatatatatatatatatatatatatatatatatatatggtattttcttcatttatatttcaagtgctatcccaaaagcccccatactctcccccacatctctcctatccaccctctcccacttcttggccctagcgtccccttgtcccggagcaaataaagtttgcaataccaaggggcctctcttccca

SEQ ID NO: 891 - DNA, 1000 bp, mus musculus
ctaggtagaacatcaagttctatactgagtaagtaaagcaagagtgggggatcttgtcttgttcatgattttaatggaattgctttaagtttttatccatttaattaatgttggctatttattgtagccttccacaagcctgaagcaggctgagccaaaccttgactttgttgccactaagcagattacttagggtggagcctgcctccctggatcactctgttgttctgccactgcagctgctacctgctgggagttggcctagctgtttcagagcctacacgtggtcacctgcagctgggctccaaggatgatttggcgggaatgggctttcccctctcctttataaagcgtgtctgccattaaaaatttgaaccttgaatagactagttgtcttggttccattatttctcaacctgcctaggctccttcttttctttcaggtccaagatgccttccaggctcgaacccagacgagccgctagagggcccccaacaatttatctactgtgtattaactgcatttattgtttttatgtatttaccttgtatccctgatctgaagacatttataataaacaggtattggatctttttcaaaggctatttcagcatctattaaaactgtcattaataagattttctttcagtttgtttatatggtatattatattgaaagacccacaacgtgaggactctcccacattctgattcaggagaggcgacaccccaaattcacccacaagaaacgggtcttgctgcaaattgcaagaggatttttattcaagagcgctctcgggcccatggtcatacaccacgcaggggtagaggaccgtggcgccccgagtagctgagtaagggggtatttaaaggaaaaaaaccacaactcaaggaggtgggaagggtgttgttggaaaataccaaaaataccagttaagagtcacaaggaagtacaaagtcacaagtgtcaggtgtctcaagactaagagcccctaacaat

SEQ ID NO: 892 - DNA, 1000 bp, mus musculus
ctcttgcgaactttctacctggttactacagccaacatatatatcaaggtgatggggaatgatatagatcatcacatatagagaaaaaataagtgtacaatcttattgtctgtgcaaaaacagatgtctataataactgtcaagagacaagttagaagaatgcaagtaaatccattctaatctccttgtacaaaactcaagtccaaggggatcaagggcctccccataaaaccagatgcactgaaattaatagaagagaaagtggggaagagctttgaacacatgagcacaggtggaaattttctgaagagaacaccaatggcttatgctctaagatcaagaaatgacaaatgggacctcataaaattgcaaaacttgaaagcaggatgggggagccatcttgggtcccaggtccctcagaaaccaatctgctcaggtgagagtgcagactgcagaaaaaaaacaaagcttctgggacaggaagaagtgacacagcttctgaaacagatcctgtttcgggctccagatatctgggcaccttccctgccagagaagatgagggagccatcttgggcccacatccctcagagacctgtctgtgcaagtgagcacacagactgcagaggcaacacatcttctgggacaggccctgtattgggccttcatcttcagccaggaggcaggactgaacacttgacctctgtgcaccttccctgcaagaggagagcttgccaacagagagtactctgatcactgagatgcaatagagagctgaactccaaggactgctgacagaggctaacagcatcacaggagaaacaagctcacaccagagacaactataactactaacgtcagagactacctgatggtgaaaggcaaacgtaagaatcttactaacagaaaccaagaccactcaccatcatcagaatccagcactcccacttcacccagtcttgaaaacaccaacacaaacaaaaagcaagacttggatttaaaa

SEQ ID NO: 893 - DNA, 1200 bp, mus musculus
aaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatgggatagaattgaagacccagaaatgaacccacacacctatggtgacttgatcttcgactcttacacgcattcacgcgacatgccaggaagaacgcaacaaaccggaatattctgcggcaaaagctttattgcttacatctttaggagccagagagcaagagagcaagagtgcaagagagagcaagaaagcaagaaaaagaacaagagcaagctaaagaacaagaacaagaaagcaagagagcaaaagtgcaagagagcaagcaagaacaagagagagaaaaagaatggcaaaaccccgtcccttttaaggagaattatcctccgcctaggacgtattactccctgattggctgcagcccatcggcccagttgtcatcacgggaaaggcagaacacatggcaggaaaactgcccctgcacgtgtgcagattatgtttaccacttagaacacagctgtcagcgccatcttgtaatggcaaatgtgagggcggcttcctacattcgacaagggagctaaaaccatccagtggaagaaagacagcattttcaacaattggtgctggcacaactggttgttatcgtgtagaagaatgggaatcgatccatacttatctccttgtactaaggtcaaatctaagtggatcaaggaacttcacataaaaccagagacactgaaacttaaagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcagaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcac

SEQ ID NO: 894 - DNA, 1000 bp, mus musculus
cctctgagtttcagtgctcagagcactctctgctggcaagctcttttacagggaaggtgcgcagatatcttgtgtttggacctcctcctggcggaagaagaaggcccaaaacaggacctttctcagaagctgtgttgctttggcagttcccagaagctgtcagcttctgtggtgcagactctcacctgtgcagactaaattcctattttccgcggagtcccggaaccaagatggcgaccgctgttgctgaggctgaggcctcctccagagccaggtggacacctgtcctctggtccggatggtggccgggtgtctgtgtcccgcaaggggtgctgcctcagcggctctgtgcttccgcctttcccagaagctgtccggttctctggagcaccctctcacctgttcagactaattcctaaggtccgtggagtcccggaaccaagatggtgaccgctgctgctgaggctgaggctgcctcctgagccaggcagacacctgtcctctcatgttacatatgattttaaatttaaaaaaaaatattctaaagtaagctctcatgaaagagatctgcaaccctgtaggtgcaacattatgaactaaccagtatcccggagctcttgactcttgctgcatatgtatcaaaagatagcctagtcggccatcactggaaagagaggcccattggacacacaaactttatatgcccaagtacaggggaatgccagggccaaaaaatgggaatgggtgggtagggaagtggggggggagggtatgggagacttttgggatagcattataaatgtaattgaggaaaatatgtaatattaaaaaatattaaaaaaaagaactgtaacatatttaaagagaaagagcaaaagacatttacccattggtctgaatgtggtacatgtcaagtcattaaaccaaacactatgctgcattctcatgagcactggattctctgactggacttgcaccacacttcatttatcttctgcag

SEQ ID NO: 895 - DNA, 1000 bp, mus musculus
ttatgcataccttgctaaatacttttgttagtggtttctggccaaatgcacgtttatcaaatatctttttctttaaataacattttatgtttcatatttgatgattagaggatggcttacaatatctgtatagttgggactgttatctttcttcatctccaaagaagagaaaagtgtggcattggaagtatgctcatgagcatatctgcctttttgttcaaatgttatcaccctttccagttaacccctccaccacctcccccatcccttctacttttttgagggtcctcccccacccacacaccccatccaacctcagcacccaagcattcccctaggctgggtcattgagcctccacagaaccaaggggctccttcgcattgataccggataacgtctgctacatatgcagctggagccatgggtccttccatatgtactatttagtgggtggcttagtcccactggactttggggtggggtggagtctggttggttcatattgttgttcttcctgtggggttgctaacctcctcagctccttcagtccttcccctaactcctccattgggatccccttaattagtctgatagttggctatgtgcgtccacatttgtattggtcaggtgctggaaaagcctctcagggaacagccataccagacctgtcactaagagcttcttggcattaatgatagcatttgggtttggtgtctgcagatggtatggattccctaagtggggcagtctctggatgtcctttccttcagtctctgctccactcttagtccctgcatttccttttgtcaggaacaattctggattaatatttttgaggtaggtgggtggtcccatccgtcaaccagggggcatgcctatcgactggatattgtctttgctatgaccttcaatcccattgataattccaataaattccataataatttataactttaataagcagtactttttattgttctatattattttaaattttgt

SEQ ID NO: 896 - DNA, 1400 bp, mus musculus
gtgagaaggtatgaagataactccatttagttcaaaattttgttgcattcattgtgtctccatttagtttcaattttgatgacatatccattggtggtgagagtgatgtgttaaagtatcccatcattattgtatggggttctatgtgtgttttcagctttagtaaagtttcttttataaacatagctgtgcttgcaattggggcatagatgttcagaattgagaattcatcttggtgggtttttcctttgatgagtatgaaatgcccttcttcatctcttttaattacttttggttaaaagtctaatttatacaatatttgaattgttactttgtagggcagtgagctacgcacagacaacctggtttccactccagcataggtcttgaatccggggagacctatgtgggacaaaagatgttcaatcttgtctcctggacccctggcttgttactgcccccacagcccccgcaggagaggtaagtaactctcagtcacacagacaatgtctcaagctcctggcattctggctagactccacccccacagttacctgactatagccaggtatgctcctccccacaattacctgatagcccagcccactataaaagggactgctcggccccttctcgctctctttaagctctcaccctttcttactcttctctctagccctccttctctctctctctcctttccccccgtctatccacgtggccatggctggcctctctctaccttctctctttcttcctgcctttctacaataaagctctaagaccataggctgtctctgctcatcaacacccactgtgcttgaatgatgggataggctttcattcccctaatgagctgcatctaacctgccactggaaggccttcctgtgctccagccacgactagaccaaggactctcgcccatgtgagaaccacccagtgtcctctccccatgacctctcctccctttggcgctggggctaattgaaccacccctgggcccccattctgttctcagctcttccgaggtgtccagtgtgagatgcgaagaataagaacctggtaaggatggccccttgtcaaccccccaataagctgggattctgtggcttcacacagccagacatgcacctggaaccatgtgaaaagcccactccttttattcccctggtgccttctgcccaacactactccagcttgtttcttgcttctttttgcttgtaaaacgtttaaccagatctttactctgagatagtgtctacctttgctgcttaggtgtgtctcttgtatgcagcagaatgatggatcctgttaaatatgcattttgttaacctgtatcttttcattggtgatatgattctagcgattctgagagaaattagtgaccaatgattgtgag

SEQ ID NO: 897 - DNA, 1000 bp, mus musculus
tgtaatctttcaaaaacagttcatcagcaagttactaaacatatgcgtatgtgagcctaagaaggacattttccctcatcacaatgagggaaggctatggcttctgcccatcacatggtccttctggtcattcctgcttttgttgcaagaacttctctgagctatgaaatcacaaggaggaaactcattggagactagaacatatgggcaagctctaagaaaaagtgagtagaaaacagtctagcaaattcaagttttataatctgacagttattatttttcttgatgttttggggtttgtaagaatctgtgcttggagctgggcatggtgatgcacacctttaatcccagccctcgggaggcagaggaaggctgatttctgagttccaggccagtctggtctatagagtgagttccaggagagccaaggctacacagagaaaccctgcctagaaaaacgaaagaaccccccccccaaaaaaaaaaaatctgtgcttgggtctgtatatatttgtgttcactacagaaaaatctatagattctttcttatctcactctgtactataatgattttttaaaaaattattattaggtattttcttcatttacatttctagtgctatcccaaaagtcccccataccctcccccactccccttcccacccactcccacttcttggccctggggttcccctgtactgaggcatataaagtttgtacaaccaatgagcctctatttccactgatggccgactaggccatcttctgatacatatgcagctagagacatgagctccagggggtactggttagttcatattgttgttccacctatatggttgcagatccctttatctccttgggtactttctctaggtcctccattgggggccctgtgatccgtccaattgctgactgtgggcatccacttctgtgtttgctaggccccgggcatagtctcacaagccacagctatatctgggtcctttcagcaaaatct

SEQ ID NO: 898 - DNA, 1000 bp, mus musculus
ttacagtgtactcatataaataagagatccatgaaggagtcacagcctctatactgcacaccaggtgacacttgtatgcacgtgtgaagtgaccctccacatggccacataaaaatatcaaatgaaagatactgagttacattgctgctcattttgactggatttttgtttgagttcctatcccttatgttgcaaatagcagaggaacctttcagcttaccagatttctctcatatgtttctagtaccattcaagagaatgcaggatgaagcaaactgctcatgtagactcagaggaatcctgagggtggatgatgcaaggactttccctaccttgaatatccaggccacatcattcaccgagtgcttttttatatccacctcttccccagagtccaatttcttctttagtgttttgcaagatgtctcattgggaatgatcatgaatgtgcccttggttgtaggacttttctcgctgaggattgagaggatgtcctgagaggaagaaagggaaacacctgtcactcgacatgctccacaaagcactttttgcttgtgagaaccagactaattgtgtgcacaggtgcagtgcaaggctggcatggacaaggaggacttcgaactgcttttgtggatcaatcgtttcatgtacacatcccactcgagtgttaaacctgaaagatcgggcaacacttatttttgaacagattttccttaggagagccagaaatgaaccctatgagacccaccgggattgctgtgggccattgccttcttgacatacagaactcaattctttaccaaagagtgtctgtctgttaacagtctggacagtatatacttgctccttgcggggcacagagcccctgtgaaaacatgctgtccaagacggactttttttcttgtgaggtcttttctttccatctaaggaggagatgaggacattactggaatagtgtaatttatatggctctttaattaaacaaatttcaattgcataa

SEQ ID NO: 899 - DNA, 1200 bp, mus musculus
tcaataaattaacttttacaaagattattttatttttcctacaagtatgcttttcttttttttcttttattattattattctttagtcttttttttttatagtccagtcactatccccctccctgcctgccctcctactgttcctcatccattcctcctttcttgtcatcaagaggataccccccaccactctgaccccaccaatctctcctctccctagggccttgtctgttgagggttagctgcatcttctctcacccaggccagaccaggcagtcctctgatatatatgcaccagagacctcatatcacctggtgtatactgtctggttggtggctcaatgtctgaaagatcttgggggttcaggttgagactgctggtcctcctatggtgttgcctacctcctcagcttcttctagcctttccctcattcaactacagggcgtccctggcttctgtctgtttgttggttataaatatctacatctgactcatttggctgctggttgggtctctcagatagcagccatgctaggctcctctgtaagcacaccacagcatcattaatagtgttaggccttggagcctccccttgagcttttcttttcttcttttatttttattagatattacatttcaaatgttatcctcttttctagtttcctcctcgaaaatcccctatctcctcctccctgctcctgctccccaacctacccgttcctccttcctggccctgacattatcttatactggggcatagcaccttcacaagaccaagggcctctcttcccattgatgatcgactaggccattctctgctacatatgcagctagagacatgatacagctgtctcctgagaggctctgccagtgcctggcaaatacaaaagtggatgctcatggtcatccattggacagaacacagggtccccaataaaggagctagagaaagtacccaaagagctgaaagggtttgcaggcccataggaggaacaacaatatgaattaccccagagctccctgagactaaaccaccaatcaaagaaaacacatggtgggaccccttgtgcttttctatgtggtggtatgtatatgtgagggcagggccaatgtatctgttatttcaggaggttgtgaaccaccctggtagtatgttgggaacattgctctggtagtctacaggaccagtacattctctt

SEQ ID NO: 900 - DNA, 1000 bp, mus musculus
attacctgggaaagtgactatgtgtattacaggagaatagagaaaataaggacagatttatccaatgaggccaagaaaaccaagcaaaactgcagtgattctcaatgtggagtaaaagaatgaaatgtgtaccagtggggcatagggaaccagaggtagccactagaaagtctcagatgccaaggaagcaagagattcccaggacccaaataggatgacattagctgaaatccggtagttaggcatgacctcccgtgtagactatcctcagttagaataaaattacatctcaaaaatattaacccagaattgtcccagtctaaagtaagttcagggacagagtagagcagagactgaagaaaaggccattgagaagccccacctagtgatccatcccatctgtaaataccaaacccagacatgcttgctaatgctaagaagtgcttgttgacaggagtcttttctctgagaggctctgccagaaactgacaaatacaaatgtggatgctggcagcctaccatcagaatcagcgcagggacaccaaaggaggagttagggaagagactgaaggatctgaatgggattacaatcccataggaaaaacaacattttcaaccaaccagacccctcagagctcccggagactaaagcaccaatcaaagaatacacatggagggacttatggcttcagccgcatatgtagcagaggattgccttatctggcatcaatgggtggggagacccttggtcttgtggaggttcgatgtcccagcacaggggaatgtaagggtagtgaggcagagtgggtgggggagcacccacatagaggcgggggagggtgggtgggatgggaggttgtggagctgcaactgggaaggggataacacttgaaatgtaaataaataaaataaccaataaaaaaggaaaaaaggaaagtttcctaaaacactggaaaaaaaaaaaaagaaagaaagaaaaattgaatgaactcctagaaaa

SEQ ID NO: 901 - DNA, 1400 bp, mus musculus
tagaagtcattttcttttcatcaagtgatttcctctttcttttatctctgtgcccagactgagttggaaggattaattcccagtagatgttctatttctatgcatatttattcagcatttgacttttccctccagagtatcaaatttgttttgcatacagttcagtcattgatttttcctcttgccacagctcactcagatctattctaagcaagcatatttgaaggcagttttggtttctttctttcttcaaagctgtggtaatggaggttacttttcactaaccacatttagtcatcatcttctttatatcacatcgaaagatctaaaattctcccttgggtctaaaagtcgttctagattttacttctatccattagtcaatctaatccacccaaacacagcatcatgaaatatattattcttaaatttaaagatgcaaactttatattgattatacacatgtataaatattcacaagttagttttcaaaggaagattaaaaatttatttacttaaactattcatgttggtgtaagcaagtgtggtggtttgaatatgcttagctcagagagtagcgctattaggaggtatggtcttctgggagtaggtgtggccttgccgatataagtgtgacactgtcagcatgggctttaagaccttcctcctgaccatgtgagagccagtcctcttctagtggtcttcaagtaaagatgtagaactctcatctcctccttgtaccatgcctgcctagatgctgccatgctactgccttgatggtactagactgaacccctggctctgtaagccagtcccagttaaatgttgttctaagaagagttgccttgatcatggtgtctgttcacaatagtaaaagcctaactaagatagcaggtgagagaaaaatcaaatgcttttgaaataaacactcagaaatcttgatttattttttgacagaaaagcactagtttatactttccagacatttatttttaaaagaaagtatttgctaactctgaacaatgtacatattcatgaaagtgaactggccttagatctctggacaaatgagagatttatgttgagaaattcaagaaaaagtaatcttgataaatatgtgacatgaattgcagatcaaagaaatcactgaaaatatgatgaaaattaattattttaagtatacatagaaaaagattatctttaaaaattagaagtacaaatttagttctggctcagttgtgagtatttcacagctaagaaatttcaagaatacagctatttttgaaaagtgcatttgcacatttttagacagggccattacaatttaaatgacatcctacaaattgaagaaagaaataatttcttggtctgcctgattgtgaggtttgtacatgaaacat

SEQ ID NO: 902 - DNA, 1200 bp, mus musculus
aaatataaatgatgaatgatggagctcattgcaaatgtggccagtcattgctatcagcaggatttttccccatctttaaaaaaaaatttttttatttgtttacattttaaatgatatctcccttccaggttactattccacaaaaatcccatcccatctcccctatacaccctcccctttgcctctatgagggtactcctccacttacctatttctacctcactgacctagaatcctcttaagctggggcatcaagactccacagttacaagggcttcacttccctttaatgtcagataagggtatcctctgcaacatatgtatctggagccatgcatcctttcatgtatactattggttagtggttaagatcctgggagctctgggtggtccagttagctgatgttgttcttcctatagggttgcaatcccattcggctcctccaggtcttcctccatctcttccattgaggttcagggctcaatcatatggttggatgtgagtacctgcatctgtattgttcaggtgctggtagaacctctcagagaacagccatacaaggctcctgtcagcaagcacttcttggcatcagcaatagtgtctgggtttggtggatacagacgggatgaatctctaggtagggtggtttctggatggcctttccttcagtctctgtcctactttttatctctgtcttccctctagacaggaacatttctggtttaacaatttctgcagaattttaaaatacgaattcttccaaagaaagtcataacagtggctgctaagtgaagatgcatctggaggtgtgaatagtattctgaagcatccactatagtcccagtcttgatgaaaaccattagctattacaccccaggaaacacatgtttttgcactgatgataaccattattttttacaaataactctaaaaaggtattcctatgatcaaagcattggctcacttaataatacttcatgatccaatgtgttactgaacgcattgttaactctgaaacttgttgggaagcaagagacatgtcagtgaatccagaaaagaatgacacacacaagactacatatggcctcagcaatcacatttgcagaaatgtagccccaaactcaagaacatcaattattctctgtgagaaaacatcctatccttcaacattatttcctttggtaggctttataataaat

SEQ ID NO: 903 - DNA, 1000 bp, mus musculus
atgacatatagaaaatgtgcaccctctctttcaaaataactacctaaagtatccccactattcaactttgcttttgctaactccttagattaccaatgtataggcagccgatgcctaaaagatggcgccggtttccagtacactgtggccataaacaaccttactgtgcctgagatagtcactacttggcgccagcccctcccgatcgagtgaatgctaatgaattgttcacaggccgaccaatcccaggaggacacatagccctccccagtgctgggttgtatataaggagtcctccctgggtgcccaaggtccccgtagcagcattgagatgttcctgcaataaaggctgttgagaagaatccgaccctgttgagtcttcctgaggtgggcgcgacatggtccactgtcttctttgtttcttttaaacaacagcagcagcaaactgtgaatgaacgttctatttctaataatcagaatatacaatgaggtgaccctctgatattttccctgttgaccataaaaatattagagttgtggaacttaccttaatttatgtcaatccatctacacagactatcattgtttgcacacaaaaatgcattcatacacaaattattctttcctaaatgaatagtacattttggggggggaatttaaaatttctattttgacttttaaattctatgacacttatgtttattatgatgagtgtttataacaaatcacaaatacccatatgattccacagatattgttataggattaatacatttaagccaacatttgctgtggttataactatgtggatgagccattgataaaaaaaacactctaaccttacatacacacacacacacacacacacacacacacacacacacacacacacacaaacatcccctatcctctttcccctcccccggctccctaacccacccactccagcttcctggcctaggttttcccctataccggggcatagaatctttacaggatc

SEQ ID NO: 904 - DNA, 1200 bp, mus musculus
gccatttcatgttttccaaccatttgcagataatagagatctggtggtggaccaactaattcagagcactgggtagaggattgggtagtagctgactgaactcctcagccctctggatcttcctcatctgcaacaccatgttgaactgtctagcattgctcatgctaggcaaccaagtgtccataagcagtaggcaagttaagccctcttgctctcactccctcagggctggctcaccctcacccatagctccagagtcagctccactgtgctgcccagtctaggttcatggctcataattctaagagctgcagcatgctaggggctgggcctgctcttctgttttcacaactttgggtctggcacacctgtgccttaccgttaagttccagctccattgtattatcaagcagaggctcagggcatgctctcccaagtgctgcacccaaggagtcggctcctggtctaacaacctcagggtcagttctccctgctactggaagtagtgaggaattaagacatatcaaccccacacctacaccagtgaagtgatggtccagttttgctcagcccatggatgtccatgtgacctcaggcagctgccctaactaggaacatctcatgttctgtaatggtaatataagccattgaaatccacagcaaccccggccactgtgtctttggttggagacatgggcctaagtggcagatcttgttgggatctcaccactgtcccaagtagatctggccattcatgacatgctcttcctctccactctcacatctccagttccacctttcatcaaaatgctcaaattgtttcccttctcttactcttccatctgactaggacacacttgcacattgtggtggctcctgttgtaggatggccttatagctggtgggcctctgagtgacctttctccatcttagctgctttggtatggtggtaagtgagtaactatggcctgcctgtttcgtagggtaaagggcaggtctgtgggtagcacataggtagagctctgtctccctcttcctgagctgcactgcatgaatttgatttgatttgatttgattttttataagtccaaggcataagacagctttggacaccaagccatgtatcaaggtgagaagaacaaaggactgccatctgctctgcccctgtctgatataagtacaacaccataaacaagcttt

SEQ ID NO: 905 - DNA, 1400 bp, mus musculus
aatattaatatttagaaatatactacatattgtatatatcaacataaaacagtttctagcattccaaattcaacaaagaattcctttaccaagttgtcagtagggaaggggaatcctctatcattctttcttttcatacattgactcaaagcaatgaatcaacggtattcttgaagtcacagattagagataggtagaattttcccttaatgaacaactataaaggtaaagacatagtcaaatggtccagtatttgtacataaaaaagatcttaagtcatagttgctttggttttgctagtagtagtagtagtagtagtattggttattttatttatttacatttcaaatgttattcccttccaagtttccccttcacaagccccctatctcctcttccctctccctgattctctgaggatgatcccctacctgtctacccactcctgtctcagtgccctagtgttcccctatcccaagcctccacagaaccaagaggcttccatcccagtgatgccagataaggcaatccttggctacacatttagcaggagcaacccttccctcctgcctccccccacctccaatagtctttggttggtggcttagtcattgagagctttgggggggggggttctggttgttttatattgttgttcttcctatgaggttaaaaacctcttcagcttctacagtccttgccctaatttcttcattggggtcccctttctcaatctgatgttttgctgtgtacatctgcacctgtattggtccactctggcagagcctccggggaggaaagccgggtatagctgtcccatagttgctttgtaaaagggattccagtatgacaatttcatcaaatctgaaagataataaagaactcacaaatggtgatggtaaattcagaattttagttatgaaattaacccttcttcattagtatcagttaaaatatagtatgttatctcctcatagctgttttgccaaaaaaaaagaaaaaagaaaagaaaaagaaaaaaatgaaaaagaaaagaaaaatgttctaattagtaaatacagagcagatgcaggaattacagaggaaacagaataaagtcaagcagaaaggataaatgctcggtaagagaaatgataaaccaagttatccttcccaaagtctttgttcatcccacattgtcctttagaaaagcactctgtagctctctctgtgtttgaagagttaatcttcctctaaatctaatgcttctacataaaagagcattgagcctttatcctggtccgaagagattgtggcacaaatcccttcttttgcatccctgactttaatcttagatattttctcctagaacagcagcttcttatacatttttaaaagtcatgataaaccattgggcttag

SEQ ID NO: 906 - DNA, 1000 bp, mus musculus
cccagaaacctagaatatccaagatacaacttctaaaacacaagaaaatcaagaaggaagaccacctcgttgatacttcattcctccctagaagagggaataaaatatccatggatggagtggcacagacaaagttttgacctaagacgaaagaatggaccatccagagactgcatcacctcggggtccatcccataataagccaccaaatgcagacactattgcagatgccagcaagattttgctgaaaggaccctgatatagctgtctcctgtgaggctttgccagtgcttggcaaatacagaagtggatgctcattgtcatctattggatggaacacagggccccaatgtaggagctagagaaagtacccaagagctgaaggggtctgcaaccctataagtggaacaacaatatgaactaacaagtacccccagagcttgtgtctctagctgcatatgtagcagaaaatggcctagtcagccatcatttggaagagaggccccttggtctagcaaactttatctgcctcagtacaggggaacgtcagggccaagaagtgggagtggatgagtaggggagcagggcggggagagcgtataggagactttcgtgataacatttgaaatgtaaatgaagaaaatatctaataatttttttaaaaaaagaagggatagagggaagtaagaagggggagctaagaagggagggatgaaaataaaacaaaagataattttttataaactaagtagagctccatgtatcagagtgcatgctacaattaagcaattgtattttaaaagaaataaatacactatcaaaatcgatcaaatatgtgtagttatcatctctaaagttgtccattgctgaaacttgccaccagcctgagtgtgctgatgtactccgatggtcacagcgcactcaagtctgtagttagatatctgcacagcccagatcatttattaaatctgtctgaaaaaccaaacacaaccaataataa

SEQ ID NO: 907 - DNA, 1000 bp, mus musculus
atcatacaatctactcaagatcaagggcctctcctctcaatgatggctgattaggccatcttatgcaacatatacagctagagacataagctctgggggtactggttagttcatattgttgttccatctatagggctgcagaccccttcagctccttgggttctttctctagctcctcaattgggggcgctgtgttccatccaatacatggctgtgagcatccacttctgtatttgccaggcactggcatagcttcacaagaaacaactatatgagggtgctgtcaggaaaatcttcctggatatgcaatagtgtctgggtttgttggctgtttatgggatggatcccagggtgtggcagtctctggatggtccttccttccatctcagctccaaaatttgtgtctgtaactccctccatgggtattttgttccccattctaaggaggaatgaagtatccaaaatttggtcttccttcttcttgagtttcatgtgttttgcaaattgtatcttgagtattctctgggctaatatccacttagcagtgagtgcatatcatgtgagttcttttgtgattgagttacctcactcaggatgatatcctccagatgcatccatttgcctaagaatttataaaattattgtttttaatagctaagtagtacttcattgtgtaaatgtaccctattttctgaacccattcctctgttcagatccatctaggttctttccagcttctttctattataaataaggcttctatgaacatagtggaggatgtgtccttattacaagttggagcatcttctggatatatgctcaggagaggtattcctggatcctcccgtagtactatgtccaattttctgaggaaccgacacactgatttgcagagtggttttaccaacttgcaatcccaccaacaatggaggagtgttcctctttctccacatcctcaccagcatctgctgtcacctgaatttttgatcttagttattct

SEQ ID NO: 908 - DNA, 1000 bp, mus musculus
ggagtctaactctcttctgaatcccagtggtcggagcactctctgcagacaagctctcctgttgcagggaagttgcacagaggtctgaagctcagatccaccacttagcagaagatgaagatccgaagggaccctgcccaagaagctctgttgcttctgtggcccaagtgctttcctgctcagactgatttctgagagacctgggatacaagatggtgcttttgcctgagtacctgggttggagcccttcctggaggctgactctcctttggtggggaagttgcccagagttctgggtctcagatctacctcctggctgaggatgaaggatctatgggaccctgtccaagaaactctgttgcttctgtggtccacgtgctctcctgagagtccaggaatacaagatggtgctctcacctgggtcacagggtcagagccctctctggaggccaactatcctcagtgatcctaagatcctgggtgtgctagggcacctgcagtgtggagagttctctggtgaccatgcgactgtccaccaaattcacgctcaaggtggcacagggctgtcactgaccagaatgaacgccagcagttggtcgggcgggtttcctgtgttcttgttcctgctggcccaagcccctctgggttgttttggaacagatgtttcattccactcaccagtgattccaagatcctgggtgttctagggtgcctatggtgtggagagtcctctggggaccttgggactgtccactgagttcactaccatggtggcacgaggctgctgcagaccagaaagaaccccttctcagatttgtaatgctccaatttactgggataatccagttcaatgttcacagatctaaaaagaaaaaatgatatttgtaacttgtatgctatctggaaaatgttaaagcatgtgttagatatcatttgaaagctaatattttatataatgactatctgtgtataaaattttcaatcattcctccatcaagca

SEQ ID NO: 909 - DNA, 1200 bp, mus musculus
gtcattgtcaaccattatcaaaaagaaaacataatccttttgattacttctgctaattttacatcttatggtgttatctctcagtttgtttattgacttgagatgtagtcctttgtgctcacacagcagagtctagtttacttctccttatatgactatccagtgtttcaaacatcagagatattttttaaattattattttaaatctttatttacagtccagtcatcatccttcctcctgatctgccctctgattgttcctcatctcactccttctctcctatttccaagaggatgtctccactccctcaacccaccagaccttcccattctctggggcctcaagtctcttgagggttagatgcttcttcactcattgaggccagaccaggcagtcctctgctctatatgtgccaggagtctcatgtcagctagtgtatgctgcctggttggtggctcaatgtctaagagatcttcaggatccaggtgagttgagactaatggcctttctatacagtcaccctcctcctcagctttctccagcttttctctaattcaacctcaggggtacccgacttctgtccattggttggttattactatctgtatctgactcattcatctgtttgttagacctctcagagagcagccaagctaggcacttgtttgcaagcacaccacagcatcagtaataatgtcaggccttggagcctccctatgagctagatccgaatttggaatggtcactgaacctcctttccctaagtttattctccatttttgttcctgcagttcttttagacaggaacaattctgggacagagattttgactgtgagatggcaaccccattcctccacttgatgctttgtctttctactgcagatggactccttcgccccactgtagggcatttcatctaaggtccctacttttgagttctgagactcacacctcccaggtgtctggtacattctagagggtcttgcccccacttcctacatactgagaatgcctgtttccattctttctgctggccatcaaggcttcactcctgttcccctaatacctgattatgcccccttaccccctccctgtcccctctcccacctagtcacctccttcccactgccattcatgattactttgctctctctcccaagtggaactgaggcatcctcacttgggccatttgacttgt

SEQ ID NO: 910 - DNA, 1600 bp, mus musculus
attttctgccttgtcaatagatgctgattaagcaacggctggcaggataaagaaatgggtgagacatctcccaaacaaaagaatgagagaggaagagaaagattcacatcagctaggaggatggaggatttgaaagcatgaggaagggatctggagaaagatcattgaaacacacccaaagcccaaagagccagatcaattataatatgcaagtatcttgccatgggactggcaggtagcaagatttgcataggatattaatatagatcatttagctctttgtcaaagttcaagtaaccataggtgtgtgggttcatttctctgtcttcagttctattctattgatctacctgcctgccactgtagcaataccatgaagtttttatcatgatttctctgtagtacagcttgaggtcagggatggtgattccaccagaagttcttttattcttgagaatattttcgctatcctggatttttgttattccagattaatttgaaaattgctctttctaactctatgaagaattgagttggaattttgatgggaattacactgaatctgtagaatgctttagacaagatagccatttttactatattaaccctacccatccataagcatgggagtgtgggaagccacatgtgctgttgcagggtggcgctggctacagctggccaccacacataagtttgggtaaacaaccaatgtgtacatatgcagtaaagtttttcaccaagtcactgcctggcctgggcatgataatgaggctccatgagatactgagagagaataaccaatcagatgagagacatgcaaatgaggtatgataatgaggctcagtgaggtactgagagagaataaccaatcagatgaggaacatgcaaatgaggtggaaagcataacgaaaccaggtgtgagacacaccactcctaggcctatataagcagcaccagttctgggcttggggtcttttcgccactgcaatcaaattctcccaataaatgtgtgcagaaggatcctggtgtggcgtctgctttgctggcaagtggggcgctcacaagatgggagatctttccatcttctgagatcttcttcaatttctttcttcagagacttgaagttcttgtcatacagatctttcacttgcttagagttacatcaagatattttgtataatttgtgactattttgaaaggtgttgtttctctaatttctttctatttatcctttgagtagagaaaggccactgatttgtttgaattaattttatatccagccacattgctgaagttgtttttcaggtttaggagttttctggtgaaattttttcggtcacttaagtatgctatcatatttttggttgtgagcctagcctttaacggctgagccattggggaaaagccttgaagatatgggtacaggggaaaaattcctaaacagaacagcaatggcttgctctgtaagatcgagaattgacaaatgggacctaatgaaactccaaagtttctgcaaggcaaaagacaccgtcaataagacaaaaagaccaccaacagattgggaaaggatctttacctatcctaaatcagataggggact

SEQ ID NO: 911 - DNA, 1000 bp, mus musculus
taccatcatcatgaggtatgcttttaaatccgggtctagctatccaggtgtgttggggtgcccaggactgggggaggtgggagtgctgcattctgataatggtgagtgctcttggtttctgttagtaagattcttacatttgcctttcaccatctggtaatctctggaggtagttgttatagttgtctctggttagagattgttcctcttttgttagcctctatcagcagacctgggaaactagatctctcctgaatttcagtggtctgagcactctctgcaggcaatctctcctcttgcagggaaggtacacagatatctggcgttgggacctgcctcctggcagaagatgacggccggaaacaggacctgtaccagaagctgtgttgctttggcctgtcacagaagctgttagcttctgtagtccacactctcacctgtgcagactagtttcggagggatctggggaccaagatggctccaccaggtactccagcaaagccctctccggcagggtggacacctctcctctggcagggaaggtgcccggatgtctggagcccaaaacgtggtctgcctcagaagctgtcctctagggaccttgggggtatctgccaactctgcgcccaggtgacctggtgttggtgccgactggaagggatttggaccctggtcaggctgggttttctgcttccctagtgctgtctcaggtccttcgtgattggattggaacagaagttgtgttccactcacctgtggtcctaagatcgagtagagagtcctctaggggacctggggggtgtcgttaggtatatttttatgaaaatagtttctataataccagctatctgcactaagcattataagtgtctaggaaacaatcccttaaataagaaaaacaacagaagtatcctctagctatccataaaatcaagcttgaaccaggaccaaaggaaaccatttcataagtcatctctttcacagagattttatttttttt

SEQ ID NO: 912 - DNA, 1000 bp, mus musculus
attatgaactgattcggacttaataaggagaagaagatgtttatactgcaggcttctaacgtcctgcttttattttggttgatggtttggacagagcctatgaagagtatttataaagagaaacagatgctcctggtaaatgagagtccatttgtggtccttacactgtgcctccttcataactgcacagttcaagttttaatttagtttttaagtctttcaaaaatataacagtaactaccagacaaccaggcatggaaatgcctggcaagtaattaattatgaattttattataaacactgcaaagctactagctactctaaaagaggaagattgagaagggtcgcttaaaacattgcagagagaaaatagccaattggcatttctctagacgtttttttcagaaattatatttcaggaagggtaatgtgaatatgagtaacacgtgggcagagaattcctgtgagaaatcaagagcgactgactgcatggtgctgggagaggcgttccatattcagacacttggcaggaaactgagtctctgaagagggggtgtggctgctctgtatccaatgagatgcagtacgataattcactatctaaggcacaggatcatatgaccagaataataaatggtgttagtctgattgttctttcagtggatgagatcttcctataaaaatcaatgtgaaaagagacatggtaagtattttctggagtttccctacatttggcccaaggatctgtagaagagagatttcttcgtggagctctatggagctcttatgaacaaaaatatgagccacaatggatcacgtaatgctttctgatatttgtgactgctgagtacagagagcatggcaaaaggtttgatatgtctccctcaagacttgtctgagaggctcttatgccatgctgggttctactgctgagtcaagattttgagagctgcatacaagatgagagaaggagaaggagggggaggggggagagggagaa

SEQ ID NO: 913 - DNA, 1000 bp, mus musculus
cccagctgaagagttctgaatccacgcagttgaatccttctcaacagtctgctttgcaagaacacttcattaaccactcaatccccgtgatgcagttctgaatcatccctgtaacaggggggtcttcgctcgtgccttaagatgttacttcccaggtttcggcaccactttgtagacgcctgattcgccagcaagaaaaacaccacagcaggatccttctgcaacatgtttattgggagagcatttactgcgaaggcgaaaggccccgagccccagaagtagtgctgcttaaataggcctaggagaggcatgtctataactgattggttatgctttcggtaccccacccacatgcctcgggccaggcagtgactcggcaaaaaaactcttacgcacatgcacacattggttgtttacccatattcatgggcgtcggtttattgaaaccagcgccatcttgtaatggcgtttgtggcttcccacaagaatttctgagaaatcaccatccctgacctcaagctgcagtagtgatacagaccgcacgatattggaacacagacagacaggttaatcaatggactagcctgttatagctgtctcctgagagactctgccagaacctgataaatacagaggcaaatgcctacattcaaccattggactgagcacagggaccccaatggatgagttagagaagggctgaaagagctgaaggggttcgcaaccccataggaagaacaacaatatcaaccactcagaccccccacagagatcccagggactaaaccaacaaccaaagagtatacaaggagattcccatggctccagatgcatatgtagcagaggatagcattgtctggcatcaataggaggaaaggcccttggtcctgtgacggcttgatgccttagtataggggaacgtcagggataccagtgacaagggagtgggtaggagggagggagaacaccctcacggaagtagggggagatggaatggggg

SEQ ID NO: 914 - DNA, 1000 bp, mus musculus
gacaataaactaagaaatttatatgttaagtagtgaccgagagagttggggaatgtggtggctgattttactgtcaacttgataaggtctagagatggacctatgggcatgagagtgaggtttctgattaggttcattgaagtgaaaccccccactcactatgagtggcatcatttcctagcctagaatcttggattgtataaaaaggaaaattaaggctgagagccagtgttcatcaccctgttccatttgttgacaatggatgcaatatgactagttacctagagctcctgctgttatatctttccctgaaactgtcagtcacaagaaagcctttctccacatgaaactcaagaaggaagaccaaaggtggatacttcgctccttcttagaacggggaacaaaataaccatggaaggagttacagagacaaagttggagctgagttggaaggaaagaccatccagagactgccccacccagggatccatcccataaacaactaccaaacccagacactattgcataagccagcaagattttgctgatatagctatttcttgtgaggctatgctagtgcctggcaaatacagaagtggatgctcacagtcatctactggatggaacacagggtccccaatgaaagagctagagaaagtacccaaggagctaaaggggtctgcaaccctataggaggaacaacaatatgagctaaccagtatgccccagagcttgtgtatctagttgcatatgtagcagaggatggcctagtcggtcatcaatgggaggagaggcgcttagtcttgcgaagattctatgccccagtacaggggaatgccagggccaggaagtgggaatgggtgggctggggagcagggcttggggtagggtatagggaacttttggagaggaaactaggaaaaaggatagcctttgaattgtagatgaagaaaatatctaattaaaaaaaaagaagaaagaaaggaaagcctttctccat

SEQ ID NO: 915 - DNA, 1200 bp, mus musculus
gttaccatagtaaaatattctggcaaaagcaacttaggagagaaagggcttattcaacttacaacttcaggttacagttcatcacttcagggaaagtcacagtgacatgatcaggagatagctagtcatattacagatacagccaatgtttgagaaaaatacacttatacatgtttacatgtgctcagtcccatctttccctgcctagggaatgatgccacctaaagtgggctgtgtctttccacaccaagtaacaaatacttaagacagttcccccacagacctgcccactggtcaatctaattgaacagtcctgctgaaactcttcccagataattctagaatagcaaattgagagtagaagaaaataatcattactagtaatgttagtcctcacatggtccacacaccacagctagtggaaacaaaaacatttacagtttcacactcagccactgtctgatttcacctctcagatagtgtcttagtcagggtttctattcctgtgcaaacatcatgaccaaaaagcaagttggggaggaaagggttgatttggcttacacttccatgctgctgttcatcaccaaagaagtcaggactggaactcaagcaggtcaggaagcaggatctgatgcagaagccacggagggatgttccttactggcttgcttcacctggcttgctcatcctgctctcttatagaacccaagactaccagcccagagatggtcccacccacaaggggcctttcccccttgatcactaattgagaaaatgccttacagctggatctcatggaggcatttcctcaactgaagctcctttctctgtgataactccagctgtgtcaagttgacacaaaactagccagtacagatagattgagaaattaagataatatttattaacaactcggcatcaatggaaagtatctaaagggtgtttatagtctgaagttcaagtttttgacccaagaaactttggtcatgtcagaaaaacatctgtgaatagatgttgagatgaagagacttgttccaggtttaaatcaaccccaccagccactccttcatgaggttgcataaacatcagatgaattaagcattagttttgtactacagtaaatcttggttactgtaaggctggagaggtggctcagaagtcaactgtccttgatcctttggtagagaaccagggttgagt

SEQ ID NO: 916 - DNA, 1000 bp, mus musculus
ataacaaacttgctcaacaaagacaatgttagggaattcacatacttgaagtccagctttcaccgtgtaaaaaaaggcaatgccaagggctgtgaaggaagctgtatgtagagtgtggaagctgtatgcagagtgtgtcatgcaggccttcacacactagcaccagaataaggaagctattgcacactctgatgctacctcagagtcctcagatctctgagcagggcttgggagaaagaggactggtagagagcagggaaattggtaggggcatctctgagacaagctgaagacctggggcagaggaggctcctgaggtatggggatgaccatagatggatgagtctcttagaagtgaggggtatggatcctgaaatggccacctctggtagccaggcaggactttcagtgaaggaaaacgaaacatcaacccacccacaaaactgttgacccaaaatttgccctgcatacaggatgcacagggtaacaatgaggcagtaattgggggaattgccaaccaatgactaatcaacttgagatctaccccatgggagagagccaacctctgacactataaatgatactttgatatgcttgcagagccgtcatttgaggggcttcatctggcctcagaaagaaacagacgcagagactcacagccaaacatctggcagagtttgggagtcttgtgggagaagaggaggaaggactgatggacactgagggatcaaggacaccataaaaagacccacagagtcaacaaacctgggcccgtgggggctcacagagactgaatagtcatccaaagatgatgcataggctgaacctaggtcccctacacacatgcagcagatgtgcagcttggccttcatgtgggatccccaacaatcggagcaggggtggggcttgtctgacctcagtggaagaggatgcacttagccctgatgaaacttgatatgccagggcaaacgttggtactcagtggagagtcagggtgtaa

SEQ ID NO: 917 - DNA, 1200 bp, mus musculus
gagcctgggctcctaaaatcctaaaagagggctcagaacacagcccaggggtggagcacttatacagagtgtgtaagatctgtgtttggtcaccagtagtccccaccctccaaaataacaggggggagagtaaaagataattttcctaatttactaaatactgcgggtctttttaagccaccctatacacaaccagaaaaaaatggagccagtttggctgtgagcccacagaatcctgattgctgtttataaacaactccgctgtacttgtgctccacaggcacacagacctctagctgccaaggaagtcctgcagcctcacccccatggctagcccaccaccgtcgtcgaaagtgctgtcccgaatggccatgctcagcacagagccacggggtgtatgcctatcatagctcacaccttaatttctgcagctgcccaggaattttttccccatagtccaagaacctagatcagtgaggaggaaataaattgtctagatatggtatgtgagagtgaccaagattaaatttctctgcctgcaagatgtactctgatagcagattaataagattacatctccacaccggagcaaagtgccacctttaatcatttcccagcgtgggccacccagtctctcactcgttaggttcatgaacaagaggaaaaagatcaccaggcagggtcaaaggtcaaaacaccttgtctctgaaggccttttcctcacgaagggttctatgaatcaaagcaagggtataaccaacctcatatttcaaacaagggaagaagaatagagccccccgtgagtttataagggaagcggggcaagctgctgctctcagaagcagaccacattcgcaaggagcatctgttgttaagttgtatgcatgcgtcatggatggaacgaagctgaggtcagcgcttatggggtgaactgtggacccaactgtaaagtgagcccctagggtcttctacctgtttatgagccgtggctactgggaaaaaaaactagtctgtggtcaggatgcaaagcaaacctcttgcctgagtaagtaaatttcaccatgaacaaggtctggagatagaatctatgcccccaggtgactgaattcttttggtctaggtcaatgctagctctgttcctgtagcaacagtgttctcttctttctatcttctcctgtggaaagccggtacgtgctgcga

SEQ ID NO: 918 - DNA, 1000 bp, mus musculus
cgaagaaaaggaagagattgagaatcaaaggttgggccctgagtctagctcctccctaaggaagtgttgtgtactgccaccacgtggagagccagataaagagtctagcatggccttgcctatctgggactgagcttcacctctttggaagatggacacacaccaggaagagaggcaagaagacttcagtgttgccagagcaactgctaggagacaccttggagttcagatgtcacatctcaacagggatgcaggtcagtggtagaacatgtgcctagcatgcacatgactgtgttcccacctcagcaccagcaagaaaaatcacacgagaacgccacagctgaatctcatttacaccaacctttagtataatttgagcaagcattgctttcaagttccacaacacgttataattaagcaattagaatgtaagaaagaaagaaaggaaatttaatagaacaggcatttcatgtgtattttagcccaacagcaggcagtggtatactggggtgattgatacactttaaatattattaagcagcttcacggggggcctcagccagccagtagatagcagcttctgcactggtgtttaagacacatgggccctcaacttctttttctggcttttccaatggccaatggagaaacaagacacactggctcggcaagaacaagagacagcactgaaatcagcatctaagagttcagtatactctgggaccatcaaatgtagatgactaacatatctcttctgccagaaagttctcaagcctttgggaaaccaaggaaacctgcagcttccctgtatgtaggcttcactgtgcaggaggcagcagcacacactcggggaagggcccagaccataaaggagcttgggttccaaggtcactttgccttctactagccatgacagtttgatcattcactgtgttccatttttctcgtttgaaataaattctcatggcaatcatattacctccttcagggagcttgtttg

SEQ ID NO: 919 - DNA, 1000 bp, mus musculus
taagggagttttttttttttttttaatgtccttcttaaagtcctctatcatcgtcatgaaatgtgactttaaatcagagtcttgcttttctggtgttttctggtgtgttgggtatcaagggctcgttgtgatgggagaactgagttttgatgacgccaagtagcctggtttctattgtttatgttcttagcccttgcctctggccatctggatatctctggtgttagctggtctttctgtctctgagtctggcttgtcccttctgcaagcctgtgtgtcagtactcctgtgagactagttctctccaggatgaatctgggtaaggagagttgtggcccagggtcagctccgaggtgcagatggaaacctgaaggatcctgtccccagctgttccttggttcctgtgacctgttgactctgggctggtccctcttaggccagaaattttagcagaagcggtggtgttatatgtgtaaacaggtatgacagcattcctgaaacaccagctctcttcaggctatatttgggtatggagtgctgtggcacagtatcagcttctgtctgtggcacagtatcagacagaaactggaagaatcctgacccagggtgctccttggttcctatgtcctgaggtctccgggtggatccctcagagcagaagtgatagacttacctgtgctcactggtgtgcctatactcctgggagaccagctctctcctggaattatttgggtctggagcactgtgggacaggatcagctccaagaaagacattttttaattgttaaatttaacacaactttatcaagaataggttaaactgcacataagaaacaaatgatttcataatcacaaaatagctaaaggaactgacttttgccaaatatcttaaatatccccatgtgtgttgtcttaatgaaaaccctctccatctaaaatactaaactattttccttttatgataatcattttcttctctttatagcttcacaacctacat

SEQ ID NO: 920 - DNA, 1200 bp, mus musculus
aagattcagaaatcatcagtttggctagggtcaattttaattttagtaattaataacttgttgtaattatttattcatgtatatttctcttttatataatgtaggcctctctaaggccctggctgacagaagttacgatgcctccagctaagtatttagccatagttgctctctaatatctttttccatacaaatttataaaggattttgctgtcttgtgttgtgttgtggactgggtctaatgctacttatgttaatatggctccaaaacttacacaggaacctgcacatctgcctgtaagatgcttaggtccctacccccagttggtgttgattggtaaataaatttgtcagtggccaatggctgggcagggagacagaggcaggacttttagcatttctggggaaggtacacagaggaagaagaactgccatgcctgagaaggagaaggtccaggcctgagaaatataggatagagggacagagaggcaaagagactgccaacatgcaagagtaggggatcgagacccagggggctgcaggcctgggtccagggtagccagtttaggaagtaatagttcaggtatatcagatggggagaatgtgctagtaatgtggaggattgaagtggcccaaccattgagctaactaaggcatatttaaatataaggaagtgtgtgtgtgtgtgtgtgtgtgtgtgtgtgtgtgtgtgtgtgtgaatgtgtgtgtctgtgtgtttcttttgagaactcagaacattggggctggtagcgaggaatttgtgccactgctgttgagtgatttgagaggacttaatcacctaatgctacagtcttgggtcaaaataattatggtattgagtttcttttccacagaaaaggtccttaggtcctctgtgcaagtagattccctgcttctaaaacattctcattcaaaatgtctttccagagaaagttatccccatctctcagttggttgcttggtcattcttcaagcaaacagctttatgatatcatataaatatagtcagagcttgattgttcagcttttcaagatgtgatggattgtctccttccttgagaggtgactatatcactgccacataaatcttagtaatctgctttgctctttgtcttaagatttcaatgaatagctcatagggaggtacattcagtcagggtgtcaggagagaagtgcag

SEQ ID NO: 921 - DNA, 1000 bp, mus musculus
tctgttttctgaggctgccattggaggtgaggtacaatgacaactgaacaggtatgtgagctctgagaatatgaactccagacttcaagggctgaaactccagggcctcgaacataaggaagttcacatggcaaatactttaactacagagtgatctacccagcccatcacggatagatattgatgggcaatggtattgaaaacttgtagaaaccttaggaagcaggacctgaatcaaggccttccttacctggggtggtcggaataaatattgatgaactggccagagggacccatgcccctttggtgtattgtcttacctccccctctgtgtctccccccccccatttttagcaggaaatgaacagttattctatgatatcctccatcaaaacagcagggccaatccagcttagattgagacatttgaaaccatgagccaaagcagaccttgtcttttaccagttgaatgtagcaggtgagcaattcagcaagataagcttgtgggcacagaaaattggtaccaagaagtacatggttgattctggtttccatctgcacccagagctggccctatgctctgatccccatacccagatcccgccaggagagagctgatctcccaggagtgctgacacacctgtgagcacaggtagaaccacttctgctctgagtgacccgtctagaatacacagggcacaggacccaaggagcagcctgggacaggatctttctggtttccatcttcccttggagcagaccctgtgccacagctctccatacccagatccttccagaagagagcaggtttcccaggagtactggcacatgtgagagaacaggtgagaccaccatttctactcaaattcctggcccaagagggacctttgtagagccatcaggacacaggagccaaggaatgagcagggacaggatctttctggtttccatctgtgcttcagagctgaccctgtaccacagctctccatatccacattcc

SEQ ID NO: 922 - DNA, 1200 bp, mus musculus
tgctcacttctaaatggagcatttaggatcacgtcctttcaaggctcagagaacatcctggaagaggctgtgcaaagagggtgcttaaaagccagagaatgggagaatcaaagcaaaaagatgactcctgcatatgacatagctgtcattcatgaacccactgcagctgtggttcatctgcacagaaccggccgggctacagtttactacggattggggagagggcctgtgaagccccatccctccccgagggactactgccaatcaacagtgttggaagaagattagtttccttcaggggtgagatctcccctacaacctcccaagccataggctgttgaccaggtttgcagaaccaggcacagttctttcttggacagcatgcctcacatcagacactaataagttccaatacagaaagctagctgggcgtgccacatgtctttaatcccagcactgggagagagaggcaggctaccaggcaagagtacatgtgagaacttgcctcaaagtaagttttactatgaaaaattaaacttagtttcagattctgggatctctgtttaaaagagatttatgcttaacatacaaattaatatataaaatatacttctggcaagctgagaattgattcatagaattcaagcaatcagttcaaaatgaataaaagggttagaaaaatttacacagaggctatctagtttcaagactaaagtacttccaggtcttaatccaatgaagaataggtcggtgacaaaggtgacaggatttgatgttcagcctggagaggtcgaaccatccaccacgtctcacgcacaccagctgctggtagcttgactaacagtgactcatgaaggaaggctgggcccgtgattttctggtaagaccgttgaactactggacagtaactaccccaaagccttggtctccttgtggagaactgtagacataatgcaatccttctgcctttgcagaagtgtcacagctaacctaagtggacacatcttgacgaacagcttagatattcaagcccttagaattttaaattaggttttggggcaggagagatggctcagcagttaagagcactgacttttcttccagaggtcctgtgttcaattcccagcaaccacatggtggttcacaaccatctgtaatgggatcagatgccctattctggtgtctgaagagagcgatagt

SEQ ID NO: 923 - DNA, 1000 bp, mus musculus
cactatgagagccatgacaatgatgactcttaaaaaggaaaacattgcattggggttggctttcaggttcagaggtttagtccattattgtcatggtgggaagcatgaagtcacatgggcagacatggtgctgagctgagagttctatacccagatcagcatgcggcaagaagaaggagtaacacgaagcctggactgaccattcaaacctaccccactaacacactttctccaacaaggctacacctacctccacacagccatatgttctaatatgcaactcctcatgacactgtgggggccattttcagtcaagccaccacattacgccaaggtatacagccaaaaacttgcctactttttatttaaaaggagatggctttcattcccttataaaagagcaaggacaatggcttagtgctattcttagtcattgagactgttcattaaagaaaaaaaaacatgtaagacaaattatgaaacatgagaggaagattttccagaggattaaggagaacaattgttattaccagtcttactcagctgtgctccctgtatggtacacggctgaccgattagcatgctatacacactaatccagtattgtcaggtcagtttttttttttgtcacacaggtatttcatcctgtatgtggagtgggtcttacatctaatcagaaataggttggtcacttccacgactttcatgccactccttcctcagctgccatatcttgtcaggctggtcatcactgtagctctcagagttcacagctgggttacagtgttaactacttttctcctccagtagagtgcatagcaccttctagtgctatgaaagctagcaagaaggggcgaagcttccagatcaggagcagctttatctcctcacattcttgactcaaatgtttggtcttttcagccataaggtcacattgaaaaagaaaacctgtcactttgtaatctaatttcagacaatccaaggcattcagacatatttt

SEQ ID NO: 924 - DNA, 1000 bp, mus musculus
ttcctgtcacatgcatgaaggaactgctcatctttccagctggggtctagttttccttggcatgaacactgttacatgtatcagggggcatcatagaatccaggtgggatcttgtcccaagagttcagaggagcttccacagagcagagcagttatactaggcctcagccaccaatttctgatgggagaggctcctgcccacaggtgctggcactccctggtagaccttcctctcccaagcattgcctctgcagcctacaggtacttgattgcacaactccgggtctgctctagttaccatttgcccttatgtggctatattgaaactataaatatggttttattcctcccactccaccccaattcctggtttctcttgcattagtgactatcatttagaatgctgtaaaatgatcctagttctctagtcatcagaaagaagtcggatgtgctgttggggattgccctcggggcttctgtagaccatataactggtacacaccgagttgtctctgaaggtcacacctaagacttcactcctgtcgtattggagctagccttaggattaatcctctactgtggccctttggtgaagcttaagatcctgaccctactgttgaactgcttctgtgatcggaaagatgggtgtcctgatcttaccacttacttacaagtggtggagcaggggccagtgttggagtctctgctctccaggagggggctggaatgaccagacatcattcctcaagcagaaccgggatctgctgctgtgggcactcagctctgtagtcctcacatctctgatctgctctcaaacttgttgggttggatctcagcctgggtggggagctgcttgttcaagcaggggaacctccctcgtgggtgggaggagcctgcaggtgtgtcctgctggactacggctgtgggcttcataagttgcgctattgccagtctaagcagtctgaaagatgaatccccgttaaagtacagttgctgctaa

SEQ ID NO: 925 - DNA, 1400 bp, mus musculus
acagcttgtatttacctatctcaaattacttccctggacccttacaatttacataaactttattcaatcatttaccatgcgacccagggggttgattactgagagcagtcattgaaaagcaagttcatttaaataagggaaaatcgtaaagagtagatttttagttagagatagtagtatgatatctggagtttgtttttacactgaagtttgttgtgggagtctcttttttactgtgtagcctgtaagagaggtaaaactgtcatgtgtctgcctttctcagcaggagacctagttgctctggtaaagcaagacctgatttttttacatctgaaacagattgaccagccagccagctgcagacttgcaggggggtggaactcactaaaaagtaggcttactgctgctaaactgatgaagctcaggctagccatcaacaccatcacaggtctgagaaggataaatttgagcacgaatataatctaagtggcctctgtattggttaaaatggcagagactaactggactgacagcctgaacttgtccatggtgatctctatgacttgcttggggtcaaaggtcaccaatttttgactatcacacaggacaacatcaagtcttcagctaccagacccagaatatttgagagattttcctatggaggacaagcctgggaaaactgacctgtcttggtgacgttgagtagagcagtcagccagctctgtccccaacttgggcagcatccaggtggcaagcaaggcatccgattgagcagctctttgcccagtagtcattattacttcgctccagttggagctccttgctaaccatcttctttggacacctacgcttgttctctgtgtacataaatatgaatgatttaagaagccgggtggtggtggtgcacgcctttaatcccagcacttgggaggcagaggcagacagatttctgagttcgaggccagcttggtctacaaagtgagtgccagggctatagagagaaactctgtcttgaaacaaacaaacaaacaaacaaaaaagaaaatagtgaatattaagtactaagtttaaagtaccactctgtagacggtaaaggtcacctagtagaaatgcacggaatgttttagacagatttgtaacaatttggttttttggttggctcaagtgcaaggttatagaagactttaagaaaagtaagtagggtgcagtctggtttccaggtttccttaaggaatgcactgtccttagcttagtactgtggattggtagtagcatttcatatctgctgcagtcaagttacctcgacatagttactcagttactatcattttcaaatgctcttcctatgcctgtgaatgactgatgctcatattgttaactgtggtgatgagtttgaaaga

SEQ ID NO: 926 - DNA, 1000 bp, mus musculus
attctctgtctgtttctaattcttttcatttttgatactaaatacatgcaaaatgtgctctatgttccaaggagacaagaattataatgcagagttgggcttcattatatacattttgaggagacagaaatttttttctgttttaataaatctttattcttattacataagattggttctgtatgccagacccgccatctgcctgaatccagtggaggccactaagggctctagagtactctccatgctgcagtacctctgcatcacctcaggatcacgagcaagtggaacacaacatcagctccaaacaattgtggagggtcttgcaccagcaggaatagggacataggaacctggcccaaccagaagctgggatccattccggttggagccagaaccagcatcttccctgtgaactagtctaggtccacagaggaccctccaagccacaggacccctagcacacccaggatcttgtgatcatgggagagaacatgggtgacagaagcaacagagattcttggtcagggtcccttcaggccttcatactcagcaaggaggcagagctgagacccagacccagacccctgggtaccttccttgccagaggagagttggcttacagggagggctttgactccaggactcaggaggtggatcagagctccagacttctggacacctgccctgtaagaggagagcttgcctgcagagagtgctctgaccactgggactcaggtgactcccaggagtgctgacagagtctaacagaatcacaggaggggtccctttctggtcggtgccagcaccggggcaccttgtgcgtggagtcttcagacacccccaaggttcctcagaggactctccatgggatcttaggatctctggtgagtggaacacaacatctgccaggaggcaagtttgaatgccaggtatctgggcaccttccctgcaagaggaaaccttgcctgcagagagtactctgaccactgaaactcag

SEQ ID NO: 927 - DNA, 1200 bp, mus musculus
tgtcttttctgtgatactcctaataaacacctgtactttagtgacttagtgcagcttctcctgttttctcagaaaataggaccacaggaggctgttttatggagtccttcaactacaaggcaagtaaatcatgggtagtcatttcttctcagtgtttccttagtttaggggaactaatgtacatgtacttttgtgagaccccaacttagagtgtttctccctggaaggtaaagcccatggatgttccccaagcttgttttccctgatttctaaaaatacagccagaaagaagctctttgttctctatagccagcaaaaagcctttttgtttgtatactttacagccagagatgcctgccttcctgtgctgaggacatggagataaaaattcagaaagagctcactccccactcctgccttataaatttcatcaaggacaccccgaagaaaagaactctcttcccaactcctcccaagtcttcccaactcctcccaactcttcccaactcttcccaactcctcccaattcttcagctagctgttaaaagccccctactgtcaccactcggggtcaaactcccctgccctgcatggcagagggacttcgtcctcagctagctgataataaaacctcttgcagtttgcatcaggtgtggttttctctcgggacactggggtgctggccagctcattcccggacttgagcagaggcccagctttgggggtcttacactttcatgcctctgttttcccttttgcctgtctgcaactagcagatcttcatgcactagctttgtggataagttttctgtttcatcagtttgtaaattttttataaacaatttaagatgagcctatatcagattgattaatgtctaacattaattaatgtaactgtctttagagtctgaatcaatgaaatgtctaacataattaaagtaaggggcttactttaagggaaagaaaataattaatttgtcttaaaaatgggcaagggacttgagtagacttttttttttcacagggggcacagaatgtacaattgggcatgggaacaactattgaatactgccagtaacacgatgaataaaatataaaagttaaacaataggatttcactctatacatgtgacaacaatttaaaaacaaaaatatttgtgacaatttgaagaaaaagtaaactacattctcctttatggg

SEQ ID NO: 928 - DNA, 1000 bp, mus musculus
aatataatcattaaagtgtcctttacttgttactgaattttaaagcaaatagcctttaatgtttctgtacctactgtgaggttgttctaagctggagtaggcaacacacactagatttttttaaagatagtcttatgactgaagggaggccaaagtgtggatacttgaatccttcttagaagggggaacaaaatactcatggaaggagttacagaaaaaaagtgtggaacagactgaaggaatgtccatcaagtgactgcaccacctggagatccatcccataaacaaccaccaaacccagacactattgcagatgccaacaagattttgctgacaggagcttgatatagctgtctcctgagaggctctgccattgtctggcaaatacagaagtggatgctcacagtcatccattgaacagagcacaagttccctaacaaaggagctagagaaagtatccaaggagctgaaggggtttggagccccataggtggaacaacaatatgaactaaccagtacccctagagctccctgggactaaaccaccaaccaaagaaatcacatggtgagactcatggatccagctgcatatgtagcagaggatggcctagtcggtcatcagtggaggagtggcctttggtcccgtgaaggtcctctgccccgctatagggaaatgccagtgccagaaagtgggagtgggtgggttggggagcagggggagagaataggggataggagatttttggaggggaaactagaaagaagtataacatttaaaatgtaaataaagaaaatatctaataaaaaatcttgctgctatatcagatcaagtgttccgattacagacattcactaccttgcctggtttacaaacttttaaatgtattttattactatagatgcattgtagacataatagatttcactgcacatagcatattttaaacatatttaggcctcacacttttcttacatattttaacagatatatttaaaatat

SEQ ID NO: 929 - DNA, 1000 bp, mus musculus
aaagtccttcttgatgtcctctaccatcatcatgagatatgcttttaaatccgggtctagcttttcggttgtgttggggtgcccaggactaggtggggtgggagtgctgcattctgatgatggtgagtggtcttgatttctgttagtagttttcctttcaccatttggcattctctggagctagttgttatagttgtctctggttagagcttgttcctcaggtgattctgttatcctctatcagcagacctgggagactagctctctcctctgagtttcagtggtcagagcactctctgcaggcaagctctcattttacaggaaagctacacagatatctggccttaggacctccctcctggccgaagacgaaggcccaaaacaggacctgtccctaagtctagatgctttggcttgtcccagaagctgttatcttctgtattctacactctcacctgtgcagaatactcttggaggagtcctggaaccaagatgtctgcagccgatgctcaggcctagcgttccaggcccgggcagacccctatcctctagccaggaaagtggccagatgtctggggcctgtgcagaatactctaggctgggtcccaggaccaagacgtctgctgccgatgctcaggcaaagcgctcctgcaccggatggacccctatcctctggctgggaaatggccagctgtctggggcccgaaaagggggctgccttagaagctctgtggctcccacctgtcccagaagcttttagcttctgtattcagtactctcacctgtgcagaatacactcggcggggtcctggaaccaagatgtctgctgctgatgctcaggcaaagcgctcctgggctgggtggacccctttcctctggcagggaaagtggccagatgtctggagcctgtgcagaatcgaagttaatattgttagccactcaatttatgtttgcaagtcagagagacacagagacagagacagagacagagagacagaga

SEQ ID NO: 930 - DNA, 1000 bp, mus musculus
ggaagacaggtgacagaaacaatgattcagactaatcacatgattacaaagctgggtctccagcagggtttctggtggtcaggtgcagatgtctaagcgagcagtgacgtgggaggggcacgcactgggccggacttgagctacctggatgacatcaaggatggagggccaatcagctggtggctccagggatctccagtccacgctttacttggccaggggggttcctgaaggacctgccagcaaatctggcttttttgcccagctcttcctcaattctaaggatctgattgtacttggccaggctctcagatccgcaaggggcatgggtcttgatctgcctagtgcagagccctaccaccaggacggtgatgaaagtgtcttcagtctctccagactggtgggacaccatgacgccccagccattggactgggcaagcttacacgcctgcagagacttggtcatgaagccgatctgtttcactttgagcaggatgcagttgcatgacttcttgccttgacaatcttcttagggttggtcactgtgaggtcatcgcccaccacctggatgtctacactagccatgaacttcggccaggcaccccagtcgtcctggtcaaagtggtcctcgatggacaccactaggtagttctagatgaaggacttgtacaggtcagccagctggtcgagtgtgatgtacctgctggggtcatccggagacttgaagtccaggtcatacttgccagacctgtagaactcggaggcagacacatccatgaagcttcatggggaagggtgtctcaaggctgttgagcacatcagtaacactattgcacctgctctggttagcaagaaagtgaatgttgtggagcaagagaagattgaccagctgatgaccgagatggacagcaccgaggataaatctaaatttggtacaaatgccattctggaagtgtccctggctatctgcaaagcttggaatgtttacagatattgttga

SEQ ID NO: 931 - DNA, 1000 bp, mus musculus
tccttgatgtcctctaccatcatcatgagacatgcttttagatccaggtctagcttttccggtgtgttggggtgccctggaccgcgcgaagtgagagtgctgggttctgatgatggtgagtggtcctggtttctgttagtaatattattacatttacctttctccatctggtaatctctggagttagttgttatagttgtctctgtttagagattgttctctggtgattctgttagcctctatcagcagacctgggagacaggctctctcttctgagtttcagtggtcagagctcactctctcctcttacagggaagctctcctcttacagggaaggtgaacagatatctggtgtttggacctcctcctggctgaagatgaaggcccaaaacaggacctgtcccagaagctgtgttactttggtgggtcacagaagctgtcagcttgtgtggtgcactctcacctgtgcagactatgttcggtggagtcccggacccaagatggctactgccaatctagaggcaaaagcctcccaggctgggtggacacctgtcctctggcctggaaggtggacggatgtctggtgcctgaaaagggtgctgcctcagtagctctgtggttcctgcctgtcccagaagctgtcagcttctgtggtgcacactctcacctgtgcagactaagttccttcagcagagtcccggagccaagatggctacctcagatcctgaggccaagggctcccgggccaggtggacacctgtcctctggcctggaaggtggccggatgtctgggccccaaaacgggcgctgcctcagaggctctgtggctcctgcctgtctcagaagctgtcagcttctgtggtgcacacactcacctgtgcagactaagttcctaatttcggtggagtcccagaaccaagatggcttctgcctgctcctgaggcaaagggctcctgggccaggcagacacctgtcctctggccggaagggtggccagatc

SEQ ID NO: 932 - DNA, 1000 bp, mus musculus
tccgtgcctctgttgagggacatctgggttctttccagcttctggctattattaataaggctgctatgagtatagtggagcatgtgtccttattacatgttagagcatctataaggtatttgcccagaaatggtgtggctggatcctcaggaagtactatgtccagttttctgaggaactgccaaactgatttccaaagttgtaccagtttgcaatcccaccagctatggaggcgtgttcctctttcctcacaacctcgccagcatcttctgttacctaagtttttgatcttagccattctaactggtgtgaggtggaatctcaggattattttgatttgcatttccctgatgactaaggatgttgaatatttctttaggtgcttctcagccatttgatattcctcagttgagaattctttgtttggctctgtaacccatttttaatagggttaattggttctttggagtctaacttcttcagttctagatactgagggaatgaccatccagagactgccccacctgggcatccatctcatatacaatcaccaaacccagacactatgctaacaagtgcttgctgaaaggagcctaatatggctgtctcctgagaggctctgccagtgcctgacaaatacagaagtggatgctcacagtcattggatggagcacagggtcccccaagaaggagctagagaaaggaccctagaagctgaaggggtttgcagccccataaaaggaacaacaatatgaactaaccagtacccccagaactccctgggactaaaccaccaaccatacagtacacatggtggaactcatggctccagctacatatatagcagaggatggcctagtcagtcaacattgggaggagaggtccttggttctatgaaggctctataccctggtgtagaggaatgacagggccaggaagtaggaatgggtgggttggtgagcaggaggatagggggaggggatatggggttttcagaggg

SEQ ID NO: 933 - DNA, 1400 bp, mus musculus
aatacaggtccgtaacacataaaaacaaagagggttcagggaattccttccctttaggaacagaaaggatggatgagaaggaccaggtgaaaagacatgtgagagacaggggtgtgtcaatggaactcagagaccgaaatggcagtaagaaccttgagaggagagacggagaggaattataggtaggacagagagtccagcatcgttttaccatcctaaaagactcttgaaactgctgattactattaatttattctacacggagaaaatataaataaagattttaaaagtacacacttaaatcaatttgtgttctccttaataagagtaagtatgagtttcacaataaggttgtcttttgctagagccttactgtcgcagcagtcagagacttaagtacaataaagataaatggtgactgggtcagtggatagcttcctaacatgggctgtggaatcaactgagcagcttctcctgcttccctgcatctgaaggactatcctatcagccttttaaatagtaaggttaaatgtggtccacataatatggaagttcatgtttagacctagaagtgttggtggcttatattatagaaaacaaacaaacaaaaaaacctgtgttagctgattttgtgtcagcttgacccaagctagagttatctgaagaaaataaacctcagttgagaaagtgcaactataagattaggctatagagtattcttaaattagtgattgatgggggagggcccagcccactgtgggtgatgccttccatgggctggtagtcctgggttctatgagcaagtagggtgagcaagctgtgatgagaaagccaataagcagagtccctccatggcctctgcatcagctcctgtctccaggttcctcccctctttgaggtcttctcctgacttccttggatgacggatgtaccgtaatatcgaagtgcaagctaaataagtcttttcttctttttgctcctggtactgcatcacaatagaaacactaactaagaaacttgtcttatttagttagccccaaacccaagcctttgatgaagttattttttataactgaaatggaagagttaaactaaccaaatgtggaaaggcaagaaaaatctaggtccttaattatttgtgtactctcataatttgctaaaatatcttatgattggagatttaattaagatattttcagtctcttagtcaattcctgtaaaataaatataatttagcctttttaatttcatatgcctgtgtttactgaacagtgctatcaagtttaaatcctcaaattagtctccagaatgtgtcatagttgttaaaagtatggtagaaaaatgctaagttttatatatttcaactaaatactattgtgtcttcaaatcgtaacaaaggt

SEQ ID NO: 934 - DNA, 1200 bp, mus musculus
attttatatgtcaattaaacttctatttaaaaagaacaagtaaaactataaaatgaaattacaatactttttgtatcatttaaagtgaaaggaaaaagaaagatgaacagacagaagggcagtatgatcaaaatttacgatacacttataaaaaattgtctttatagaacccaatgctatgtacagtgaatggtgaatgcataataataaagacaaattgcaacaagcaaaacatggccagaaaccaaaaagtaagaatagtatatgctacctgattggtggctcagtatctgagagatctcaagggtccaggtaagttgagactgctggtctttctatggggtcaccctcctcctcagcttcttccagcctttacctaattcaaccataggggtccccaccttccgtccattggttgggtataagtatctgaatctgcttctttcagcggcttgttgggcctctcggagggcatccatgccaagctcctgtctgtaagcaaacacagcatcagtaatagggtcaggccttggagccttcccttgagctggatcccaatttgggcctgtcactgaaacccctttccatcagactcttcccatttttgtctctgcagttttttagataggaacaattctgggtcagagtttttgactgtgggatggcaactccaatctcttaacttgatgtcctgtctttctactggcggtggactctgaaagttctctctccccactatagggcatttcatataaggtctctccctttgagttctgagagtctctcacctcccaggtctctgatgcattttggagggtctccccacctcctaccacctgatgttgcctgggttgcctgtttccactctttcttctggccttcagggcttcattccttccctcccacccctaaaatacttggtcatgttcccctttcccctccctgccccctctcctactcaggttccccctccccactgattgctttcttctctcttccaagtgagaatgaggcatcctcacttgagtccttgggtttattaatcttcttgagttctgtggattgtatcctgagtattttgtgctttttggctaatatccacttattagtgagtacatagcatgcatgttcttttgggtctgagttccctcactcaggaatatattttctagttccatccatttgcctaaaaactcattc

SEQ ID NO: 935 - DNA, 1400 bp, mus musculus
cccagtaacacaaacaagacagtcactgtgatgaattaaagtgagccttcatacaaatttcttttatgacttttaaattatttcataatatcaaaaaatgttaatatacatatcatcaaatacagccatcttaatgtataagctattatttttattgttgcttttcaagttataatacatattccctttttgtaaatgaggttcaggttcagttagagaccctgtctcagaaattaaggtagaagatacccaacatccaacatcaacatctgttctctataagtacacacccatctcccccccgtctcaacacatacacacactcacacaaatatatgcatgcccaggagaaaggggagagggagaaatattgtgtattaccaaggaggattaaactgcattttaggggtaaaggttgaaagatggctcagccattaagaaacagtcctggtcctccagaggacctgacctgaattcagttttaagcaccgaggttgttgactgcctaccacctgtcactctggctcaagagaagacaatgccctcttttagcctccatgggcgcctgcactcacaagcacagtaaccacccccacctctgccccacggctgctgccataacacctccctcttctctctgaaatagcaaacagacacttacatgtgaaacaagaacaggtatggtatgctagcattaggaaagtcaataggcagacactagggcttctggccagccaacctagcttacttgctgagctccagaagagcgggagaccagttctcaaaaagcccaaggaggggccagacatggtgatacttctttaatcttaacactggagaggaagaaacaagcagacttctgggagttcaaggctaggcagaggtacagagactctgtctcaaaaacaaaacatcccaggtgggtgatttctaaggactgatacttctggcctccacacgcacacacccacactcacgccaacaaaaaattgaattgtaaatatgcctaaattttaatagaaatgaagcatttatcagtgactgggaaaaaggaagattttttttttttaatgctagagcatctatctacccatctgaattttgtgcaaagagacagtaaccaactcttcataacataaaagttctcccagtctaaagattctaaattaactgacctcattacgtctcactcaccagcgtccaaatcgtattgcttcttgtggtcattaaagagctatataatttggaccctggtcaattttagctaatctacaagagaaaattcaaccttgatcaaactgaccaataggttaaacctttctcaaagattcagtagtgtgcctgctcaaaagtagcactatatatttacaagatacgaactccagaaaaccagatattcc

SEQ ID NO: 936 - DNA, 1000 bp, mus musculus
ttctgttagtaagattcttacgttgtctttcaccatctggtaatttttagagttagttattattgttgtctctgtttagagctttttcttctcatgattctgttagcctctatcagcagacctgggagactagacctctcctgagtttcagtggtcagagcactctctgcaggcaagctctcctattataggaaaggtgcacagatatctggcattcggacctgcctcctggcaaaagatgaaggcccaaaaagggcctgttccagaagctgttagcttctgtagtcagcactctcacctgtccagactagtcttggagggatccaggaaccaagatggttcccccaggttctctggtaaagccctcccgggtggggtggacatctctcctctggcagggaaggtgcccggatgtctggagccctatatgggtcctgcctcagaagctgtcctctagggaccttggggttgtctgccaacttcgtgcccaaggtgacccggtgctggccctgactagaagggattagttaccctggtcaggctgggttttctgcttccctaatgctgtctcatgtcctccatgtttgggttggaacagaagttgtgttccactcacaggtggtcctacaatctcgtggagagtcctctagggaaccttgggggtgtacactgactctgggcccaaggtgacccagtgctggagctgaccagaagggatttgtgaccctggtcagtcgggttttctgcttccctaatgctgtcttaggtcccgtgcgattggattggaccagaagttgtgttccactcaccagaggtcctaagatcatgtggagagtcctctaggggaccttgggggtgtctgccaactctgtgcccaaggtgaccgggtgctggcgctgaccagaagggctagaaatgttgtctagtgctactggtgttcattcataggatggcttgacattgaatttgagcaaggaggtgatagagacttgggtatatc

SEQ ID NO: 937 - DNA, 1000 bp, mus musculus
agtagatggaactagaaaatgtcatcctgagtgaggtaacccagacaaaaaagaacacacatggtatgtactaactagtaagtggatactaacccaaaagttctcaatgcctatgatacaacctacagaccatatagagcatagaaagaagaacaccagggggtggatgcttcagtcctgcattgggggcaggggtgtgattaggacgattgtgggagatggaaggagatggggacaagggagggagaaaggaggtggaggaaataagggtggcagtatcagaatctggaggagatgtgaaagaggtaaagagggtgaataaatcaaataaaaataggtagcagggaagatgaggaactggggatagccattggagggtcccagacaccagagaaatgtgaggctctcaggacccagtgggattgactttagccataatgcacagagaaggggaagatagaacctgtggagaccacctccagtagacagacacaccccctggtcgagggatggggccacccacccatctcaaagtcttttttcccagaaatgtttctgttgaaagaaatgacagggtcaaaaaatggaacagagactgaaggaagggtcaactggggaatggccccacctgggaatacatcatgtctgcagacaccaagcctagcactgttgccatggtcaagaggtgcttgcagacaagaactaagtatggcagttcctggggaggtctggccagcaactgaccaatgcagatgtggatgcttagagccaaacatcagactgaactcagggaacctggtgggggagctggcagaaggactggagaaccagaggtggattgcaacaacattggaagaacaaaatagtctggcctgacaaccctgttgtctcagggactagaccaccaaaaaaggagtgtgcctcgagaaatccatggctccagatacatatgtagcacaggatgccttgcctgatagcaacagtaggggaggcccttggt

SEQ ID NO: 938 - DNA, 1000 bp, mus musculus
aacataatgtttgatctactataacttgtaattgtgagcttaaataaaacttcttttctaaaaaaggataataaaaacaagatagtgtgataccatacaattgacatgcaactaatgatttaagaatatgtttgtggacaagtcccttccggtcggcgccagcactgggtcactttgggtgcggagtcggctgatacccccaaggtcctgagaggactctccacaagatcttaggaccacctgtgagtggaacacaacttctgttccattccagttgcacaggaccagcattagggaagcagaaaacccagcctgaccagggtcacaagtccctttggtcggcgccagcaccaggtcacctgggcaaggagtcagaggacacccccaaggtccctagaggacagcttttgaggcagaccccgtttctgactccagacatccaggcaccttctctgcacaggacagatgtcctcccgcccgggagggcttagccagagcacatgggaaagccatcttgattcccggatcaagactagtctacacaggtgagagtgtggattatagaagctaacagcttctgggacaggccctgtttcaggccttcatcttctgccagaaggcaggtccaaatgccagatacctgtgcaccttgcctgtaagaggagaacttgcccacagacagtgctcagatcactgaaactcaggagagagctagtctcccaggtctgctgatagaggctaacagaatcacgggaggaacaagctctaaccagagacaactataacaactaactccagagattaccagattgcaaaaggcaaacataagaattttactaacagaaaccaagacctctcaccatcatcagaactcagcactcccacctcacccagtcctgggcaccccaacacaccgaaaagctagaacaggacttaaaagcatatctcatgatgatggtacaggacatcaagaaggactttagtaactcactgaaagaaa

SEQ ID NO: 939 - DNA, 1800 bp, mus musculus
gtgtgagacacttctcacagatccgtaaggttgtgcctgtgtagcgaagcaggtgtttgatacttgggagtaggagtacgcttggtcagtacatcactgcctgcttgagtacaatagaccttacatacttgcctgtgatgacttctatgcttctgcaatcacagactttagaatccgtggtgactctattctaattatacacctgctacctcatggaaacaatgtgcagtgggaaccacaagtaagaagccaagctaggtgaccttcaccactggaagctctccagtgcttgtctccagtaggctctagcagacgtaggctcctgaacatctccaatactatcaactaggtgagttgaaagcaaaaggtaagaaaggcttccaaagaagctacgcagcaaagttccgtattgaaaactgtaaagttttcaagatggaaaaaatgttaacatcaaaggcattactttcagtaaaagatgtgctgaagcaaaatagatactttacaaactatttcttttttgtttttacatacaacattacattatttattgacagcatggaaaagtaaatctttatgtgcatctacctgttaagcgtctatcttttggactgcttatggtgagatgtttttctactttgcttttcattgattatattgtattgtattcttatattggggtttttatttgtttgtttgctgaaacattttctttttaattgattaatttatttattcattttatatccagttagtattccccatcacccccacacacagtcctttccctattccttttttctcttctcctctgagaacggggagcctcccctgaccccaccccaggtaccaacccaccctggcacatcaagtcactgcagatctaggcacatcctttcccacttcctgtggtctccacccatgcaagactcacactaaggtctgtccctactgggctacgtctccatggtccagtagcagggatggagatctaaactattttctttactgtgttgctttttctccaggagagctctcaaaactagagttctcacacatttgaattaatagtctttccattttgccaacaaaataaatacaccaaataaaagggatccctaatttcacctgatactgtttaagtacttctgagaagttaaataattctggttcattctctccacatgacaacaacattactactgcaggaaacccatgtgagcaccatagagtcccaaacctttgaaaggtagcattaaaagaactctctatctctacactcattacctgcatttcttgaaaaatacaaacattggactgattagcagaaaaatagcaaacacacggggttaaatgatatcacctgatgaactcctcagatctcctgcataaaccatcctaactcccaacatggttgggagtacctacatgagtcatctggcagaacgggaatataaactgtgcttagagaatgaaatcctccttcagccacataatgggttctttggtgcttttcctcccagtcctttgaatatggacacagtccaaagggcccatcttccagtccaccctctccttgctagtgaacaccattccttctagaagaatattagttctcacaggaagaatgcccatgttcccagaacttccctatgagaccactgggaaacactccatgatctgagactttctcttcgggaccagccctatcctacatgcccaatcctggcatcccagttcctggatttatcattaggggaaaaaaatctttcttcctatatctaaagaagtaataacttaaag

SEQ ID NO: 940 - DNA, 1000 bp, mus musculus
tatggtttagcagtataatatctctgtatcaagagcctggagaatgtttagaataattccattccccttactccacattccctatgtaaagatacaaaagttcacaagtctttctttcttttgaaaatctcagcctagtagagagactggatggtcaggctctaaaagttaaaagttaaaagtttatgttacgaccttgggcgcggagtaggcagacacccccaaccccaggtccttagaggactctccacgccgtcttaagaccacctgtgagtagaacacaacttctgttccattccaatcgtgcgggaccagcattaggaaagcagaaaacctggcctgaccagggtcacaagtcccttcctgtctgcgccagctccaggtcacctgggtgggagtcccaaaggtgtctagaggacagcttctgagacagaccccatttcgggctctagacatctgggcaccttccctgacaaaggacaggtgtcctccccacccaggagggctttgctggagcaactggggaagccatcttggttcctggataactctgagactagtctgggtaggtgagagtgtggactacagaaggtaacagcttctgggacagtccctgtttcagtccttcatcttctgccaggaggcaggtccgaatggaagatatctgtgcaccttccctggaagaggagagcttgcctgcagagagtactcagaccactggaactcaggatagatatagtctccaaggtctgctgatagaggttaacataatcaagagaggaacaagctctaaccacagacaactataacaacttactccagagattaccagatggtgaaaggcaaacataagaatcttactaacagaaaccaagaccactcaccatcatcagaacgcagcactcccacctcaaccagtccggggcacaccaacacacccaaaaacctagacctgaatttaaaagcatatctcatgacatcaagaggacatcaagaagga

SEQ ID NO: 941 - DNA, 1000 bp, mus musculus
agatagagtccacagaattctaaaagttcaacaagctgaagtgtccaagtaaggacacctcagttctacttgggagggagaagaacgcaaccaagagggagagagggaaggagggagggaactcggaggcaaaggggatggaggggagagggaagcatgatctggtatttgttgggggaaaaggactaaagccctgagggccagcagaaagaatagaaacaggaaatctaagaaggtgggaggatgggggactctcaataatgtaccagagacctgggaggtgagagactctcaggacccaaagggagggagctagataaaatgcccaacagtaggcagagggaacttatagatgcccacctccaacaggaagacagggcatcaaaagagggagggggttaccatccctgagtcacaaatgactcataattgttcctgtcttaaagaacttcagggatgaaaatagagagaagactgaagaaaagaaggttcagcaacatgcccaaagtgggatccagctcaaggggaggccccaagacctgacactattactgaggctatggggcactcacaaaaagggacttagcatggctgcactctgaaagacccaacaagcagctgaaaaagtctgatgcagatatttgcacccatccaatggacaaaggttgctaacccctgtgattgaattaggggaaagttggaaggagctgaggaggagagaaaccctgtaggaagatcagcagtctcaattaacctggaccccaggcctataagaccaccaacagggcagcatatatcaactgatatgaagctcccaacatatatacagcaggatttccaggtctggatttagtcagagaaaatgtacctaaacctcaagagacaggaagccctagggagtttagaggtctggtggggttggggatggagggcagggacaccctcgtggagacagtggtacagggaggagttatgggatatggaataggaggagcatgga

SEQ ID NO: 942 - DNA, 1200 bp, mus musculus
ggaaggtggccggttgtctggagccgaagatgttgccgcctcagaagctctgtggctctcgcctgtcccagaaactgctggcctctgtattccacaccgtcacccgtgcagcctgccctccgcggagtccaggagccaaggaggctcccgccagggcctgaggcacaaacctctcgggccgggcggacccctaagttatctttttaaaattaagacaattttagcatagaaaaatttagctccaaattattggtgttttgattattctacaataacggatacaaagatgacttttaaatacctaaatagtcttggtcaaggcaatgtcatcagggaagagtacacaatgtgaattggaagagtccttgaggaatattataacgaggagtagtgtgggaacagagaacctaggaaaggagataagggaaccagggctgtgaagaggtaagagcttaaagaagcagctgagttaggtctcaacagagagaacttgggacagtgaagatagagacaaagtcactgttcccacaggaattgaggagagtggtgccatcagaacccagtccagcaccctattgatagtatcacactcactgaatgactcacctctgtgttccagaacagagctctcaaaagctctaatcacaacatttaaaacagtgatgatatggagcaggtgtgtgctgcctgagggcccttagcattaaactcatcatggatgagcatgtgttcagttatctgtggacaatgctaaatgaccagtacagctttgcatccttctaaggttgctgttcttgtctattccagtctcgaatgtcagcttctcctgtctactcatggctccactctttcctgactgtgaaacctcagacaattatttcatctcctctattcactttccttaagtactgtcttagttagggttttattgctgtgaacagacaccatgaccaaggcaagtcttataaaaacaacatttaattggggctggcttacaggttcagaggttaagtccattatcatcaaggtaggagcatggcagtatatattcaggcatggtgcaggcagagctgagagttctacatcttcatccaaaagctgctagtggaagactgacttccagacaactaggatgaggatcttaagcccatgcccacagtgacacacctatcccaacaaggccacacctccaaatggtgc

SEQ ID NO: 943 - DNA, 1400 bp, mus musculus
ctgttttatcgaagcagtagataccctgcatcaatagataccctaagacaggaagtaaaatcatttaagtgactgtaagtctaggacagttgacttagttctcagttctgtcaggtaagctgcaactcaagtctccattctttcactggtgctagcttttcactctccatctttcttgttattgttttcctttcttcttccattctgaaaatctgcttgggtttctgaatttgccaagcaggatgctgggcagcagaaatggaaggaggcactagaaccagatcttggcctcatgacactttcagaaaagcggatgtgttatcactggtggtagaggttgtactgattgagcattgctgtgagacaagtctatccaagtctaatagcttaagttgtatttgttgtggtaccatctctggggattagaaatccaaatgagacttagctcagttaatgtcagaaagctacactcaagttactgacctgagcagttggcatctcaagccttagccaggaaagacccagttccaaattcactaggatgctggcatgccttggctcctctctggctcttggccagagttgtctctcaatacctgctgtatgaacctgtctttggagtcaaaagggagagtcaacaagaaggaagccaatcttctgtggcacagtctactattgcacacttcttctcaactcaatcagctaagagcaagtcactgagttcaggcctccacactcagagggaggagataacacaaaggatctctcctctgggaggccaggaactaaggatatgttagaggcttcctactgtggagtcactgatgtctctaagagcatttaagactcaaatcaactaggccaaaatcagcaagctaaaaacatcaaccatcacttccataagatatagtgaggaaggtgataaaccacagggggattagaaggaagaccaaagataaaataaaaatctcattgttcctgggtttcttatgtttgcccaaaggggcatctgtgtctctaaagaaaactaaaatgaccttatcaattcagtataactaagaatatccccaccccaaacaaaaactagatgagtgccagtaaggtaagaaaattattcttccttgattctaggaaaacaaaggtactataatgtgtaatgtacctaacttaactgggtatgtttgtattcaatttcctacccataaaacttgtgaccttatgcatactataagatccaaatgaaagatatccatttaataatttatgctcagttaatattcagtttctgtgccaatgagagatcaaaggcatccccagctggctgccttggtaccatgcatttgaatggtaccaaggcatggatggatattcagtatctatcgagtttggtgcatagaagc

SEQ ID NO: 944 - DNA, 1000 bp, mus musculus
agttattaaagttcttcttgatgtcctctaccatcatcatgagatatgcttttaaatccgggtctagcttttcggttgtgttggggtgcccaggactaggtggcgtgggagtgctgcgttctgatgatggtaagtggtcttgatttctgttagtaggattcttacgtttgcctttcaccatctggtattctctggagctgtgcaggatacactcggaggggtcctggaaccaagatgtctgtgcagggtacactaggcagggtcccggaactaagatgtctgctgccaatgctcaggcaaagcactcccgcgctgggcagatcccaatcctcagaattcttaagctcgcatggctggtgttgtgggtatctgggggtagtcagccaactgtgcgccctagctaccccggtgctgctgggactggaaagggcttgtgcccctactctgacagggttttctgcttccctgactaatgcagtctcaagtccctcgcgattggattggagcagatgctgtgttccactcaccagaagtcttaagatcgttcggagggtgttgtgggtagctggcggtagtcagaggactgtgcgccctagctacccccgaccatgactcttaataaacagtttttatgttgtgttgagcaagacgttaaaggaaaggaatatattagtaagcttccctaaaattaaacagatattgtcatctcaggacaatggtggtgcacacctttgatctcagcatgaagaagcagagactggtggagctctgagtttgagggcagcctggtctacaaattgagttccaggatggccttgagctacaaagagaaacgctgtctagaaaaacaaagcactttccggttaggtactgattctatttatttttaattttagaaataattattggtctttattggaatattcttgttattttaactctgagcttatgtgtaaataaatttaaattttagcagtgaattaaatgttacttcaatgac

SEQ ID NO: 945 - DNA, 1000 bp, mus musculus
aatctgctgggcgtggtgatgcacacctttaatcccagcactctcgagttagagtcaggtggatcttggtgagtttgaagcaagcttggtctacaaagtgaactccaggccagccagggccacgtagtctctgtgtgttctctgattgaaagtctttcaaagccccagtagtgtgtgatttcagatgctaatattaatagtgcagttagtctgtgtgtgaagactttgacagtggtgtgttcctgtatctggaaactgcagcatgcagtctattcagaacctcgggctggccgtcatcgctatccttgctggcatgatcctggactcgaagggatacttgctgctggaggtgttcttcattgcctgtgtttcttgtgagtgtgccccgtggcagcgttgggtttcttacaacagattcaagtgttgatgtttttacagttgggctttgtcatactgctgaaactaaactagacagtgtgcctcagcaggtaagggtgggaagccaggctctgccttggtcgctgaagtagctctcggcttctaggaagctaagggtaaagttctgattttgttcatttgtaaaggcacatggttttctcagatagaaatccctgcagaactacttcttagaaatgacaaactggccaggtgctgccaattctggggataagaagagaggaagaagggtcagggcgggtgctggttgggggtgtcttggctcccactcctatagggctattctgccactcctgggctaagaagcagtggtttcctagggggaaaaaacgctgtggcactccagggctcccagaagcaaagatgaacagtgtgttttagattccgattaagaggggtttggtctgtgcttgcgtttgatgcgtcggtgtcacttacaagcgtgccttgtgtttcagtgtcactgctggctgtggtctgtctgtacttggtgaaccgtgcccaaggtaagcacttacctttctttctttgtctcaggtgggcc

SEQ ID NO: 946 - DNA, 1000 bp, mus musculus
ggtcacttaattagttctcagcacatttctgtccttatgggtcggctaaaccaactgtggtggcacacgcctatcctcctggccctcaggagccagaggcagaggacgatgaatatgaggccaggctgggctacagtgaaaaatcctgtattgagcaggaagaaagaaagaaaaaaagacacagggaacaaaacaaccaaaattaattaaatgtcaattacccactcataataacaaaatgtccccatgaacttatttcattaattttttaagcccatgagacacagattcaaagaaaagtgagatataactcaggaataggagaggttcccagaaaggattactctcttcagtaattttaaatcagtaataactaagaattcaagagcagtactaaagtgtagttactctactggcaatgcaaggttcctcaaaacaccatcaaaagcatctgcactgactctctagggagaacatctgtgccctgtccttagctgacaggagcaaaggagaagggctcaatagcacacgagaggtctgcactaatgaaaagcttctttataacatgtatcccgaatagactgcccaacacctgtattttaaagacttgttaagtaaactttagaaacacgtgcgagtagctcttgtttctagaacattaaaatttacaattttccccgggagcactttgcctgagcatctgcagcagacatcttggttccgggaccccgccgagagtattctgcacaggtgagagtgtagaatacagaagctaacagcttctggggcaggccaaagcaactcagcctcgggacaggccctgttttgggccttcgtcttcggccaggagggaggtcctaacgccagatatctgtgcaccttccctgtaagaggagagtttgcctgcagagagtgctctaactactgaaactcagaggagagatctagtctcccaggtctgctgatagaggctaacagaatcacctgaggaacaagctct

SEQ ID NO: 947 - DNA, 1200 bp, mus musculus
tgagatgcttctgattttaaaattatgaagtgatcatagtatgtattcatatcaaaacactcatgatatttgcaatgggcattcatgtacagctatattctttgctacagctatattcaaggctctaggatccttgtagttaataatttcttaaatattttatggccaatatatgttttctttgaaaatccacacattataaacaataatgtgtaaaacaaagacatctctgtactaaaatccattcaaaatagatctctacctaatatagatactgacagtaaacaagggatgaatacagcaaacattttaactaatgttttcatccttggggatggaccctggctctacatatgttagacaaatgctctgtgagtgagccattcgcagagctactagttcactttgtgtgtgcacctgtatgcacctgtgtgcatgcaggcaggcaccaactctattagctcaccagatatgtaggtcccaaggcaatctcaggttagcccttctgccttgtttgagaaaggaaccctgtgctctacagagctgctaccccaggttagctgctaccccaggttagctggcctacaccaggttggctgctacaccaggttagctgctacaccaggttggctggcctacagacctcagaggctctccttctgcagctcccactcaccagagactggaacgacagatggctggccactactgtactcagctcactcggggtctgaactctgatcctcacatttgtgtgacaagcgttttgttcaggaagcaatctctcccacccctaactcacctttgatgggcattttatttcaaattattcattgttgttgtactttgcggggagcaggggaagagatgtgagacagggtctttctatgggacagacagggtaccctggctgtcctgaactttttgtgtagatcaggttggcctcaaactcagagagatccatgtgcctttgtctcgaaagtgctgcgattaaaggcatgtgcgtgtctggctcttattcgctgtttttaaaagtgtctacaatgtacatttgtctctgtctacttattttaaaatatactttctagaatcataacttcaggatcaaagagcacataccttttaaaatgaaattaatgggtgtatactacacctatatttgtatttctaatgaataaaaaaagtacacactctaatact

SEQ ID NO: 948 - DNA, 1000 bp, mus musculus
tagtaagaatatttatccagaattaaaataaaggattgtgtaaagaggggttgagagcagcagtgagttggaggaagatcatctcccggtaggacctatagtgcagccatatctccaggtcacgctcaggctggcgctcacgtgtgggtttcatcagtgtgggaacgatgctttttactgccaggaggtttgtagacgacaatctcactgaaagccgagggcagcacaaagtcaggtttctgcactgggatgctggacttctcacctcaatttaagagaagttttatccgagctctggaccatctaagagtgagtcgctgtctgctgtttcagtcataatgagccgaaattgtgtctctgtcactccagggtggagaggactcttccacagccctgtggagcttgcaatctgtgattgcttcgtaacaggttgagtgtgcacgtcactgtgttaattacgcagtgtcctatgtgcgttggacagcatagaacacaacacgtgggacctaacttgcaaggattgggtcttcaacttcaagtgcaatgtgtatgaaaaccaatctgagccttgtattctcgtaaatatttattttgtaatttttgttaccgcacgagctgttccggagaagggttctcgggtcatttcagaggtgcgtggaggcacactcagcaatactgtgtcagccgtgacatccctcagtcataccctccactgcacactagtcctctgacatactccagctttgtaagttcagtgatttttacttacacatttaccatttttgtattccaaaatgtgtttgttttaagttatatggaactgacctcctgatgcagtccttggtccccaggcggggcagaagctctgtgcctgtggacacctgggtttgggttaaccctcgaagggctcctcatagggggttgcttttttttttttttttttttttggagggaaatgtttgaagtaaacctttgttttctgaaactaccttggctaaaa

SEQ ID NO: 949 - DNA, 1400 bp, mus musculus
atctaatttgatattggctattggcttgctatatcttgcttttattatgtttaggtatgtgccttgaatccatgacctctccaagacttttaatatgaaggcatattggatttgttgaaggcattttcagcatctaatgagatgagcaggtgattttcttctctgagtttgtttatattacactgatgaattttcatatattaaaccattcctgcatcgctgaaatgcagcatactagattgcagtgaatggtgcatttgatgagttcttggatttggtttgtgcgaataattttattgagtattttggtgttgatgttcataagtgaaatcgttctgaagttctctttcgttgttgggtctctgtgtggtttaagtatcagggtgactgtgacctcatggaataaattaggcagtgttccttctgtttctgttttgtggagtagtttgatgtgggtctgtgtactggaggctttccgtggagatttctggcccagccaggtgcaagggttcaggcaaaggggagagaatatgatcagggagggaaagtcccctcccctgtctcaactgctgcagctgctttgacctctgccattgcctcctgaattggtccaagatgctgcactggttgccctgcaccaggtgccctgcactgagctcataaaagtcctactagccagtgaggagtgatggggagcttccggctgtgtttcaggagagaagatctcttcccaagcagcagtggtacagctcttatgacagaagctctcagacgacagagtaattctcacaccttcgttccttccagataggattcttatatgcagttttggggtgggtcaggggctgagagcagatactccttatctgaggtcttggggataccttatctgcatgtgggagggcttggtgctgctcctaagtgactgatggccacagacctttctacagggtgctatgggaggctatagctatgtgacaagtgccacaggcccaggagagtggcaaaaacaccctctgtcccttcagggtcattgtgttttcaaccaggaaccaggctggctctcacagcccactgccccacagtttgaggagtattgtcactagctcttctttcaaagtctggtagaattctgcactaacatcatttggccctgcactttttgagggctgggaagtttttaatcatcgcttttatttctttatatggtttatgggactgcttagatggtttacctagtcttggtttaacttttgtatgtggtatctttggtttatatttttcagttttgttgagtgcaaacatttgaagtaagagctaataattttttgaatttcctaaatttctgttatgtttcccttttcatttctgattttgttaatttggatactgtctctgta

SEQ ID NO: 950 - DNA, 1000 bp, mus musculus
gcctgcaaaaacctgtttcctatcaagttatatttagagtttcttatcgtagttctttttatcataaaaggcatgctggaaaagctgtgcacagctttgagatcatactagagagaaatttaatttgacatatactttatagtgaacacatatgtgaaaagatttttatcatttctgtgtatagttataaatagtcttgtattgctagtaaataagtcattagactgtttggataaatttgagctagtggtactactgaaaataaacttggattaaacccctgcttatacatgtgttccttatgttaacacacacacacacacacacacacacacacacacacacacacagagagagagagagagagagagagagagagagagagagagagagagagagagagagagagagagatattgagattaagcatcattcctttaaagctttcgtgttttatttacagaatccatctgtcttaggtagggttttactgctataaacagatatcatgaccaaggcaagtctcataaaggataacacttaattggggctggctgacaggttcagaggttcagttcattatactcaaggtggcagcatggcataatccaagcaggcatggttcaggagccgacgggtggtctacatcttcacctgaaggctgccagcagagtactggcttccaggcagctaggatgagggtcttaaagcccacactcacagtgacatacctatcccaacaaaggccacacttactccaacagggccacaacttctaatagtgccactccctgggccaaacgtatacaaaccataataccattgtcttgtgttgtatacagagtttcctgtttctccaaccactctagtgactgtatctttagaggcctcgtgcagatctttacttggtacactctctaatatttcttaatagttatatttcatatctctttatttatgaagagtcaatattttagtacctatttcaatatgtagagta

SEQ ID NO: 951 - DNA, 1200 bp, mus musculus
agggagaaagttggcagccttctctagtccctgattttagtaggattgcttccagcttctcaccatttactttggtgctggctactggtttgctgtagattgcttttattatgtttaggtatgggtcttgaattcctgatctttccaagacttttatcatgaatgggtgttggattttgtcaaatgctttctatgcatctaaggagatggtcatgtgggttttgtctttgagtttgtttatataatggattacattgatagatttccttatattaaaccctccctacatccctggaatgaaacttacttggtcatgaaggatgattgttttgatgtttccttgaattcggtaggaaaaaattttttcataggtatataaactatttattaacagcaaaggcccagagactcatttcttcttggatacacccacagttcggcccctgcagccagtggtcttggtgtgctgactgcagacaagaaggctccaaaagtggcacggccctctatgggctcaaattttttttcagccgctccagttcctcatgcagcttgttgtctagacctttggccagaacctggatgtacttcctatccttcaaatccttaagtctgttcaggaaccagtctggaatcttgtactgtcgtgggttctgcatgatggtggtcactcactccacctcatcctccgtgagttctccagccctctttttaaggttgatgtctgctttcctcaataccacatgagcatagctccgccccacacccttaatggcagtgatggtgaaggctattttccaccgcccatcgatgttggtgttgactactcacaaaatgtgctggaacttctcagggatcactagagacatggtggcagcacagatggcagcatgtaggcctcctgtcggttagcaagtattttattgaggatttttgcatcgatattcataagggaaattggtctgaagttctctatctttgttgggtctttctgtggtttaggtatcggagtaattgtcacttcatagaatgagttgggtagagtacattctacttctattttgtggaatagtttatgaagaactggaattagatcttctttgaaggtctgatagaactctgcaataaacccatctggtcctgggcttttttgggttgggagactattaatgactgcttctatttctttaggggatatag

SEQ ID NO: 952 - DNA, 1600 bp, mus musculus
catattatatgttcaacaaagttaattttcataattattaccctttggtgacataattaattgtggagtcattcagatagtagttcagacaataaatttgtacattaggttgatatcacataaaaaaactgatcatataattcaggtaatgttatctaagaccatggtggtggcccagcctatactacaacctggagccagatctcagtctatggccctgtagcagcaagggtctgttactaccaaaggtcaggctgatgttgcagttgctggccagggacattctgatgtctgaaggctgagggctgtgcaaactggcctcattgctcacctggccaacctggagagagctgatcctggggacacgagagcaagagctctaaccctgatcctagccagctgcagtagtggggagagccccataccttgtgggtgttgtaggtaagctgaccccagggtgtgagcatgggggaactggccctgctactcatttctggtgtagtgggatttgggggtatgactgagggatagcaggccctatcaattgtctttcacgactttgcatgagcaagggagagatgccccaaccgttatcctttgccaactatggcaggctgaaatactggcttcgaagtcatagaagtgagatagatggccctgctcctcacctaggcaacacaatagaactgatcttgatggcatggagtacagttgactccagaaggtgagagtgtgggagacctagcctagcaacctctctgctgcagtacaaggaaaggagagataccctccccgaaccctgacacttaaccacgtacagcagtgggcagagcgaggcctcaggtcatgagtacaggagggctagctcaccatgcctcttgtgttctataaggtggacgctgccttcctctactccctcatcctttgcacttataacaggcagaagagctggctctgaggtcaggagagtgggagatctggccctgtctcacaccatctgcaactttttggagagcaagccctgcactttgcttgggcagtagagtagagttggccctggttgtgggaattgttggtgagctggtccaagggcatgagagtgggagagctggcaggttgagcagcttagatacctctctggtttctaagacctctctgagcagagacctgggctttgaattggcccaccccaatatctactccactgttgaactgctagagtgcataaagcttgccctatggatctaaaactacagcctctccatgaaacaaggtaaaaaacaggataccaagaagtgccccagtgaggctccaataatgatagagtagcagaagccagaggccttgtaccaggctgagtcattgcaatgaacatttacaagcaaaaatagtgtagaaaaatggtatcctgtaggacacactgtgacacactacagcttccacaaccagatgtttttatctgttttgggagatgctgtaagtgtaaagcgttcataagaggggaaggtggatgaatgggacttgggcgccaatatgaaattcacaaagaaccaataaaaagcttaaaaaatgcaaaatttccatgggctcaaatctatat

SEQ ID NO: 953 - DNA, 1400 bp, mus musculus
ttttcattgacttaaaataacagattttaatatatatgatatttaaccaatcatgtatagtttacttaaagttatgaccatgattaattttttttatcattcttccacttcctcttccattgtcaaccctttttcttcttctttttaaatttatttatttatttttttgtttacactccacatattattttcctcctgatccaccttccaactcttccacatcccatgcctcctttcccaaccctgtttccacaaggatgtctcagccctccccagcccttaccccaccagacatctaaactccctggggtcttcagtctctggaggttggttaggtgcatcttctctgactgaccagcagtcctctgctgtatatgcattggtgtcctcatatcagcagatgtattctgcctgtttggtggtccagtgtttgagagatcccagggttccaggttaattgagattactggtcctcttacagggtattcctcctcctcagtttcttccagctttcagctaattcagccacaggactcagcagcttctgtccattggttgggtgcaaatatttgcatctgactctttcagcttcttgttgggtctttctgtagcagtcatgataggttttttgtttgtttgtttgtttgtttgtttgtttgttagcctataggctcattaatagtgtcaggccttggggcctccccttgagctgaatcccaacttggacctgttgctgaaccttcttttcctcaggatcctctccatttccatccctatagttctttcagacaggaacaataatgggtcagagtttttgactgtgggaaggcaaccccttccctcacttggtgccttgtctttcagctagaggtgggttctataagttccctcgccctactgtcaggcatttcatctaaggtctctccttttgagtcctgagagtctcttaacttccaggtccctgatacattctcaggggtgcccccaacctcctatctcccaaggttgcctctttccattcatttctgctggccctcagggcttcggtccttttttcccaactgatacctcatcatattccactcttcacctcctttccgctttcccacaaggatctctcccttccttcccagtcctgtgattgatttcttctcccttccaggtgagaatgagatatcctcacttggacccttcagcttgtcaaactttttgagttcagtggactgttatactgggtattctttacttgtttgtttgtttatttgtttttgactaatatctacttcttagtgagtacataccgtgcatgccattttgggcctgagttacatcactcaggatattttttattgggtattttatttattaacatttcaaatgttattccctttcccagttcc

SEQ ID NO: 954 - DNA, 1400 bp, mus musculus
ccaaacttataatacacacttaaagcagtgctaggaggaaaaatcatagtactaagttcctttatgaaaaaattagagagatctcaaactttcctcttaatgggacatgtaaaagctgtagaaaaaaaatggaagcaaacacaaccaacaggagtaggtagcagtaaattagcaaactcagggctgaaatcaatcacttgaaaaacaaagaaaacaataaagaagaatcatcaaaagtaagagctgcctctttaaaatataaacattattgctgggaagtggtagcacatgcttttaatcccagcacttgggaggcagaagcaggtgaatttctgaattcaaggctagcctgttctacagagtgaggtccagaacagcaagagctatatagagaaatgctgtctcaaaaaaaatatatatatatatataaataaaaataaaaaatatagacaaactcctagccaaactaactaaaagacagagagagtacttaaattaacaaaatcagaaattaaaggaggatgtatgggacaatttcagtgtggacactttgtcccttcttaaaattgggaacaaaacacccatggaaggagttacaaagacaaagattggagctgagacaaaaggacagaccagactggagttcctggcccggggagtctccagacacctgcaaggacccacacaggatccccagggatcctaagacctctggtgagtggaacacagtgcctgctccaatccaatcgagcaggacctgagactgcattaactagggaagcagataacccagcctaatccggggcacaaatcccttccagtccactgcagcacctgaattccttgcccgctgagtctctggacacctgcaaggacccacacaggatcccacacaggatcctaagacttctgatgagtggaacagtgtctgctccaagccaatctctcgggacttaagactgcattaattaaggaagtatataacccagcatgatcagtggcacaagtcccttccagttcactgcagcacctgggttccttgtgcacagagtttctgaacacccccaaggtcctcacaggactctccacaggatcttaagatttctggtgagtggaacacaacttctgccaggaggcaggtttgaacaccagatatctgagcaccttccctgcaagaggagagcatgcctgcagagagtactctgaccactgaaactaaggagagagctactgtcccaggtctgctgatagaggctaacagaatcacctgaggaacgagctctaaccagagacaactataacaactagctccagagaaaaccagatgacgaaaggcaaacataagaatcctactaacactcgagccccgggctaccttgccagcagagtcttgcccaaca

SEQ ID NO: 955 - DNA, 1400 bp, mus musculus
aattctcaactggggaataccaaatggctgagaagcacataaaaaaaaatgttcaacatacttcgtcatcaggaaaatgcaaatcaaaacaacccgagatttcacctcacaccagtcagaatggctaagatcataaactcaggtaacagcagatgctggcaaggatgtggagaaagaggacactcctccatagctggtggggtcaaactgatacaaccactctgtaaatcagtttggcgttcctcagaaaattggacatagtactgcctgaggacctagcaataccactcctgggaatatatatacccagaagatgctccaatttgtaataaggacacatgctccattctgttcatagcaaccttatttataatagccagaagctggaaagaacccagatgtccctcaacagagaaacaggtacagaaatgtgaagcatttacacaatggagtactactcagctattcagcagatggtcccatggaccccagaggactcccatgcaccagacaccccagcacgaccaggatcataggatcactggcgagtagaacacaacatctgtttcaaaccaatcctgcaagcctgtgccagcagcagggaaacaagagaccctgaccagggtctcacgtcccttttggtcagcaccatctcctggccaccttgggcacaaactcagcagaaggtcccgaggtctccagaggactttcaaaccaatcttaatggacctgtgacagtaggagcaaggacacaggatcccagtctggccagtgactcaggcatgggttccttctgatcagtgctaatataccttggttttgaacactagagagccccatggtgcccagaggagacaccacttccaggtgttgtaacatgcccaggatcttaggattccaagatcccagaataccaggagcttggtcacacaaggatctcagggtctcagaggaagtttgactgcaaagaattctgacacacccagaatcttagattcacaggatactggaatcacaggataacaaagaaaggaggactatgaggagtcctgaatcaaccaggattataggaaggacaggctccaatcagttatattgagggcagcaagcacttgagaaaatcagatggcaagaggcaagcataagaagagaagcaaaagaaaccaagtttacttggcatcatcagaactaaactctcccaccatagtaagtcctggatacaccatcacaccagaaaagcaagataaagatctaaaacttctcatgatgatgatggagtactttaagaaggaaataaacaactcccttaaagaaatacaggagaacacaagtaaatagctagaagcccttaaagaggaaacacaaaattcccttaaagagttacaggaaaacattaccaa

SEQ ID NO: 956 - DNA, 1000 bp, mus musculus
actatcgtattaaacttagtaaagtaaatatattaaaatcttaacgcaagaattcaataattaattttaacttagtattttttttcaatcctttagttaaaatctagagacttctgagtgctaggaataatactttatcactgaaggaaatcctgaagcattaaatttggtatttactttaaaaaaaaatccttcagatctgtgactgtgccctgttcagaccttgagtgcttgttctggacccagtctcagaacacccagagcaagctcaactctccggtgctctaatatgctcaggatcagaggtgaggaggccacaacatctgccccaataccaggagtaactggaaccagtgtgatccagagatccaggaaccccacgtggccagtggcactggttccatccttctggggagaaccctgagcagaccttgagcatgaacactgcagccagtctcaggacacccagaggaaactcccaagtgctctaacactctcaggatcataggaaaacaggatccgaggagctcagacacaccagaatctcaggatcccagaggcagcttaattcccaggagcctgacacatccaggttatcaggatcataggatcccaggattacaggatcacaaagacagctggactctgaggagttctgacccaccaggatcacaggagggatgggctccagtcagagacagtgaaggcagatagcactagagataaccagatggcgagaggcaaagataagtacataagcaacagaaaccaaggttacttgctgtcatcagaactcaattctccaaccataacaagccctggatacactatgacactggaaaagcaagattcagatctagtatcacttctcatgatgatgatgatagaggactttaagaaggatataaataacccccttaaaacattgcaggagaaagctggacatggtggtgcacgccttgaatcctagcacttgggaggcagaggcaggcagatttct

SEQ ID NO: 957 - DNA, 1600 bp, mus musculus
gcagaacaaaaatgaccacacgctaccccatcccattttatatgtatagaaaataatccttacacctaaggctcattcagagaacatcacagaggattgggggaaagatgataagaagcagatggccaggaagtctgattcaatatttttcttttttagatatgacagggaagctacacctttgtaattgaggaaaatacgtaataaaaaaaaatttcaataatatggttgccaaaacatgacctgaaaattgagagtaccccttaaaccaccaacataaattggctttagtctaagatgaagagatacaggaaattaatgactcttgagaggaaaataatcttatttagtaatgaagaccctgactagttatctatcaccaggtggtcagctctagaatcatgcattctggtaacactgaatatatttcttaagttgtatttttatttttttacatgtgtgtgtgtttgtgtgtgtgtgtgtaaaatattaaataagaggaggccataatttgagacagagtgagggagcataggaaagtttatttttaattaaaaacatactttaattaagcaaagcaaaactctcttgagaaaaagcttattattttcaataaaacaacttaattttgtcatttataatgtaaatggtgtttctaaattttaaatattttagtgtcaaaagtaaatgattattgtgggaagccgcaaacgccattacaagatggcgctggctaccactggccaccgcccatgataatgggtaaacaaccaatgtgcgcatgtgcataagagttttttgccgagtcactgcctggcccgatgtatattaatgaggtactggtagcataaccaatcagttatggacacgtcactcctaggcctatataagcagcgccatttctgggctcagggtctttttgcctctgtaattgagctctcccaataaacatgtacagaaggatcctattgtggcatcgttcttgctggcgagtcgggcgcacacagattatggatttcaaattctttatatgagatattttctttcctttctagcagaaattttggttaggaaaaagttcattcacataaattatatgaataaaataataagtcagttgcttcaatgtgtatttaccaggatattatttcataatactttgtggacttcattgatatttatatatttattctttgatcaaggatagcaatgctttatgatagtgattcttgaaagctacattgaattttcctcttgattttaaaataatatcgtataattgatttgtagcacaaaaatatggtcattcataagcctgtatggatttggtaattcatacgcagtgtaaccattgtgtttattttccacttcttataagtagcatttatggagagtgtgaaacagctacttagaatgtatgtagacttcatttactaggatgaaacatatgcagatattatctatagcttacatattttgagacaaaatgaatcctattttaaggttaagcattagtagggctctgtcaatacaattacaagatatataataaaatacttgttaaatccttacagacttgaactttaaatttttatataaa

SEQ ID NO: 958 - DNA, 1200 bp, mus musculus
gtacatgaagcctagtgaggagggatgtgaaaaatgcaaagagaaatcacaatggaaagtacaatgcttgaggcatcaagaccccagaaacagtaggaagagtataccaatgggttaagcaatactaaatagtcatcccagagaagatgaccataagagaaacattgtgtagactttgtaggtcatatttatatatttaggaatatatataaaggcttatgcaaaaaagaaaaaaatgagcgcataaattttaaagatagcatggtggaagtaaggttcatggaaaggtttgagaggaaagagagaggaaaatatgtaaacattacaagtcattcatcccaaattattgagcctctggcattatgtgataaatagtccctttctcataataacatagactgttcataagcagtagcacctgaggttgacctatgccccccaaatgcaaacacaactgcatatatccatgtaccacttcacatacaaacttttacacacatctgcacatacacacatataaaattaaaagtttaaacgtcaagcaaatttattttgcttgaatgatatgaatacaacagcatttcaatattaaaaccaatacacattatgcatatgcatcgaacataagttaactgcaatatttttcagctctttaaaaaatgtatagctgtctcctgagagtctctgccagagactgacatacacagagacagatgctggtagccaaccatagaactcccccaatggaggagttaaagaaaggactaaggagctgaacaggtttgcaaccccttaggaagaacaacaatatcaactaacaagagctcccagagctcccagggactaaaccaccaaccaaggagtacacatggacggacccatggctccagccgtatatgtagcagaagatggctttgttgggcatcaatgggaggaaaggccctaggtcctctaatggatcgatgctgatgtcccagtgtaggggaatgcgagagtggggaggcagaactgggtgggtgggtggaggaacactctcataaaagcaggaggaggggggatgggataaggggtttctcaggggggatttggaatggggataacatttgaaatgtaaataaataacacatccatttaaaaatgtatagtgaatgtatactttgtttcccagaattttaaattaattaacatttgtaaaagcaa

SEQ ID NO: 959 - DNA, 1000 bp, mus musculus
agctccagaatgggcaaagatttttaccagctacatctatgatagagagctatatcaaaaatataaaaagaattttattagtcagacatcaagaaaactaagaactgaattaaacatggggtatcaatctgaacagggtgttctcagaagataaaacacaaaagggtgagaaacagttatagaaatgtttaatattctactcatcagagaaatgcaaatcaaaactattttcagatttcatcttaaaccagtcagaatggccaaaatcaataaaacaaatgttggtgcaagctggcaaagatgtgggtgtaaagtaaataattattcaatgttgatggaagtgaaaacttgcattgccactatggaaattagtgtggcagttcctccggatatctatctatcttcagatctagctacaccacacttgggcacatacccccaaaaaccttatttcaaacataaggcaagatggaatgtaaaaaaaaaaatatttaaaagtttattatagagaataactactgcctttaaatatattcttttacattaaacttttttttccatttttattaggtatttagctcatttacatttccaatgctataccaaaagtcccccatacccacccacccccactccctacccacccactccccctttttggccctggcgttcccctgtactgggtcatataaagtttgcaagtccaatgggcctctctttccagtgatggccgactaggccgtcttttgatacattgcagctagagtcaagagctccggggtactggatagttcatgttgttccacctatagggttgcagatccctttagctccttggatactttctctagctcctccattgggagccctgtgatccatccattagctgactgtgagcatccacttctgtgtttgctaggccccggcatagtctcacaggagacagctacatctgggtcctttcgataaaatcttgctagtgtatgcaatggtgtcagcg

SEQ ID NO: 960 - DNA, 1400 bp, mus musculus
ggtagtcattagtcctcttaaggagtcttctctttgccacagacagagaccactgcagaaaaccaaaatataaaaaataaaaatcattctaagatttattaatatatgtttgttgttttgtgtatattgcttgactctccccccctctctctgtttgtgtgtgtgtgtgtgtgtgtgtgtgtgtgtgtgtgtgtgtgtgtgtggtatgtttagaacataactcgcaactgaaaggaaatctgtttgggagcttgcaatgttgttaggttgaagcccacctccttttaaacagtttcctgttgtaacatgattttgtggtaagcttgatataaccttctctaacctttgtgtttacagccatgcatacttctagattcaggttaccttgaacagctaaaaactgcatttccatcaaggaaatgttgacaaaaccttcgttgagaaacactacatcagtaatatttgcccacaacaaccactaaaatgtgaaaaaacatccagctgcccacagtgcctagagcttccagggctattgttctgtaagtgtagatgaatctaaagtcctgacaggcgccaaaccaaaactgagatggatacaactgcagtgttgccaggctccttcttgtggctggacagcttgtcaaagccttccgtctgcaacaagccagagcagagaacaggaagaaatggataagaaagcacaagtgatttttggtacccaatgttgaaattgcagactagacatccgggaggaatgcttaccactattgatttgttagcttggacaggacaacaaagtcatttggtgttttgtaacgctactcaatgagaaagcacagtgagcccatggacagatcctcttcagaagtcaatagtgttaagagagaagacattgccataacctttggtatgctgcgtgagaaagctatagacactgcgaattcttcttcaggttacctttaaatctttatgctgttgctcacttggataatttataagatcccccctcctttttttttaattctttacttgccattgcaaggaagagaaaatgttatagatcacattttctgaataatctgaaatgttttggttgggatggctacagaaaagctttagaattacctttactttggcactgaagatgcaaataaagaataagaaaacattttaagaaaatgacgtacctggaaaaaatattttttattcaggcaaaatgtaaacactggaattaaacaatatgttcacattatcacaatagcacagaatcaatagtgaatgttttttttctttaactctccatagttattcagtgtttatttcatgtaagactttgtaagaaacatcatgtataatatttctaccaatcatcactttcaatgattcttatagaaatagac

SEQ ID NO: 961 - DNA, 1200 bp, mus musculus
tctttgaggacttctacctgtttgcttgtgttttcctgtttttctttaaggacttgtaactctttagcagtgttctcctatatttctttaagtgagttactaaattccttcttgatatcctctaccatcatcatgagatatgcttttaaatccaggtctagcttttcagttgtgttgggctgtccaggactaggttgggtgggagtgctgtgttctgatgatggtgattggtcttgatttctgttagtaggattcttaagtttgcctttcaccatctggtaatctctggagaaatttgttttagttgtctctggttagagcttgttcgtcaggtgattatgttagcctctatcagcagacctgggagactagctctatccttagtttcagtggtcagagtactctctgcaggcaagttctcctcttgcagggaatgtgcccagatatctggtgttcgaatctgcctcctggcagaagttgtgttccactcaccagaggtcttaggatcctgtgggagattctgtgtgggtccttgtgggtgtccggagactccccaggccaggaaccctggtgctgcagtggactggaagggacttgtgcccctgatcaggccgggttatctgcttgcttaattaatgtagtctcaggtcccccgtgatcagattgcatcagcagaagtatttctttacttaacctctgttgagaaaagcattcgtaaagtacatttgtgattatttgatgtttctgagaaataaattgcaatattcgttttttagcaattctttttttaaaattaggtattttcttcatttacatttcctattctatgccaaaagtcccccaaccccccccccactcttctccccacccactcccacttcttggccctggcattcccctgtactgaggcatataaagtttgcaagaccaatgggccgcccttcccagtaagggccgactaggtcatctgatacatatgcagctagagacaccagcacgggggatactggttagtttatattgttgttccgcctatagggttgcagacccctttagctccttggttactttctctagctcctccactgggggccctgtgatccatccaatagctgactgtgagcatccacttctgtgtttgctaggccccagcatagccttgcaagagacagctatatcagggtcctttcagcaaaatct

SEQ ID NO: 962 - DNA, 1600 bp, mus musculus
aggatcttatacccaaacccacagtgacacacccattccaaccaggtcacacctattccaacaaggacacaccttcaaatggtgccactccctggtccaaggatatacaaaccatcacagcaggtaagttttcagtgagtaaagaagtatttatacttaagctgggtacccaaatgtaaatgcataataaacaaaacagttatattatgataaagaaatcttacattttgttttattagtgtttcattgattttttaaatcaagaacttaatagtgaaatttctgtttgataaatgtcaccagatgatatgactagtagtaaatgttaaatacagttcgtgtacatagtattaaatatttaaatagtaaaactaagaatttatttgttgttacatatattttacaaatgtaattgaatacaatatgaacctcaaaactttccctgtgaatctgaaaaacaaaggattcatttaagtttatatgtaagcaatgaactcactgaatttaaaaataatttacttattctttatggagtagttttaaggaccatgatgaaactgagctgtattcaaaacaatgtagaaaaaccatgagaattgtattttatttagtattttagagaataccataagaataaattattacggtcccttccagtcaacctcagcaccaggtcagcttgggttcagagttggtggacacccccaaggtccccagagcactctccacgggatcttaaatcctctggtgagtggaacaacaacttctcttctaattcaatcacgcaggacctgagacagcattaattagggaagcagaaaacctggactgaccagggtcacaagtccctctggtcagccccagcaatgggtcaccttgggtgcagaggcggcggacacccccaaggtccccagagcactctaaaggagatcttaggacctctggtgagtggaacacaatttctgccaggaggcaagttcgaactccagttatctgggcaccttcccttcaagaggagagcttgactgcagagagtgctctgaccactgaaactcaagagagagctagtctcccaggtctgctaatagaggctaacataatcaactgaggaacaagctataaccagagacaactataacaattgaccccagagattaccagatggagagaggcaaacataagaatcttactaaaagaagccaagaacactcaccatcatcagaatgcagcactcccacctcacccagtcctgggcaccccaacaaacccaaaaagctagaccaggatttaaaagcatatctcgtgatgatggtagagggcatcaagaaggactttaataattcacttaaagaaatacaggagaacactgctaaagagtaacaagtccttaaagaaaaacatgaaaacacaaccaaacaagtagaaagtccttaaagaaaaacaggaaaacacatctaaacaggtgatggaaatgaacaaaaccatactagacctaaaaagcaaagtagacaaaataaagaaaacccaaaatgaggacactagaaaagcaatctggaaacatagatgcaagcatcagcaacagaatacaagagatggaaga

SEQ ID NO: 963 - DNA, 1000 bp, mus musculus
tctatctatctatctatctatctatcatctattttctatctatgtccattaaaatgggcaatatcaatttgacactctgcatgtacattctagtcaaaattatttcatgtctctgtacaaggaatcctctggggaagatgcaatgaacaattatctgcagaaactatacagctgtttaagtaattttttgaacctgaacacacacacacacccatacccacacacaaatggcagttcttttgaaatatactagaacttcatagatgcttaattgttgttcctagttcagagtatcccacatcacctgcacgcatctgggaagatgctggaaattttgatagtgcagttaacctgaggttgattatttttcttttatattttcagtttgtagcagtttcagtacaaggtgtagaaggccttgaaatttgtagacacccggctcgccagcaagaaggacgccacaacaggattcttctgcacacgtttattgggagagcttgattgcaccctgagcccaaaaaccagtgctgcttatataggcctaggacaggcgtgtctacacctgattggttatgctttcagtacctcatttacatgcctcaggccaggcagtgactctgcaaaaactctactgcacatgcgcacattggttgtttacccgtacttatgggtggtggccagcggtagccaacgccattttgtaatggcgtatgtggcttcccacagaaatttagtgatgcaaagtatatatgtataaatttaaataagctccatgaacatatggaaacatgttttgaagcttaatttatcttatgttgttggcaataatatgaccaaatcacaataggtaagtgtgatgacttcaaacctaagggtgtattcccagtgaagctcaacttactgtgggcaggtatgttgctgcgactgtgagtacagcaaataagaaaaaaatgttgatccatctttactttatctaataatagagatcataggccataat

SEQ ID NO: 964 - DNA, 1200 bp, mus musculus
ttgtaacaaaaaatgaaattatgtagtatttgtctgactttacaacttttatcttagagaaagcaaccattttcattggccacagaaaatgagagaggaatccacaaagagaaaatgcttaaaagggagatctctaatttccctttaaaaactcaagccatgagtggtcaagtgagagcaagtcatgcaatgttaagtaactgtcctttttagagttttactgctgtgaagagaggcctttaccaaggccagagaaggcagcctagctagtagaacataccctacagacaggccacagcttttggggtagcccctgttccagttgtttggaacccacaagaaggttaagctgcccatttgctacatatgagtgaggagacctaggtccagctcatgtatattctttggttggtggctcagactccaagatccccaaggaaccagagtattttactttgttggtcttcttgtggagttcttatccctttcaggggtcacagtccttccttctattcttccataagagtctctaagctccatctactatttagctgtggcctctcagagaacaacatgctcctgtctgcaagcataaatgtattattagaagtgttagggattggtgcttgcccgtgagatctgtctcaaattgggcttgttattagttggtcattctctcagtctctgctccctttcctgtgcatgtgtaacttgtagacaggataaattttgcattgaaagttttgtgggtaggttggtgtctctatcactccactgagatttctgtctggctacagggggtgtcctcttcaggtttcatatccccaatgtagtgaatcacagctaagtgcaccccattgattctcagacaccttctttatcccaggtctctgtctcatcctggatgtggctccccaacctcctcagccccgtcaattgcagattttcttgcaagcaaggaagcttgaatatcacatagaaaggggaataaaatactcataaaaggcagatggagggagggaattgaaaaggagggagggtgggaagggaaatgggagatgcaggatcaggtatggggaaggacaggagagatggctgggtggccatggaaataaaatagattttatatatgcatttaaatgtgaaaggaatgtaagaataatgaatacaaagaatgtaacccttacgacactagtgtta

SEQ ID NO: 965 - DNA, 1200 bp, mus musculus
tactgtgaacagaatacataatttttgtactaagtgctaaaagtaaatataaagaaattgtattcttttaaaaagtgtatatcttatatttttgcagttgaattttctttttttttcttttattggatattttttatttacatttcaagtgttaccctttccatttctcccctctagaactttctatcccatcctcctaccacctacttctatgaagttgtgcccacacccacccactcctgtcttcctgccctggaattcttctacactggggcatctaaacccctcagacacaagggcctctcctcccgcttatgtccaacaaggccatcctctgccacatatgcagctgaagctgtgggtccctccatgtgtattctttggtttgtggtccagtcccctggagctcagggatagggcgtgttgacactgttgtttcccccatggggctgcaaaccccctcagctccttcagtcccctctacaattcccccatcggggtccccgtgctcagtccaatgcttggctgtaagcatccaccttcatatttgtcaggctctgccagagcctctctcaggaggcagccatatcaagtttccaacagcaagcacttctgggcaagcacaatccaggtgtggcaactctatatgagatggatcccaggtgggccagtctctggatggcctttccctcagtctttgctccacacttaatctccataattgttcccgtgattattttgttcccctttctcatactcacactttggtcttccctcttcttgagcttcatatgctctgaactgtatcttgagtattccaaactgctgggctaatatccacttatcagtgagtgcataccatgtgtgtgtttgtttgtttgtttttgtttgtgactggatgatattttcaaggcccgtccatttgtctgcgaattttattaagtcaattttttaaatagctgagaagtattccactgtataaaagtaccacattttctgtatccattcctctgttgaaggacatctagattgtttccagttcttaaatgaccatcagatgttgaaagggatcttagacatctgagttttctgggttttatgccatcacattccaagaatctgtcaaggtaattatctcataacaggtctcatttatagttggtgaattcagttcttgacttcattaccttccagcaaatt

SEQ ID NO: 966 - DNA, 1000 bp, mus musculus
tatttttacagtccagcatttaccccctcctggtctgccctcccacagttcaacatcccattcctcttccccaagtctttaagagaatgccctccatccacaccatgcctgcttctccctggggcctcacttctctcatgagttaggcacatcttctatcttctctcactgaggctagatcagatagtcttctgttgtacatgtgtcaggggccctcggaccagatcatgtatgctgcctggttgatagctaagtgtctgagagaccatgggtgtcagggttagttgaaattgctggtcttcctatgtcctcctcctcagcttcttctagccttctcagaattcaaccacaggggtctccaacttcagtccattggttgaatgtaagtatctgctctccatctttctcagtcagcttattgttggacctctcagaggacagtagtactaggctcctgtctgtaagcacaccatagcatcagtaatagtgtcagccttggagcctccccttgagatggatcacaggttggaccagtcactggtcctcctttcactcatttcttctctgtttttgtcccttcatttcttttagacaggaacaattctggtcagtgtttttgactgtggaatggcaacctcatcccttcacctgatatcctgtctttctaccagaggtggaaagtttcctctccccactgtagggcatttcatctaaggttcctccctttgagagttgctcacctcccaggattctggtacattctaaagggattcccaacctttaaacctcccccatgaggtagcaaaattccactgtttctgctaaccctcagggcttctcttctgttctgccccaatacctgatcatgttcccctttcttctccccattaccctcctccctcccacccaggtcactccctcctgctgcctcatgtaattgctttcttctccctaccaattgggactgaagaatcctcacttgggagcttctgcttgttaa

SEQ ID NO: 967 - DNA, 1400 bp, mus musculus
gtatttagtttagtaagtatagcaagctgtttgatttgtttgtacttttgaaaaacaacttgttcattgattgttccagggtttcttttcatttgtacttatttttttctgatattttctctttttaaaatttttgattggctctttgttaatttcacatcgtcaacttcaatttcacttatctccgcacccctcttatctcccattcccccatgcaagcttgcaaatcctgcccaacagaaaagaaattttcttatggaagtagtaatgtgccatgttgtattctacagtataaccatacccttttattcacacttctttcttgcaaatgtccattgcaatgatccttttggcttgctacaaagcctctgacttttggtactttactaatactggaacctctttgggactcctcttgaatatcctgttgttgccctgtgccgtggagatcctgaagtttttggatctgtaagatcagctccctcatgcacttttgcagttagttcatcgatgtggtagatgttaggctggaccattcaatctgggcccgataggtgtgagctggtttgctatcatgcacctcaggatcagctctactcttctgcccaagtgaggtgcagggcctgctctctgaaatgttgcagccagtgtgagatagatgatgagggatgagtgaaaggtagagctcctccgtgctcacatccttgggaccagctcatctacaactcccacaatatgtgggccgcctttcagagtactgcagctggctagggtagggttagctctcctgctttcacaccccgagagccagctcttccagatgcccagttaatgggctgggtcatttctgtacagctctcagacatcaccatgtcatctccagggcagcagatcagaccagagacattcacctggcctttggtggtaacaaacctttgttgctgcagggggaaggactcagacataacccccaagtggcagcacaggacaggaccctaccatagttctagattggatcaatcactactcaatattcctcactactctgagttatcagttctgcctctcttcaatgtgtcccatccttctgtttctctttcttttccatttctctactttattgctccacttaagtgttgcctgaggtccccaagtgtctggggttatcttagtattggtttcagacatggttggttgcaatcttagtattgttttaaagcatggttggttgcactagtatattatcttcatcatgggctctcacccccacccaattacacatagcctctctcttatctgccacctacagatgagacaaagaagctacaactgccagacctttaggggtaggtctgatatttattttcttctattgttttggggatttgtctggtctccat

SEQ ID NO: 968 - DNA, 1200 bp, mus musculus
aacagtaaatgagaagacttgtctgtgttaccctacttctcatcagatcagccctttctcctaagatcctcaattctttgcttttcttttctgtttcttttttgttttgtcttttgctattgcttttggtttgtgtttgtggggtgtgtgtgtgtgtgtgtgtgtgtgtgtgtgtgtgtgtgtatctttgtgtgtgtgtttggttttttatttgtttgattttttgttttgttttgttttcatttcttcttcccgtttttgtttctttaattggagagtggagctttgagaagacatgattgggcattacaagtgtttgttgctattgggttctagttaagttaggccagcagctggttaaacaagacaaagaatatgcatgtgacttcatggtgtgtgtttgctatgagggcaaacatgaatgcaattcctgactttaattttatttatgagcatctgaatttatattcattactagttaagaattagttgtgttgaaaggctctcaattccatccttttgttgcagattatttcagcccattctcctttctctctataaacgattactccaattgtaaagaacattactctaacaacacaatgacttctctgctaaaattcaatatgtatttttaaaagtgttccaattattgactaacagcactctacacactaaacaaggatgttgcctggaccggccctgctttctgttttcactgctacttagaggagtatcttgcacatctctttcagtgacttcgttttatgtgatttttatattaaatagagataggacctcactttatatattgggatggtctggtacttgctatcaaacccagagattcatctgcctctgcatcaaaatgctggaattgaaggtcagccaccatcatacctggccttgtttcatagatttttagtgagattcactgttttgctattatattccttccctgggtttcagttcatcattttttaagatctgcacatgtgatagttagcactattgacaaatttaatcaaatcaagaatcacattggagagagaaagaaaagtaaaggaaggtaaaggagaaagaaaatttgtacacagtttagagctacgcttatgaactatatagagttaattttaatattggcattgtatcttgagatgttagtaagtttacctcattaagtttatatacattggtatt

SEQ ID NO: 969 - DNA, 1200 bp, mus musculus
gagaagacctgaaatttgcataccagctttgcttacctactggatgcttttgcagtcaggactgccaggttcctcgaaaatgcctcatgtatttggggacttggacaaggcaagtaataggttagaaggaaagttctgtataatctatagagatggagatgaagagaagtggggaggactgctgaagattgtctataaagagctggtaatgagactggaccattgaacttggagaagaggagggagaggtgaagatttgtagttaacatcccagctttcatggcctgagtgacctgtgggttcacagagaatgcctcctggggttaggacttgagataaaggacataatgttgggcaaggtaggggagaaggtgtgcatcatcctctggcattgctgtcagaaaggacggtgctgccacagcaagtggtttgttacagagttggggtgagtgtgaggtactgaatttggaggagagaaacataactaaaacagactctctacctgggactgtcaggggccacagcaggctgggactcaaatcagtgtcttgctcagtcaccatcagaggagcttcctcttgaagtaaatgggaactcatacagagacccacaatcggatgatgtgcagtgagtgagagactttagtactcagacctacaagggatgtcttcatcaaacccctcctctcagggctcagggatctatgcagaagaggctcagaaatttgctaagaaccagagaggatggactgcagcaaggaaacctcgtcttctgtacacaaccgagctggtgagctcccagggactacagcagcgtgcacagggcctgcacaggttaaagtcacaccagattccatctctgagcgccacacaggggcctatctctgtaagagggaagaagacgtgagctcctactccctagccaagaagttattgccaagtgacaactgtttgcaaaggaaagactaattttctctagtggagtctcactgggtatatacactaccgtcaagggcaggtaccacacccagaagtatatagccagcacagaacaaactcagggatgtttttgtagacttttgtttttgtatcatattgctttgtttgggcacttttttatcttattgttcttttgcttgtatattatggtttccaagtctgggcttttacgggtttagggatgtgtgtgtgtgtgtgtgtg

SEQ ID NO: 970 - DNA, 1000 bp, mus musculus
taacacaatccatcaacattgatattaaaacatttatttttctttctgtttaattttatttttgcaaaaacgattcccccagaacagcagcagttaactgctaaaagccaatataacatttcatcatgcattttgattttgatattctctttggtttcagattcaatgtttgcttgaaagaaaataattcataacagaacatttatacttttaaagagggctagtacttgaggtataaaatgctaataaataaacctctttacagttttgagtctggagaagagtatatacatgttatttttagtattttaattggcttatttaatcagtaaatgccaacctatattacttcaacatgagttgatattttaaaatctgaaaaaaaagtgattttaaaagtaaaagtatcaaaatgacatttcataataatcccagttctaaacaaagaactacagagaagtaatcactactgggagaagcattagatgttttcagatataacctgcctacatggttgtcgaatatagagtattcagccttgaaattacgtgtgtgtatgtgtgtgtgtgtgtgtgtgtgtgtgtgtgtgtgtgtgtgtgtgaaccaccaccagaagaagattcagaaagttgtgtttatggttttgggcacacaaacagcatgtatatgtaacaatgttaataaaagaaaaagagggtatcaagttgagagggccattgagtggggcaggagagggtgtgtgggtgggggagcaccctcatagtggcaaagagtagagaggagatggcgaatattgaatgcgggggtggttgtggaggtataaccagaaagtgggatatcatttaagatgtaaatgaattgaaacattaattttataaaaagaaaaaagaacatcaagttataaaaagcgagtgtgtgtgtatgtgtgtgtgtgtgtgtgtgtgtgtgtgtgagagagagagagagagagagagagagagagaatgttgggttgggttgg

SEQ ID NO: 971 - DNA, 1000 bp, mus musculus
accgctccagcaaccatctacaccgggggtatctaacttccacaggaccaagtgcctcctctcccattgctgtcaggcaaggccatcctcttctacatatgtatctggagtcatggattcctcactgcacactccttggtttgtggtctagtgtctgggaccaccagtgcgtggtccagtcagctgatgttgttcttcctaggggtttgtaatcctcctcagcaacaccagtcctttggtcagttttctcatggggtccccgagctcattcagatggttgctacatctccattggtcagttgctggctggacctcccaaggagcggccatatcaggttcctgacagcaagggcctcttaatcagagcaacagtgaaaagtttggtgtctgcagacaagatggattcccctgatgggacaatcccaggatggctcttccttcaggctctactccatttttttgtaccttttcttcctttgaacggaaacatttctgggttaaaaactttgagatgggtgagtgtcccatctcttgaccgggcgccattcctatctgttggaagtagtctcaagaggttctatctcccctgtgcatttcaactagagccatccacattaggtcctgagagctttcttttccctggtgcctgggaccctccagtggctatccccatttcctcatcaccccctgattcatattttttcaatttcctgtccttctgtgcctctatcccatcctctccagtgcctgatactgcctccttatatcctccccctcttctctacctcccaagccctcctcttcctccacttcccattattctttagtattcaggttcataccaaagaccagatgagacattcagccctatggtgtgagcagatactgtgtccttggacaatctgttcattcacagtcattgttgatttatatggaccacagagaaatatatatatattcagggtaagttaatatttgttcagagggaatgataaataat

SEQ ID NO: 972 - DNA, 1800 bp, mus musculus
aatgagcattattatttattaacttttaaataatttactgtataccacggttgcttcattttcaatgatttatcttatcattgacttggcaactctacttatcaaagagtttttaacataattttaggacttctaattttttgcattatttatatttgccatatgttaattctatgatgatgtaaattaaccttgcttcaaaggtataatcttccaaccttactctctccagtgttgcaattacaagcttttgaaacaatatccatctttatatcaaatattacttacttagtctaatggaggttgaacatgtctctacaaaagacatatggacttcttcatccctggcatttatgcgatgatagttgaaaaaaaaaaaagttaggtcttgtaattagctgagtccattagctggaccatataggtgaagtgaatgctttctttgtcatgaggacaaacacagagataagtatgcacagagttatacctttgagtatcacagaaggagaaggtactcaggaaactcaataatgtgatatataagatgaaaatcaggagttgcaaaggaagctagaagtgtgaagacaattctattctgagttctcaatgaagaatataacttgtataatcttgtaattaggaagttctagccactattactttctgaaaaaaatgttatattaatccatccaggtttcagttatctctttttttacttgaatttctttttttttaattgcttattttatttatttacatttcaaatgttgtccaactacctgatttgccctctgcaaaccccctatcctattgccctcacccctgctatacgagggtgctctctcacctactccagactcactgccctagcattcccctatgctgaggcccagtgccttgacaggatcacgggtctcctctcccactgatgccagataaggttcctctatgtgtgccctttgattggtgttttagtccctgagagctctgggaggtttcgattcttgttttagctatgggaaattaacatactttacaaaatatattttgaaatctgcatctactctcctaattgagtcataacaaaataaatgtagaataatatgtagttctctttttatccggaacatcctgtaaaatattttattttttattgtaccatttttcaattttgggaaacttcttgcatcctaggaacatccttgtgtaaatgaagctagaaagtaataaggtagatagcccatcctcttcaggaacccctgtactgtgtggataatgttccttgttaacacacactgaggcactttttttatctttattctggaacaggaatttaaagatatttttcattttagtgcattttaatcaagaaaattttaggtgagcctatatatgcagatatataaaattagtactcaaaacagatatttcatgataataaaccataaagaactttatttcaaaacaattctgtagtatacatatatgatttaacactgatgaaatgaaagaaaattaacaaacagtaagattgactcacttatatataaaattgtatctttgctcaatactttacagttcagaatccaaagactcttcagtgattttattatatgtgtttttatatatatatatatagcaatcaagtcatcaatgctgagattgtaacttcatatccaccaatgtggcaaaaagtggcagaattattttaatggccaatttgaaaattgtttgaatttctatctaattttaacatatttttgttttgtttgctaataagtgtcatagtgtgatgtgcca

SEQ ID NO: 973 - DNA, 1200 bp, mus musculus
gaatttcaagtgggattgcattgaatctgtacattgcttttgttaaatggtcatttttactatgttaatcctgcctatcagtgagcatggaagatcttttcaacttctgaggtcttctttgatttctttcttcagagacttgaagttcttgtcatacagatttttcacctgcttggttagagtcagaccaaggaattttgtatattttgtaactattgtgaaaagtgtaaatttccttatttctttttcagcccgtttatcctttaagtagaggaaagccactcatttgtttgagttaatttcttatacagactccaggaaccaacaaggatgacattagtcaaaatacacaacaaaagggagagacaacctatagagactatatccagtgaataggcaccacccccggttgagggatggggccaccaaccacctcaaaaatactaatccataattcctcctgtcaaaaggaaatacaggataaagagtagagaagagactgaggaaaggccatacagagattgtcccacgtaggatccatcccatctgcagacaccaaacccagatactattgctgatgccaagaagtccttgctgacaggagcctggtacagctgtcccctgagaggctctgctagagcctgaccgatgcagatgaggatgcatgctgccaaacatcagactaagcacaaggattccaacggagaagttagggcaaggactgaaggagttgaaggggattgcaaccccataggaagaacaacagcatcacctcaaccctcccagggactaaagcaccaaccaaagagtacatatgggggcaaccatagctccagatggatatgtagcagaggattgccttactgaaatcaatgtgaggggagtcccttccttctgtggaggctcaagaacccagcataaggtaattctagcatgatgagtccggagtgggtggatgggtgggggagcaccctcatggagtcaggggagaggatggggcattgtggaggggatactgggaaggtagataacttttgaaatgtaaataaataaaaccaatttaaaaactaaatggcaaaaaaaaaatcttatcacattctaataagaggaaactaaagggttttatgtatcaaaatgaagcaaaatattaacggtatttaacactagattaatcaggtcatttatatgtatatgtattcc

SEQ ID NO: 974 - DNA, 1200 bp, mus musculus
attataattaacttcttttccaactactaaataatgcctattggaattattttgttgatgagctaagttgcagctttaatatagccttaatcaccttcttctttaaaaggcttccaatatcttttagccttgttgctgtcgttgtttaatcagttgtaaagaaggtagtatgtgaatattgatgctgattaccactggctcctcatgactttatcaataccataggaaacctaaaaataattaatatgtgattgacacagcaaactattttcaatttacagcatttcattttgtgtcccgtccagcaggacctagttattcgtgggtgcaagggggacggcaaacctgggagaaaatgggagggagagaagagaggagaggagaccaaggagggaagtcctgtcaaggtctcagtttattaggctgaaacacagggttttaaagcatacatcaaggggaatagggaggggttgagggggaattaacaaagaataaagaagtgggcatcagggaacatgagggctgaagtcaggctctaggcagcgggcactctgtgtcttatctccggaatttggattctcccttaacagccttagatgtcaggccagactcagcatgtaactcatatccttggatgtcatgggagtcaggaagagataaggaagaggggattctaattttgcttttacagccccaggtgccaggaatggaacagggagaagggagtgacgactggctcctagcacaaggccatttggcttgtcagggtgggagactgtgaaaagcttgttttctcatggtatggtctccaacaattttgttcttaaagtttcgtttgaaagaaaaatactactaataaagttaataattagataaaattacatattactttaaataatataaagtgagtggtatagttctacatgagagaaaaatgggtaaatatatatctagaaaaatcaaaaaaatatatctttcataaaaatgctctttaagctagaaaatgaaggccaaacaagggtgagaataatttttgtggcaaagtttctgctataggagatagtttagctctagagaaatgtgaagatggttgaggcagtagtggggcagggaattcttggcattaggttgcagtatattgcatgaaagtttgttgaagaggataggactttgtcttgaagaccattgtgtaatttaaga

SEQ ID NO: 975 - DNA, 1000 bp, mus musculus
ccagcagtaacaatatagagagacccagtcattcccctgcaacatatagacacaaaagtgaagtaaaacaaacaaaacaaataaaatcttaaattgagaattttataacattattcacaaaagtctcaaatgtgaaggcaacaaagataaccataaaatgttgaatggatgaataaactctggtactgtaacagtgctgctacttgtccataaaaacgagcgaaatactgaagcacagtgacaacttagaacatgaaagtaaggtaatctgatcacaagtcacatcgtattggaaatcaggctaatcagtaagagagagaaaaatagaagaatcaggaatgaataggaatgccagagtaggactgttgccatgaaggttcatttgagtttcactttgacctgatacacatgctcaaaattaactagactagtaattacacatattggcaagaacactaacatccactaaactgtacaccttacacgattatatccaaggtatcttctctgtaaaattatattttctctgtgaaaaataaccctatcaattgttggcaggaaagtatttttattggttttcatatcagtagaactttgaaactctgagtgtatgatcaaacacttaaatgaaacactgagcaggcattctgcctgagttgaagtgtcagactgccaacgctctcaccaagctggacagcagttaactcagaaacaggcatattggcttgccagcaggacagcttcagagtttgttctgagaggggccctgtgtaggggtctaggcataagcagagctcctgtatgtataagatgcctggctttcatattttattttccggggagccaatgtgcacttcttggcttctcaaaccccacaggggctgcagcagttacaaagttctctgcaggtaggcagctctatttacctctgtctgcagtttttccctgctaaaataaaacttggcttgtacaagtcatatttattataaatatgtttcac

SEQ ID NO: 976 - DNA, 1200 bp, mus musculus
taaaattgcattctaacttatttttctttttttactgtttttctaattttcttttggtttgcaattaatttatttattcactttatatcccaattgcacctcccttctcttccaagatccccccctcacacagccccttgctctcattcctcaatctccttctcctctgagaaaaagaaagaccccctgggaaccaactcaccatggcacatcaactcactgaaggactgggaatatcatctcccacttaggccagactcagttaggcaagcaggattcacaggcaagcaacagagtaaggaccagtctctgcttctgttgttggggtacctacatgaagactaagctgaacatcagctctaattgtgcagtggggactagattctgcctacaataaatgaaaggaaaagaatggagcagagactgaaggaatagccaaccactgatcttcccaacttgagaccaacccttgggcaagaactaatccacaacactattaatgatactctgttatacttgcagacaggcacctagcataacagtcctccgagagggtccacccagtagctgactgaaacagatgcaaagacccacagctaaacattagagagagctcaggacatcttgtggaagagttgggggaaggattggggaacccagaactccaccgtaaggccaacagagtcaactaacctggacctttgggagctcccaaagtagtagtgttttctattcattaaagtagatttttgagacatccggccaccttcccagccagaggacaggggtctgcccagcccaggaggctaggattttgactcatgattggcaggagccaccttggttcccgaactctgcagaaagcagcctgcacaggtgagagtgtggaccacagaagctaacagcttctgggacaggcaagagccacagagcttctgaggcagagccgatttcaggctccagacatccatccacgttcccggccagagcacaggtgtccgcccggcccgggaggccctagccacaggatcagctgaggatccattagatgctgagaaagcatttgacaaaatccaacacccttttatgataaaagtcttggaaacatcaggaattcaaggcccatacctaaacatgataaaagcaatctacagcaaaccagtagccaacatcaaagtaaatggtgagaagctggaagca

SEQ ID NO: 977 - DNA, 1200 bp, mus musculus
ttattcccggaaggcatcatcctcatttcatgtaactaatatcttaatgtctgatatacacctggaccagagtcaggatttaatattctcagtgtctaaaatgatggatacttaatttacttttctcataggaaggagggaagtgtcatatttcctatgatttggcttggggaagagctgccttttagacatactgagtttcttcttgtctaatacatggcttggccacataccattcaggacacatggattgtgtggaaatggtgaacaatgacagaatcacctaagagtggaaagagtccccaaagaagaagcgcaatgctgagtttcttgtctggtgacttcctagagtatttatgcagaagatggataaagactaaggaaatttaaactgtggtttttcattttcagtgcatacctcaggcccagtcagtgtggggtaccacttttttttcttttttctttttcaatttttattatatattttcttcatttacatttcaaatgctatcccgaaagtcccctataccctcacaccccactccccgccctgctcccttacccacccactcccacttggccctggcattcccctgtacgggggcatataaagtttgcaagaccaaggggcctctctccccaatgatggctgactaggccatcctctgctacatatgcagctagagacatgagctctgtgggtactggttagtttatactgttgttccacctatagggttggagactcctttagctccttgggtactttctctagctcctccattgggggccctgtgttccatccactagatgactgtgagcatccacttctgaatttgcaaggtgctggcatagcatcacaagagacagatatatcaggggtaccactttttatgcataccattctggctccaaacataatcaagggatattcatgatgtactgttcagcctatttatggaggttgaagtctatctctgctaacaaatcacttgctttgttagtggctagccttggctctgcctcgggccaaagcaacactggctgtccttgacaggcatcatccttgcatggtttcatggtctccaacattggcttttgttttctttcttgtcaagttcatgttaccagcttatacgtatgtcatgacattttgctttcctacatatggtggtctaactcactagctacaccattttc

SEQ ID NO: 978 - DNA, 1600 bp, mus musculus
aaatatgcaagagtaaggatatcaacaacaaaattatttttttacatcaataagagttttgacagagataataggtgatattttacaagacagacatttattaataatatactgatagataatttcagctaatagattatatttcaagcaagatttaaattgtggtctggagctgctaatactcttgtctcctttcaagttttgagaatatctgcaggctactctgcacctggtatatgcagtgctgtggactgaactcatgacttactaggataaataagcacattttagactgagtcacatccccaaacctgttctaaaatgttaaaagaacatttatctaatagataagcaaacatgatgagttaatttggaaccaatcccaatttcacacatgatattcttataacattgaaagcatctgggtggtttgatgaactaagtttctgtatcttttagcaagtgggcatgtttatgagactatgaaggcaaatgtatataaatgaggtcaaaggtcaatcccaagtatttccccccacccctcaggagctctctaccttcatttattagatatcatccttatttacatttcaaatgttatcccttttcctggtttcccttatgaaattcccctccccctgctcaccaaccctcccactcttacctacttcctacttccctgtcatgaccttcccctacactggggcatcgagccttcacaggaccaagggcctctcctccaattgatgtcaaacaaggcggtcctctggtacacatgcagctggagccattggtccctccatgtgtactctttggctggtggtttagtcctcttttgtgtgttgaggatcaaacacatgttatgattgtgatgctgatgcttacacccatagtctggatccttcacacagagcttacatcgtctctttgatgctttctgtgtcagtagttgatgttcctgatatttttgttagtagataaaaatggatttttcatggtttttttttgctcgctcttactgtttcagatactcaaatatttttaaccatatgcaaacatatattttaggaggcattccctgtaacagtgatgggaatagagtatcaaaattattgttcaggtgtgacaatatcttgatgaatacattaaccaatataaatttcaattttctaatataaaagaggattgccgaaaaccacacacaatcctgtgttttgtactactgaaatcttggggctttcacttcccagttagcatgcatgctctgcacagctcctctctcctttcttagctattttgagcaatttatagtttgatttccatggcactcctggaaatctgtggtaaaagccttgtttacagacttaaatgttttgttctccaaatctgagacaatatgacagtcataggagtatgattttttaaatatctctcattctcatcttttcctatattcaaattttacatacattcatataaaagaagtccctctgtgcttttaatctttattctgtagtatgatagattacaaaagcattgtttttgaagtgattttcatttctcttaattaatgttcaactggaaaacactggattgtaca

SEQ ID NO: 979 - DNA, 1200 bp, mus musculus
aatttaattagaaagacaggatccatgatgcagattattatcatcctattaacaggacaaaataattcccaatatttttgaaagcatagttatattagtctaagatctaaaatgtttacccatgatatatcattctattcatagcaccaattacctaataatgtgataatgtttttcaagttgtatacttatgtaagattgccaactttcaacctagtgcctggattcgaggtatcagaaaagtgtatttgataaatgttatccatatatacctactcactattgtttatatattatcatactaaagtatcatgagggctccagacatccgaccacctttggggccagaggacaggtgtccgcccagcccggaggcttctgcctcaggttccgtggaagccaccttggttccgggactccgaggagggcagtctgcacaggtgagagtgtggactacagaggctagcagcttctgggacaggcgagagccacagagcttctggggtggcaccgttttcgtgctccagacatccggccaccttcctggccagaggacgtgtgtctgcccatcctgggaggactttgcctcagggtccggggagccatcttggttccaggactcccgggagggtagtctacacaggagagagtgtggactactgaagtgatggcttctgtgacaggccaaagcagcacagtttctgggaaagatcctgttttgggccttcatcttcggccaggaggaggtccaaacaccagataactgtgcaccttccctgaaagaggagagcttgccttcagagagtactctgaccactgaaactcagaggagagagctagtctaacaggtctgctgatagagggttaacaaaatcaccagagggacaatctctaaacagagacaactataacaagtaacgccagagattaccagatggcgaaaggtaaacgtaagaatcttaccaacagaaaccaagaccactcaccatcatcagaacccagcactcccactttgcccagtccaacacacctgaaaagctagacctggatttaaaagcatatgtcatgatgatggtagaggacatcaagaaagacttatataactcacttaaagaaatacaggagaacactgctaaacaggtagaagacattaaaaaggaagtacaaaaatcccttaaagaattgcaggaaaacaccacc

SEQ ID NO: 980 - DNA, 1600 bp, mus musculus
ttcagaatatgccatattctgcacaaaccaatgattagaaacaaatacaacccacctggggatccatcccataatcagccaccaaacccagacactattgcatatgccaggaagattttgctgaaaggaccctgatataggtgtctcaagtgaggttatgccagtgtctggcaaatacagaagtggatgctcacagtcatctataggatgcaacacagggcccccaatggaggagctaatgaaagtagctaaggagctgaagaggtctgcaaccctacaggtggaacaacaatattaactaaccagtactccagagctgttgtctctagctgcatatgtagcagaagatggcctagtcgtccatcactggaaagagaggcccgttggtcttgcaaactttatatgccccagtacagggaaatgccagggccaagaattgggagtgggttggtaagggagcagggcactgggagggtaaagagaacttttgtgatagcatttgaaatgtaaatatagaaaatatctattaaaaaatgttctcaactatcttgacagagaaaaaaatataaaatattcaatgtctaaaattaaacattgatttttagttgatgttaaagaatagaaaaaatatatattataatatggaaaactacctgaatatgttacattcagaattgcagtcaatgtttattaatttttagtacctgacaaatatatggttcaagaattacaagaccccttccggtcagccccagcaccaggtcatcttgggcgcagaatcagtagacacccccaaggtccccagagcactctccacgggaccttaggacctctggtgagtggaacacaacttcttttccaatccaattgcatgggacctgagacagcattaattagggaagcagaaaacctggactgaccagggtcacaagtcccttccagttgaccccagcatcaggtcacattgggcatggagtcagcgaacacccaaggtccccagagcattctccatgggatcttaggacctctggtgagtggaacacaacttctgccaggaggcaggttcgatcaccagatatctggccaccttccttgtaagaggaaagcttgcctgcagagagagacctgaccactgaaactcaggagagagctagtctcccaggtctgctgatagagactaacagaatcacaagaaaaacaagctctaaccatagacaactataacaactgactccacagattaccagatggagagaggttaacttaagtatcttactaacagaaaccaagaccactcaccatcatcagaatgcagcactcccatctcacccagtcctgggcacccgaaaacacccgaaaagctagacccagatttaaaagaatatctcatgatgatggtagaggacatcaagaaggactttaataactcacttaaagaaatacaggacaacactgctaaagagttacaagtccttaaagaaaaacaagaaaacacaatcaaacaggtagaagtccttaaagaaaaacaagaaaacacatccaaacagctgatggaaatgaacaaaaccatattagacctaaaaagcgaagtagacacaag

SEQ ID NO: 981 - DNA, 1200 bp, mus musculus
accaggaaggtggccggctgtctcttctttttttttttaactttgtattttctttgactattatttcagtatcctctttggtatcttctacacctgagattctctcttctctcttgtattgtgttggtgatatttgcatctgtgattcctgatctctttccttgggtttccatctccacggttgtctctctttgtgatttcttcactgtttctatttccaattttagattctggacagttttcttcaaatccttcacctgtttgattgtgttttcctttgttctttttaaggaactcatgtgtttcctctttaagggattttacctatttacctgtgttctactgtatttcattaagggagttatatatgttctactcaaggtcctgtatcatcttgatgagatggaattttagatcagaatcttgctcttcaggtgtgttaggttatccagggcttgctggggttgaagaactgggttctgatgttgccatttggttatctctagtgttaactggccttgctctctctgacgggagcctttccctcctgtgagccttgttatgttgggcctcctttgatcaggctgtctctgggtgtgagagggtatctacagtgcctggtctgtggcaggcctcctgtgagttatgctgacccctgtgtgggcagggtctagggtgctggaacacacaatctgctccagggttcagttgaggaccagaaggaagatgttttctccatgcagggcaggaggtcctatgtcctatgatctccagggggtgagggtgttccagttaggtattgggtcaggcagaactcaccagtgagcttggtggtgtcagaactctgggaggtcaagctgtctgtatttgggcaggtggtgggtgtgggactagagcacaggatctgctcccaggcatagttgcaaacaggaaggaagatgtgtctctggcagggtgggaggtcctatgtcctctggacctgggggaggagggtcccacctagatcaggtattgggccagaatgggagattcacatatgtcctggaggacaacttgtctctgggtgtaggcatgggggtaggggattggtgcacatgatctgcaggtagaattatatcttgcttaaatttctgtgaaacaaataaactttcttattagtgactatagagtttttgtaattttacagcatgaatagtagtt

SEQ ID NO: 982 - DNA, 1400 bp, mus musculus
atctactatatagaatagaatctaaaattcctaacttccaatatcctttatcaattatgagctatttttaactttatatttagtctctaaatataatatcacgcaccccaatcccactcatctcccatacccttcctatctactttccacccttgcaacctcctgccacacccacccccaataaaataaaatgagatagaatttttaaaaaattctgttgttgtcctgtgtcatggagatcctgcagctttggatctgaaggactgaccctttcacatgttccagcatatcacaggtagggtagatattgggatggctcaactccaagccctagatctgtgcctggtaggtagctgagtgagtcagcccaccggctctcctgccactttaccaccagggtgaggtctctagcactgcaatgtatagctcacacaaagccacaaataggaacagacaggtcaactctcttgcacaccaagttgggtgggtgacaactctccttgaccaagccactccattgcagaccagctctccctcatgtatgccttaggagctgactcactggcgagtccccctgctgtcaggtctatcaataatagatagtccaggtgagagggtaggaccagctcagcacagtgccttacatgtcagtacagaccagagatatcttcatggcctttggtgataacataggcctagggcatcaacagacaatggctgccgtagaccacagatgcatggatcccagatgtccccatggtctcagatgacattgcagaccactcagatcagcatgtccccccatagcattacagccctcagataaccacatagtctctagtggcagcccagatagtgcacatccaattggcccttttggtaacttgggccacagtcattgatacagatcacaactacagcagaaccaatgacccagacatgggcccttggtgacagcctgggccaggatctccccatggcctcttcaaatctgcctctgccttttcttcactgtcattgagtcttcagttccaacttcttccacagtatatcaacccctgtgtgttgctttctcttcagtctccccactccctctttcccatctctccatcaaacataaatccatcatagtgctgtccaaggcaggtgcttggatgtctttcttcaggccagcctaggtctgaatggccagaatgggtgcttgagtgtctttcctacatttatttacttatttattttttgataactagaaccattcatagcacctacagcagctgaaatgtatgtactatcagtttaaaatttataaatacacatataatttgcatgctagaagatgatgtaaaagcaagtaaccagaatataaaaagtttatgaatatttgcttttagaaccaagta

SEQ ID NO: 983 - DNA, 1200 bp, mus musculus
atcagtcagaagcatagcagatggcagtcctttgttcatcctagcttgatccttggcttagtggccagagctgtcttatgcttaggactcataaaaaatcaaatcaaatcaaatctagatagtgccatgcagcaggaagaaggcagaaacctgccaactgccatgccacccacagacttgccgtccagcacaaggcacagggaagccatagacacttgcttcccaccatccatgtagcatggggagagggtgtcacccagggctccttcagccatgtggccagcctgcagcaagagccagcacagtgtgcaagtatgtggtggtcagatgggagagaaagaaaggtggaacagattgagtagtatgaagagagatggaactgtagacctgaaggtggagagaaataatctgttgtgagtggctgccacctatagccacagtgtagtccctgctgagggccatgtctgcgtctgttactatgcagcagcaaagatcagtgtttatgtctgtagttcatattactactagagtatatgggaatatctggttggagcagctgttagggacaatgtggatatccaggatctgtgcataagtgatccctgctctcaccagaagcagcagtctatagaactggctccatctctcactagcagcagcattcaggaaagcaggccgtccaccttgcccaggcagcacagtgaatctggccctggtggctagtgtgtgggtgagcaggctctgcctcctgcctcccctgaggtggtatgggtatgagggtaataatccccctcttgcctttcagtacccactatagtcaggggatctggtcctggggtgaagacagcagaagaactggccctgcaccttgcctgggaagcacaagtcggcctagcccttgtcaaatgatcatgagtgagccggtctgtatggtgagagcactggagagctggccctgatgctcatctgctaggaggtggtatgagtatggggaagatacatacatacacacacacactcacactcacacttgtggcagtcaagagaagtggcctctggaggggtttgggggtagtcaagggagaagaagaactggccctgtccattgccttacagctgtagcagccagaagaaaggatcctgtatctcatgtgggcaacacgggagtgttggtcctcatggatggggagcaggtaagga

SEQ ID NO: 984 - DNA, 1200 bp, mus musculus
agtacagggttctggtgatggtgagtggtcttggtttctgttaataagattcttacatttcccttttgccatctgataatctctggagttagttgatttagttgtctctggttagagcttgttcctcaggtgattctgttagcctctatcagcagacctgggagactagatctctcctctgagtttcagtgggtagagcactctctgcaggcaagctctcctcttacaggaaacatacacagatatctggcattaggacctccctcctggctgaagacgaaggcccaaaacaggacttgtcccgcggctgagttgctttggcctgtcccagaagctgttagcttctgtattctacactctcacctgtgcagaatactctcggtggggtcctggaaccaagatgtctgccgcagatgctcaagcaaagtgctcccaggccggcagacccctatccactggtctggaaagtggccggatgtctggggcccgaaaagggggctgccttagaatctctgtggttcccgcctgtcccagaagctgttagcttctgtattccgcacactcacctgtggagaatactctcagcagggtcccggaaccaagatgtctgctgccgatgctcaggcaatgtgctccagggcccggcagacccctatcctctggccgggaaagtggccggatgtctggtgcctgtgcagaatactctgggcagggtcctggaaccaagatgtgtgctgctgatgctcaggcaaagcgctcccgggccaggcaggatgtaatgtattaaaaacaagaactatttccaataaaacaaacagaggcttcaaaagaaggggtcaggaaaagcaaggtaagatgggagtaatcacattggtgccagaggtaatcaaaatggagagaatgcagcatgaaatgtgtaaaagtcccacaggaaaacctgcttctttgtaagctaatttttaagattaaaaataaagtatcaagaacaaaagaacagaggcatccttaacaatccacaaatcctttgagttctaacatgaaacattttagatgaacctagagttaactgcatctatattgagaacttcatggactctcacctccttcccaccaccatttaccctaaacatttagtattatttcaagtaatatatatattatacacacacacgtacacgatacaattagtatgtttttccc

SEQ ID NO: 985 - DNA, 1000 bp, mus musculus
acaggaattaataaccattggtcattaatgtccctcaatattaatggactcaactgcacaataaaacgacatggactagcagaatggatgtgaaaacaggatccatcattgttctgcatacaagaagcatactgccttccagtcagcaacagcaccaggtcactttgggcgctgagtctgcggacacccccaaggtccccagaggactctccactcaatcttaggacctctggtgagtggaatgcaacttctgttccaatccaatcaagcaggacctgagacagcattaattagggaaacagaaaacccggcctgaccaggcgcacaagtcccttcaagtctgtgtcagcaccaggtcaccttgggcacagagtcatctgacacccccccccaagttcctagaagagtctccaagctatcttaggaagtctggtgagtggaacacaacttctgcaaggaggcaggtttaaatgctagatatctgggcaccatccctgcataggagagcttgactgcagagagtgctctgacaactgaaactcaggagagagctattctcccaggtctgctgatagaggctaaaataatcaccagaggaacagtctctaaccagagacaactataacaactaacttcagagaggcaaacataagaatcttactaacagaaaccaagaccacgcaccatcatcagaacgcagcactctcacctcacccagtcctgggcaccccaacacacccgaaaagctagacccagatttaaaagcatatctcatgatgatggtagaagacatcaagaaggacattaataactcccttaaagaaatacaggagaggggctggagagatggctcactggttaatagcacccgactgttcttctgaaggtcctgagttcctatcccagcacccacttggtgactcacagccatctgtaatgggatttgaagacagctacagtgtgctcacatataataagaataaatgaatctttaaaaaaa

SEQ ID NO: 986 - DNA, 1200 bp, mus musculus
ttggaaacaaaacacccatggaaggagttacagagacaaagtttggagctgagatgaaaggatggaccatgtagagactgccatatccagggatccaccccataatcagcatccaaatgctgacaccattgcatacactagcaagattttattgaaaggacccagatgtagctgtctcttatgagactatgccggggcctagcaaacacagaagtggaagctcacagtcagctaatggatggatcacagggctcccaatggaggagctagagaaagtacccaaggagctaaagggatctgcaaccctataggtggaacaacaatatgaactaaccagtactcaggagctcttgactctagctgcatatgtatcaaaaatggcctaggcggccatcactggaaagagaggcccattggacttgcaaattttatatgccccagtacagggtaacgccagggccaaaaagggggagtgggtgggtaggggagtgggggtgggtgtgtatgggggacttttggtatagcattggaaaagtaaatgagctaaatacctaataaaaaatggaaaaaaaaagacaaaggcctagtgaacagacctgttgaaggaagaaagactgaagagtgtatttcatcatggagataaagcttgtacctgagagaggaatcaaaatagtgaccaaagacagcagcgggcacatatgggaaatatccaacagaaaagaattgtaaaatgacaagctaactcttgcccctgtcaaagagtagggtcatctctgaggaactagttgtattcacatgagtggtttgtgggggctacgatatgtgtgatgtgcttttgaggtaatagacagagcagtgttatttcctaaataatgagaattttctgttttggaaaggtttcccagaagaacataccacgagtttgtcatgtacctggccctaaacaatggccatcattttgagagcccttttgactctttctctaagccagggcatttgttcattcttgtctggaagtgctttgccactgaagtatatacccaaaaacccccactctaaattctaaaagaaagtctaaatgattaagatgttagctgctaaataattttttctttaggtttatgtagcagaatctaaggtagtcttgagataatgccagaatgtataaggcctctccttgttttataaatctatgcctct

SEQ ID NO: 987 - DNA, 1000 bp, mus musculus
gggaaaacaaaatagtcacgtaattcagaagaagggagagaccagggtggaataagggagggagagttgaaaatgggggcaggaccaggtgttaggggagacaggaaagaagcccagaagcccaggagaatgaatggaaatatgcagctgccagagtaaagggtgggggaacctctggaaagttccagagacctgggataagggaggtacacaggacccaatgtgggtgaccttagctgaaatgcccaaaagtggggatatgtaacttgaaaagtctaccttgagtagttagacagggctcccagtggagggatggggacaccaacccacctccaaatttttcaactcaaaattgctcctatttaaaataaatgcatggacaaaaatggagcagagactgaatgaaaagccgaccagtgactgacccaactttggatccatcctatgggctctcactaaaccctgacatcattactgatgttatgtcgaccttgcagacagaagcctaatatagctgtcctttcagaggctctgccggcagctgattgggacagatgcagatacttacagccaagcattggactggggtcaaggacctttatggaagagttatgggaaggattgaaggtactgaggaggatggcaacaccattggaagaccaacagtgccaactaacctggatcccaggaagctcccagagactaagccaccaaccaaagagcatacacaggctggtccaggcccctagcacatatgtagcagaggactaccttgtctggctcagtgggagaggaggagcctaatcctgtagagacttgatgtcccagggaagggggatgccaggagggcaccctctccaaaatgaaggggagacaggagggggatgtaaataaataaaataattaataataaaaaaagactcctggggaaactaaagatacagggatatatatcaacataataaaagcaatttacagcaagtccacgggaaacatcata

SEQ ID NO: 988 - DNA, 1000 bp, mus musculus
gaggcatagctatatggtttgttagatcatatatgttagaagcactgccactttaagagagcacatgttgcatctccatcactttagactcagcagtcaagaatagagccctgctgtgactattgtgggtattctggctgagatacatctggggaaagctcatccacttttgacagggtccataatgcttaaataattgcccttccttattagtgctttcctgactcagagaaagaaagaattcaagacatgaagtatagctatttacaaaagccatatattatctttttttgatctgttctgtttttgatctttgtttttttaaattaggtatttatttcatttatatttccaatgctatcccaaaagtcccccccaaaactcccccaacaactcccccacccacccaatcccagttcatggccctggcgttcccctgtactgaggcatataaagtttgcacgaccaatgggcctctatttccactgatggccgactaggccatcttctgatacatatacaactagagacaccagctccaggagtggggggaatactggttagttcatattgttgttccacctatagggttgaagatccccccgccccatttccttgggtactttcactagctcctccattgggggccctgtgatccatccaatagttgactgtgagcatccacttctgtgtttgctaggctccgggatagtctcacaagagacagctatatctgggtcctttcagcaaaatcttgctaatatatgcaatggtgtcagcatttggaagctgaatatgggatggatccttagatatgccagtctctagatggtccatccttttgtctcagctccaaaatttgtctctgtaactcctcacataggtgttttgtttccagttctaagaaggggcaaagtgtccacagtttggttgtcgttcttcttgagtttcatgtgtttcgcagattgtatcttatatcttgggtattctaagtttctgg

SEQ ID NO: 989 - DNA, 1000 bp, mus musculus
attcaaaggagcaaatatggaggtaaagtgtagagcagaaaccaaagaaaaggccatccaagggctgtcccacctgtgtattcatcccatatacagttatcaaacccagacactattgtgcattccaagaagtgcttgctgaaagcctgatattgctgtctcctgagaggctctgccagagccttacaaatacagaggcagatgcttgcagtcaactgttggactgagctcagagtccccaaaagaggagttagagaaaggactgaaggagttgaaggggtttgtaaccccataggaagaacagcaatatcaacaaccagaccccccagagctcccagggactaagtcatcaacaaaggagtacacatggctccagctgtatatgtatcagaggatgggccttgtcatgcatcaatgagaggagaggtccttggtcctatgatggctccatagatgactcagcataggggaattgatggcgggaagatgggagtggatgggtgggtgtaggaacaccctcacagaagcagggggagggaggttagaatagggggtttccgggaaggggggaaaccaggaaagtggataacatttgaaatgtaaataaagaaaatatccaataaaaaaagaaaaaatgtttagaacagatgagaaagccagggcagtttctggggtttgatgtggttgcctagctaacagggcattgtttgctgaggtattatctgagcaaacaccttccagatacacaaaagtgtgtgcaaacaaaacaaaacaaagcacaacaccacaccacacaaaagccgtcacccaggttgaagaaatagggtacaatccccagagaatgaactagcgtgtatggggcacattaagacagcagatataaagcaaaaggcatggtggtaaggaggaagagaggtgaaccacaggccagatcacgtgtggcttgaaggccctgcaatttcatttaggagttttccgtgattctgactttcctgggaca

SEQ ID NO: 990 - DNA, 1000 bp, mus musculus
tcttatgtctgccttttgccatctggtaatctctggagtcagttattatagttgtctcttgttagagcttgttcctcttgtgattctgttattctctactagcagatctgagagactagctctctactgagtttcagtggtcagagtactctctgcaggcaagctctcctctttcagggaaggtgcacagatatgtggcattcggacttgcctcctggcagaagatgaaggcctgaaacagggcctgtcccagaagctgttagcttctgtagtccacactctcacctgtgcagactagtctcagggggatccaggaaccaagatggctccctcagttgctctggccactttattgtttctatttccatttttcaatccttgatggtttgttctattccttcacctgtttgattgtgttttcctgtagtttctgtaattctttaaggatatttttttgtgtttcctctttaaggaagagcttctatgtgtttacctgtgttctctgtttttgtttgtttgtttgtttttgtttttggagacagggtttctctgtatagctctggctgtcctggaactcactttgtagaccaggctggcctcaaattcagaaatcttcctgcctctgcctcctgagtgctggcattaaaggtgtttgccaccatgcccgggctttcctatattttttaaaagggagttattcatgtccttcttaaagtcctttaccatcatcatgagatgagattttagacccgaatcttgcttttctggtgtgttggggtatccagggcttgctctggtgggagaactgggttctgatgatgccttgtaggattagttcctgttgcttatcttcttgtgattccctcttaccatctggttatattcggtgttagctggccttgctgtttctgactggagcttgcttttcctttgagcctgtgagcctgggtgtgtcggcacaactgggggtcaaggtttctctgtatgggactgggacagt

SEQ ID NO: 991 - DNA, 1200 bp, mus musculus
gcatattcaaagtttctcacatacccaaagtaaaatacttcaaagttcccatcaggtcagtgctctggcatttttacatttggggacatttacatctgaaaagatttaaatttcagttaaggaactattctttgaaccattccctgaacacaaaagacacaacatggtggccctgaggctctttagacataattgtagttgtgtgatctcagtgcctcccttggtaccgacctcctggctcttcatagctccttgtgctctggatatcagcactcaagccaagcctagcacactttgtgtgcgaaggcatgctgcttaatgaaaggtgagattttatctttcaaatatgggaattacagctttcacatgaggtggagcctactgctcacagccagggtacaaatccattgcaacccttttcttacacacaattttgcactaaattctactaacatcattttttatatccgtttcttgtatggaatcagatctgtatccttgtgacaaagtgcttgaggtaacttaaagcaatggcagttttattttggcccacagttgcagctatctaagtctcagatcacttaggtcagctgcatttgtgtgtgacatgtgatcctgtaaagtactcagagcatgtgacaagagtagagcttctcacctcatggtgagcatgcctctgggaagcaaagggagttagagaagagatgtggggctccatattcccctcaaagcagtcccatgctgagtaacctcctcccaccagactcgttgttttaaagatgagcacatcaactttaacacatagattttgagaactttaaagaattgaattatagagctttgtgtgtttctatgtgaaacaaacatacttctatctagtcagaaagcctgtctagatagtttctctaataccacatattgcatacaaatattaagtacttttgagtattactaatgaaagactaacaagaaacttaccatgttcataaatgactgtaatcccaacacttgagaagtatgtggagacaagagaaattcagtctcatgctacatagctacataggtagatagcaagttctaggctatgctaaataaaactctgtttcaaacaaacagggataaaatgaatatttataatatacaaaaagctgagatacatgtattttcatcagatatttgtactctttatattttacactt

SEQ ID NO: 992 - DNA, 1200 bp, mus musculus
ctttcaggaatcatagcattaaaatagatacaaatttaaaatcaaattccccaaattagcagcctactcaaggaacatcataacataatttcttctctctctctctctctctctctctctctctctctctctctctctctctctctctctctctctctctccctctcttcctctctctttctctctccctcttaattagagttattatatttcagctattagatttttaattattcttttaaaatttttatttgatctattttttacttattcactttatatcctgctcattgcctctcacccagtcaccccctacacacagttcttccccattgtgcatccccacttctcctgggagtgggtaagcattttcctgggtatcccctcaccctggcatatcaagtctctgtgaggctagctacttcctcttccagtgtggcaaaacaagacggcctagctagaaggtcatatcccaaacacagtcaacagcttttggaatagcccctgctgcagttgttaaggaccaacatgaaggtcaagctgcacatctactacatttgtgcagagatgcctaggtccagcctatgtatgttctttggttggagattcagtctaagtgagttccaatgatccagtttagttgattctgttggtcttcctatcccttacagggtcacaatacttcccctattttttcataagagtccccaaactccatccactgtttgcctatgggtgtctgtatctgtctgagccacctgctgggtggagcctctcagaggtcaaccatgctagactcctgtctgcaagtataacacagtatcattagtaacgccagggatttgtgtttgcccctgggatcagtctcattttgggttggttattgattggccattccctcagactctacttcatccctgtgtctgcgtttcttatagacaggataaattttgggttgaaggtttttatgggtgagctggggtttctgcctggcttgttacttctattcttctattctcatgtaggaatctgaaactcacatatacatgatggaaatatttcatattaaatttccattgaatgaattaccttaactttatggctaattattctctgcatagctactttattaattatcctcataagattatccctaaaatgttcaacagaaagcagtctgttttcaatataacccctgcc

SEQ ID NO: 993 - DNA, 1000 bp, mus musculus
attgcaatatcaagacacattgactctagggactacaggtgtcacccagtgctggtcctgtacttcatcataagagttcccatgtttacaaagaatcctccctcccaaatttgtttggttatagttgcatatgaataaagcagggaaaacagccaaatatctagacacagacatgcttgtatgcatcagaaaaaaatgaagttaaaaaggctgttaaactcaagacccaagctgaccttaaatattagttaatatgtcagcaattttattagatattttatttatttagatttcaaatgttatcctcttttctgattttccctccagaaaccccctatccatcctctttccccgtatcccacccaccaacttgcacctcacctccctggccttcccctacactagaacatcaagccttcataggactaatggcctcccctcccactgatgaccaacaaggccatcctctacttcactgcagctggagccaggggttcctccatgtgtactctttggttggtggtttagtgggagttctgagatttctggttggttggtattgttcttactatggtttgcaaaacctttcaactccttcagtcatttctctaactcctccgttggggacccagtgctcagcccaatggttggctttgagctctgactgagcctctcaagagacagctatatcaggatcctttcaccaagcacttcttggcatttgccttagtgtctgggtttgatgtctgtctgtacttaggatggattcccaggtggggccgtctctggatggcttttccttcagcctctgctccacactttgtctcaattttcctcctgggagtatttagtgctcccttctaagggttgaagcatccactctttggtcttccttcttcttgagcttcatgtggtctgtgaattgtgtcttgggtactcagagcttttgggctaatatccacttaccagtgagtgcataccgtgtgttgttctatgactt

SEQ ID NO: 994 - DNA, 1200 bp, mus musculus
ttgtctggctgtaggtctttgtatatctttccatctgccacagaaggcagcttctccagtgagcaaggcactaatgtgaggctagcagaaagtcattagaatcactttggaattacgcttacagtttctaaaagaagctggtcatggaacacagaaggaggagatacctgaggaggaattagcagaggatgttgaagagattgaccatgccgaaagggagttgtggcgtggccagatcttgtggtttagaggcctgaacagagtccaaacacagatccgaggggtgaatgcatttcgtagttctttatacgaagggttagagaagccagaatcaagaagttcaatccacaactttatgacacgccctgagtttaggatagaagattcagagccgcacatcccccttattgatgacactgatgctgaagacgacgcccctacaaaacgcaactccagacctccaccctctcctaacaaaaataacaatgctgttgacagcggaattcaccttacaatagaaatgaacaagtctgctacctcttcatccccaggaagcccactacatagtttggaaacatcactctgattgtaagctgaatggtaacacactagctgcattgtaaagaaacaaatcgaaactgagtcttttcacatattgtgacggacaagatagtattcttgtctctggacttcaacagaagatacacttgtacgaatgtagatttatttaaaaaataaaaaacaaaaaacaaagctttctgccagactgagggtgcttttttggggtgtgggagaaacgaactgacagataaacagcggtgactcggcatgagtggcctgtgggtcgtcagtggtacctaacgttgtcctgactagcagagctgtggtttatctcagttcatgatggcagggagggaggagtgactctggatgagacagagagccctggatcattgagtgaatactttaatttctgctgttggctgttaataatttggattatttacgtttataaatgatacagatctgtttacaaggtttgtagataatttttttgttcttcatagacgggaagtttccttatagtaatgcagagaaaaattagtccttcaaatactgctgtattttcagtgaaaaaaagggggggtgtttctattgaaactgtaataaaattttgcctacaatttatcttgttacata

SEQ ID NO: 995 - DNA, 1000 bp, mus musculus
gcaagctctcttcttgcaaggcaggtacccagatatctggtgttcgaaccagactcctggcagaagttgtgttccactcactagaggtcttaggatctcgtgtggaatcctgtgtgggcccttgcgggtgtcaggcgactctgctggcaaggtagcccggggctcgagtggagtggaaggggtttgtgccccagatcaagcccgggtagcctgcttccctatgtaccgcagtctcaggttccgcgcgattggattggggcaggtgctgtttccactcaccagaggtcttaggatcccgtggggggtcccgtgtgggcccttgcgggtgttgggcaagactctgctggcaaggtagcctggggctcgagtcgagcggaagggacttgtgccccagatcagggctgggaagcctgcttccctatgtactgcggtctcaggttctgcgcgattggattggggcaggctctgtgttccactcaccagaggtcttaggatcccgtggggagtcccgtgtgggcccttgcgggtgttgggcaagactctgctggccgtcatgcttagtctttatctttttgctttaatataactgaaatacagcagagacactttctaatggataacactttagaacgattcttatttgctaaagttataaaagatagtattcatccatcaccccgtgttgttccaagtaacagtagattccatgtcttcttccatgaaaatgactcgtgaaatatcagctccaatatgaggcacttagtgtaagaatttatttactctaccactatgtggtcagaaatttggactagtgcctgtgtgtattcttccgaacttcttagtggtctatgaggtagacgaggtgccagctaaaacaatacagatagtgagatcaagtgttctcatcatctaacagaaaaacatgggcatagtcttacacactatcaaaaagaaagaatgaaagcaaaggcagttggataagtctctgcttgtgtctctg

SEQ ID NO: 996 - DNA, 1000 bp, mus musculus
aataaaactatggcagaggtttcttatctgaaggtacaattaagggctgaacatgtgatctcagcacatggtctctggcagcctggagatcctgaaacatctgtttgggaaccatgggtggttttggatgctgccagaagccacctccttctcatccttcatgtgtggacctccacagagacgtctcaggtcaggccctctgacatagaataagctttatgatggcacctccaaaggtttgtggagcaagactgaagtgctcaaatacattaaaaattattctgtggtctttactgctttgaagagaacttgtatgttttaaagtccatgcagtaaacaactgaggagaataatggtagtgaacagtagtatttacaatgacacatgttgagaatgtcttttattagtcttgaatctcaacaggaccataacaaacttttgttcacttgctgaacttctcagtccaatgtgagacctcggatatttactagaataagcaggtaatgctttaggaataaagcacattttaaaaaatatatgggcacatagggtaaaatatattaaaaattctttttattaaagtttcctgaatattttattttactagggagttattatttgtgcttctatttattaaaagataaagctggattttgttgcatccagttttcttttcttttctttatatttttattagatattttctttatttacatttcaaatgttgtccccttccctagtttctcttccccaacccccctatacctccccctccttcagcttaccaacccacccactcctgcttcctggtcctggtattcccctatactggggcatagaatcttcacaggaccaagggtctctcctcccattgatgactgactaggtcatcctctgctacatatgtagctagagccaggggtttgaaggggtttgcagccccataggaggaacaacaatatgaactagtcagtatttccagagctccctggaactaaac

SEQ ID NO: 997 - DNA, 1000 bp, mus musculus
tataggcacacctctaattccaaactttttttatataggcacacctcaagtcatctgaagaaaaaaatcttttttacatatttaattttatttctaatgcatttttccacgccgtattccattccctgcccatcccatctaccctccgactgctccacatctcacacctcctccccacctcatcccatctcttcgtggatgcccccaccccctaccccacctgacttttaaactccctggggtctccagtctcttgagggttaggtgcttcattaattgagactgctggtcctcctacaggattatccttctcctcagcttctttcagccttccctagttcaacagcaggggtcagctgcttctgtctattggttgggggcaaataactgcacctgactctttcagctcctttttgggtctttcagagggcagtcatgatagatccctttttgtgagcattccatagcttcagtaatagtgtcaggccttgggacctccccttgagctggttctcactttgggcctgctgctgaaccttcctttcctcaggctcctctcaatttctatccttgtaattctttaagacacagttctttaagaaacaattatgggtggaaggtgtgactgtggtatgacaacaccttccctcacttgatgtcctgtctgctccactatgccacaggagcacctttatgttcatagaggacttatttgtgataaccagaagctggaaacaacctagatgtctcacaacagaagaaaggatacagaaaatgtggttcatttaatggaatggaatactactcacctattaagaatgaggacatcctgacttttgcaggcaaatgtatggaactagaaaatatcatcctgaaggaggtaactcagaacccaaaggacataaatggtatgtaatcactaataagtagatattagccaaaaaagaaaaaagaaaaaaaaacccatacagaatacacaagctacagtccaccgaattca

SEQ ID NO: 998 - DNA, 1000 bp, mus musculus
tattcatccaaccatagagaagggggttggcaaaggtggagcacatggcgataatgtggaacacggtgaagatgagtttgtactccttcaggtccaggacgtggctgtcgatgtccacagcgagttggaaggcgtggaggggtagccagctgactgcaaacaccactaccacgcacaccagcattttggtcattttgtgccttcgctgatggtaatggtcacttgcagctccaggactgacgtggttcctcagcttactccagatacgggtgtaggagaaagatatgatgcccagaggcaaaacgtacaggatgagcagggtggaaaggctgtagactgtaccatacacactcttctcttccccaggccacttctcggtacaggccacaatctcaaagtcaggaatgatctcaatcagggagtattcccggaagatggccagtggacttgccagcagagcgctgatgccccaggccaggccaatgatcaggaagctgattcgcttggagatcttgctctccaggtggtagacaatgcaacgatggcggtccagagcaatgactgtcaaagttattgtggacacttgtaccgccagaccctgggcatagggcaccaaatggcacaagaccggacccattttccactctcccatcaaggtataggtaagagtgaatggcaggcacagggtgttcaccaaaagatccgccacagccaggttggcaataaaaaagttggttactgtgcgcatgctcttgaatttgattaccacatggattaccagggagttgccaactacccctagcaagatgatggagcagtaggccaatatgaggatcacctgcacctcgaccagtttggtgctgtctatgagctccggctccggatcagggggcaactcacctctaggagtagtgtgccctggcccatagggctccactttcacttctacagtttgattctcatctgcctctgcacctaccgggcccatcttcagaaccag

SEQ ID NO: 999 - DNA, 3200 bp, mus musculus
atagaaagctggacttgcatatattacaaaataagtcctagtcttggacctttagaatgaccctcagctgtgccatctcttcctgctggtggtccatctgcctgctggcgccagcatgcttaattttccattagaatgaccatactttcctttgttcatgaatgtcttggtctccttttgtcaatcatgcttgctcagtcaagctaccttctgggtatactacagttaaaccaagttcatctgagtccttgctggaatgcatttgaacgtagctctaagtggtgaccttatcatgataagcaggatataagaattgtaccaccaccacaaccacctcctctacctctaccatcaccaccatcaccaccatcaccaccacatcctccatcatcaccatcaccaccaacgacaactctatcatcttttccagatcacctcagtgtcggctatcaatgaggctgttttaaaattttctttcttattagatattttctttatttacatatcttggcttcccctccaaataccccatgtctgctcctccctcccccctgcacaccaacccacccactcctgcttcccggccttggcattcccctacaaaggggcatagaaccttcacaggaccaagggcctctcctcctattgctgtccaacaaggccatcctctgctacatatgtagctagagccataggtacctcaatgtgcactctttggttggtggtctagaccctgggatctctggtggtactggttggttcatattgttgttcctcccatggggctgtaaatcccttcagctccttgggtcctttctctagttcctctactggggaacctgtgccagtccaatggttggctgagagcatccacctctgaatttgtcaggcactggcagagcttctcaggagacagctatttattgaaagaagattactttcttgctttttctagggtgtagtttctctccacgtgttggcgttttccatctattatcctttgcagggctgaatgtgtggaaagatattgtgtaaatttggttttgtcatggaatatcttgttttctccatctgtggtaattgagagttttgttgggtatagtagcctgggctggcatttgtgttctcttagggtctgtatgagatctgcccaggatcttcttgctttgatagtctctggtgagaagtctgatgtaattctgataggtctgactttatttgttacttgaaccttttcccttactgcttttaatattcttttgttgtttagtgtgcttggtgttttgattattatgtgacaggaggaatttcttttctaatccaatctatttggagttctataggcttcttttatgttcatgggcatttctttctttaggttagtaaagttttcgtctataattttgttgaagatatttactggccctttaagttgcaaatcttcactctcttcttttttttttttttttttcccgagacagggtttctctgtgtagccctggctgtcctggaactcactttgtagaccaggctggcctcgaactcagaaatccacctgcctctgcttccggagtgctgggattaaaggcgtgtgccaccacgcctggctcttcactctcttctatacttattatccttagatttagtcttctcattgtgtcctggattttctggatctgggggggcaggtggagctttttgcattttgtgttttctttgactgttgtgtcatgttttctatggtatcatctgcacctgagattctctcttctatctcttgtattctgtttggtgatgcttgcatctatgactcctgatctctttcctaggttttctatctccagggttgtctccctttgtgatttctttattgtttctatttccatgtttagatcctggatggttttgttcagttcctttacctgtttggttgtgttttcctatgattcttgaaagagtttttgtgtttcctctttaagagcttctacctgtttacctgtgttctcttgtatttctttaagggagttatttatgtccttcttaaattcctctatcatcatcatgggacttgattttaaatcagaattttgcttttttggtgtgttggggtaaccagggttcactgtggtgggagaactgggttctgatgatgccaagtagtcttggtttccgtagcttatattcttgtgcttgcctttcgccatcttgttatctctggtggtaattggttttgctgtctctgactttagcttctccctcctgcaagctgatgtgtcagtactcctgggagaccagttctctcagggaggaatttggatatggagagctgtggtactggatcagcactggggtgtagaaagaggtcagaatgatcctgtccccatctgatccttggtttttgtgtcctgatggctctgtgagggtccgtcttgggccaggaattggaagagaagaggtggtcttacctgtgcttacaggtgtgtaggttctcctgggagactagctctcctggtggtatttgtttatgtagcaaggtagaacaggatcaactttgggtgtagatggagactggataactcctgtcccaggcagctccttggttcctgagtcctgagggttctgggcaggttcctctgagcagcagtggtggtcctaagggcactcacaggcctgtccatattcctgggaggctcgctccctccaggtgctatttgggtatggagccctatgacagaggatctgctacaggtgaagaatgaaaccggaagtatgtttagttttcttatggtcttggattttatgcctaataatgatatagttacttcatcttatttgattacttactgtctttattatgtttctattggtgctataagtcatgcccacgggtgacttgtgaaaggattcagatcacattctatcactgagataagtcagggcagaagttcacatcagggtcctggataaggagctgatgcagagcccatgaagaagtgctgcttactgcttgttccccattgcttgcccaacttgttgtttttatagggccctggaccgcaagccctggggtggcaccactctatggaatgccctcctgtattaactgttaattaagataatactttttagactacaggccagttttttagatgcattttctcaatcctggttcccttgtcttaatcaattctggcagcttt

SEQ ID NO: 1000 - DNA, 3200 bp, mus musculus; identical to SEQ ID NO: 999

SEQ ID NO: 1001 - DNA, 3200 bp, mus musculus; identical to SEQ ID NO: 999

SEQ ID NO: 1002 - DNA, 1000 bp, mus musculus
tggatattttagtagggaacgaagtgaagcaagaaaaaaatatgttgtgatctaactgtcctcattttcaaacacagctcggcaatctgttattggctgtgttgtgattggctgtagtgctctctgatacagcacttaaatgggcatggctgagtagttcagttttttgttaagttcattggaaggccttcatcagtgcatttaggagtgccaggtggccaccaggagagttgttgatggccactctgtgggtttgcaaagtgcaaacctaaaagaccaagagatgagaaatgcattgctatttgtgaatttacgttttatctcacttcacttgaaaatttatgagtagtgtggcttaagggtgctggacttgtgtgttccagggcttgcccccactgataacacccttgttggcgtgaaagtgcaatgcaaattatgacagttacaaccttctgttttgtttaacctgtcagtagatttcctggctcagtgctgagggcaatggtgtgttcagctagtccatattcacctaaacttaaaaggtcaggtttctacaggcaagcctagtcaaagcctaattgatgaggagggcagggagacagaatttactgttctgttggctagtttcatatcgttaggttgtcctgaaagcatcaggcagtcacagcccctttcatgtaagtgctgaccctagacaggagctgacaatcaaaggaggcagccacaggaaccagtgcaagtaggctattgatttttcagttaggtctaagtagtttgtagtatgggtaatgggtgacagaggcaggtatgtcattatcaatgagctccagaacagtagcgacaacctgccctcatatttccttcagcactgacagtatgcatccagaggcggttaataaatcacccaacccttaactgacaagtgactgggaggtttaggttgaggaatggaagttacagagctaaacttctcttcttgaacatatataagagtcaacaa

SEQ ID NO: 1003 - DNA, 1000 bp, mus musculus; identical to SEQ ID NO: 1002

SEQ ID NO: 1004 - DNA, 1000 bp, mus musculus; identical to SEQ ID NO: 1002

SEQ ID NO: 1005 - DNA, 1000 bp, mus musculus
ttctaatactggcttatgcataaaacatgaacaacaattataagacatataaagagtaagttgccaggtgtggtgatgcacaccttcaatcccagaactccggaggcagaggcaggcggatctctgttagttcaaggccagactggtctgcaaatcaagtaccaggatagccaagtctacacagagaaaccctgtcttgaaagctcccaaatataatagtagtagtagtagtagtagtagtagtagtagtagtagtagttgtagtagtagttgtagtagtaataataataattttattaaagttaaggagctgaaatattataatagaatgttctagattttaggtaagctatatttatatttgtcagattatgttgtaattttcaaaatggatactgaaaaattgccctgaatgattactgtatgagtccccccatcatcaatagtccccctataatacttaggaaatatacatttaattatttaaaagcacaagttaaattttcacatatgttttgtaccagttgcaataaatatattccagtaaatataaagctttagctgggcctgatagcacagtactgtaatcccagctacacaggaggctgagacaggagcacatgctcagagcctgactgaaaactcaaggccagcctacccagtgtggccaagttaaaagaggagctccagctcctggcttgcacatttgcatatgtaaggtcctgaattctgtcctctgtttcacaaagacaaagaaaaaacagcagcttcttacagcaccagagagaccctgagaaaaagtaaggtctcccatttaagtgacagcatctccctcttcttttccttggggcccactaaggtactctgcttattggcttacttcctctcctgggctcctctgcctcttcctgtgaacacatttcacttcctcccctcagtcgcactcactacacagtggtttcagttgttctaagtctttctaagtgacaccttccctgtt

SEQ ID NO: 1006 - DNA, 1000 bp, mus musculus; identical to SEQ ID NO: 1005

SEQ ID NO: 1007 - DNA, 1000 bp, mus musculus; identical to SEQ ID NO: 1005

SEQ ID NO: 1008 - DNA, 1200 bp, mus musculus
tttttataggaggagacagacatcagcaagtcaacaaagtcactagtaactatgtctctgtacaggggtcttcccccatgctgaaggggctggaaagtggtcatctgtgccagctagacagtaagaacatagtaggatatgttttgcaaaacacacacatacatgcacacacacatgctgttctgcttagttggtctggctgcactgtctcatgctggaacccagcatatggctttttctttggtatttagaccctgaggttcaaagagattaccgacaataatgatcttcctgtggcaaacgtaatgcagtgtcaggccattttcataggtgctgtgctgtgttgttgtttgtttgtttgtttgtttgtttgtttgtttgtttgttttcaccctcctttctacttcttaggatgaaaatggaaactagaatcaaagcagccacagttttctagctacctctaaaggagtagctactcttccatccagatgatacaagcaaaaaatgaaaagaaagaagacaataatgaagcaaaaaggatgctttgttattgtaatggcttctttctgcttcatgtcactgagcaagatgagaaagatactagttttgtagaaacttccacagtactgtagcatgacctcacccagggtgcactgaccaggtgcctagggatcccgtagaaacatgggttgattttcagcatgaaactagcaacaagtatgaagtgatattttagatggcagtcactgtcctgccagtaattagcaactcttaaccctcagacttgtctatgctccttacaggctgtggaagctcagatccgaagttttggacagacgccttcgcaactgctcatagagccccaccctccccgaggttcggccatgcaggcggtgagtgctttcctctggcctcttcttcagctctctcactctccattaccagtgtctcacagtgcatgaggttctctaccatgcctgggcctactctcctcatacagtgccagcctgctcacaaccagcaagtaccggcatattctccctaggtcatgagaaagcaaatttagctacagtgctcacatttcatcagctcgtggtttctgttgcaaggttcaaaggaccacagttgtcatgtctcttcatcgtagagtaaaggactccacgcataaaaccaaagctttttttttttttctaatttgat

SEQ ID NO: 1009 - DNA, 1200 bp, mus musculus; identical to SEQ ID NO: 1008

SEQ ID NO: 1010 - DNA, 1200 bp, mus musculus; identical to SEQ ID NO: 1008

SEQ ID NO: 1011 - DNA, 1000 bp, mus musculus
tttgttccgtccacttgtttttctaacatgaacaccctgtatactgcaatgtacttgggttatttctttaatccatttgaccaggtttaatctctttacatgtaaatgactggctgaggaaggacttgccatttgcaggctgggtccatgtgctgtgagagttcgatcttcttttcctcttctgtgttggccttctgcactgttagaagtacaggaaggtactcagcataacttgctaagagctggccctaaccaaactgtgcaggggaggggttcacgtagcagagctccctgtggctggtgtccatctgtccctgcaccatcttctcaggagagcaggcagctcctgtctgtagtgaccactacatcaggtcactgttacaaggatcagggccctactcagagtataggctggcccaggcagcattctctcctctccctccctcacctccagtggcaaccgctttgtggggttctcctctgagtctgatgcctgtaagcactgtttgcactgtagaaatgattctgttcacaggtcagtgacaggctgtgtgttctagcagtatccaaacctttcacagactacggaaggtctctgtgctgtcaaaaccgagcttacttgagtgtaccaaaactgtcaccagcagcagcaaatgcatccctataaccaagccttctccatcttcctctaggtgcatcatttctggaatggcttcgggaagcattgtcctgttttacaatgactttaaccgctggcatcatgagtaccagacccgctactgaggggaacgaatgcaccgtggtcctgtttcagcccaagcaaggaaggacttcaaacaccactctatagaaatagctatcacatctgaatgtaacttaaatttgcttgaacaagcaaaatattttttaaagttaattgctatttttgtagactttgctcgacattttggggggggggggggtgggaacagcacaagcagggaactggctgctgggttct

SEQ ID NO: 1012 - DNA, 1000 bp, mus musculus
ataccagagatggatcagtctgtaaagtgcttgaaaaaccttctaatcacacccaggaaagagactcatgcactttaaaccccaggagtgggtctggtggtctgggctatcatggtagatgagaaatacacaggacatggaggctgtggcctcccctggggtcacaccaaagccacagcagtttccttttctgcaggtacacgcagtgagaggtccaagatggaggcagacaggagatggcagcccaagagaagcctccacaggagaaagccttgctatcctgctgcctaggtggcatctactggctggctgtgtcctgctgacccccaacatttttatgtccccagtgtgctcttcccaggctgttctggactcactgggaccggcccctaaaatgaagcattacagctgagaggcaaagagccagggctgtgctcaacccacctcccttcagccacataccagccatgcaatcatgagcaagatgccataaccctttgttggctagaacttgacctgctttttgctagcatgatcagtttttcatttctgcattgcattaggtaacaaatacttaagtaacttgatcttcattaacccgtactcatgttcctcttttcaatgggattcaaaactgacagcaaagagggtatccctatgattcctcagagaagcagcaagaggggaggccagccacttcctagtgccagctggtcctctgtgcctcaaggctgctttcctgaacatctctgatccaccctaggccttgtgatgacacaaatttccatgacgaaaggtcacaggcatgacgatttctgactagctcagcacaatgtcatgaggaaagaggaaaggggcattatctagggaggtcctgctgtgttgggaagaatcctcaccatggctggccatcattgtactgagctgccctccatgaaggacattgtcatgatggagaagtctctctctctctctctctctctctctctctctctctctc

SEQ ID NO: 1013 - DNA, 2000 bp, mus musculus
gtatctaaagtggagagttgaaaggggtagatgaaaggaaaggagctctttggtttttctgtaagccaccaccacctcctgtgccccgcacaccccagctctgaagtaaagccaccagtaagctcttagtgacgttctggtaggcagtcatatgccaatttgatcaggactataacttgcatagtattaggattcatagggacgtggctctggggtagaacaagacagatctgagttcaaaattaggcttggccaccaactgactgcatgctggctccatttcataacctgttagtggttacagccagaatgcatgtgtaagtgcctggcattcgcagcagtggttataaaccacacatttcctgggggagcctgtcaaccccttaaagaagctgcaaaggaggggtgcagatatcagacttaggctctccagcactctagatgaaatattctgccactgaacgacgctcctggtccacgactctggaattttacctataccctgcatgtgcaggaggtcaagagaccacacactgagaaggatccatgtgaagtgccttcttcctccccatcccctcccttcaatattgctgccattagggagaggatagcacaagaatcagggattctctctctctctctctctctctctctctctctctctctcataggtgcacatcaaactatttgagtcactgatttgagtcaatgttttaaatctcctatgccagtgatttccatatcagccatttgagtggctggggttactgtaagaccacagcagtccctgctgtcactgctgactcagagtggcaggtggcggctgttcatatggaagcagaactggtccagggaagctgctgtcttggactctggcccctggcctcctcaccatgttctttagccttgggattcctgggttctggatattcaaggccaggacggcctctcgagcccccacatagagagtgttgccatcgtcactcaggagcagcgtgtcaaagtctcggaggcctttttgttggaagaagctgagggccctgtgcccgtctcctgttgggaggcaatgacaaggagaggatgagaaggagctgaccactgaggcaaaggtgggggaggggtggcaggcctcagcagctgccccccttcactggcggcacccccctccatttccttcatccttcaacagcagggcatcggaactttgtggattgagtccccagaagtgaaaagttccaaagacagggtaatggtagcttgggtactgttggtggtgttggggggagagcctgctcaagacacagacagaaaatgaagtgaggctagaagatgcagtctcaggcctggggggatgcagtgaagcaggatgggagggggagagctgacaggtagacacaggaaggggttctcagccacaggcaacggagatagctgtcgtccgcctcaagatttgtcgtagttacagatccctgccacccccgtttcctctgtctcctcccctcactctgcgatagcaattgcccaccaccagcaatgcccactgcagcagaaaaggctgcttcctctcggtttctgagccccatcagtgtgggcattcctgggagccacctggacagtctgaatatgttggttagtagtgcatgttcactacatatcttggtggtggcatgtgtgcacatacacacacgtgaatgtgtgggttcctgacacactggcacatcagcaaggaggaaagagcacctcagataagtctctagtgagcacatgtggacttttgctttagtcagaggacaatctggctgttactcttttggcctcaggaagcctggaaaccaagaggaatccaaagacaaaatggaaacaatactgcctagattggcttctcctgaactctgaagagagctcattgtacttccccttgaaacgcaggcttgtttgtgcctgcactcccatcccacccagagatgccgctctatccaccgactgctacatctccttta

SEQ ID NO: 1014 - DNA, 2000 bp, mus musculus; identical to SEQ ID NO: 1013

SEQ ID NO: 1015 - DNA, 2000 bp, mus musculus; identical to SEQ ID NO: 1013

SEQ ID NO: 1016 - DNA, 2000 bp, mus musculus; identical to SEQ ID NO: 1013

SEQ ID NO: 1017 - DNA, 1000 bp, mus musculus
agctcaaaacacaaattgaaccccacacaataatgggaagttcaacacgccactctcaccaatggacaggtcattgaaatagaagtgagaggatcccgcaatacctcacctgggcatatatccagaagatgtttcaactggtaataaggacacatgctccactatgttcatagcagccttatttataatagccagaagctggaaagaacccagatgcccttccacaggggaatggatacagaaaatgtggtacatttacacaatggagtactactcagctattaaaaacaatgaatttatgaaattcctaggcaaatggatggatctggaaggtattatcctaagtgaggcaactcaatcacaaaagaactcacatgatatgtactcactgataagtggatattagcccagaaacttagaatacccaagatacaatttgcaaaacacatgaaactcaagaagaacaaagaccaaagtgtggacactttgccacttcttacaattgggaacaaaacacccatggaaggagttacagagacaaagtttggagctgagatgaaaggatggatcatctagagactgctgcacccagggatccatcccataatcagcctccaaacgcagataccattgcatatgccagcatgattttgctgaaaggaccctgtctcttgtgaagctatgccagtgcctggcaaacacagaagtgaatgctcacagtcatctatgggatggaacacagggcccccaatggaggagctagagaaagtacccaaggagctaaaggggtttgcaaccctataggtggaacaacaatatgaactaaccagtacctccagagcttgtgtctctagctgcatatgtagtcggccaccattgggaagagaggccccttggtcttgcaaactttatatgccccagtacaggggaacaccagagccaagaagagggagtgggtgggtaggggagcagaggtggggggagggtatggtagactttt

SEQ ID NO: 1018 - DNA, 1200 bp, mus musculus
attctttggaaagtcaattggatggtattttgatagggcaaacatgtgaaggaatgtttagctgaagtggatacaggaaaaagcatgtttggctaaagcaagcacatgaaaagacacatgatgagagtttctttgccaaagacattcatgtattggtataccttacactgagtagttgagctaaacttttcagaactccatagagaaatgcacaaaaaacttgtggtggtgtgctgcagtgtcttgttgcttcctgggactcagtctgattgaaagagtgatgtcagctgagacagacagactttggaaggcaagaactgtggaggacacctgatgtttggaggtagtataaaagggatttgtgagcagtgatgaagactgagcttggcttgcctatagagctagctgtgcaatgcttgtgggtctctcatcatcgatgatcttcaattctctgagaaatgaacagccaagaatttttcctggtgttcctcctagtcccttctgctgactctacctgctgttgctatcctgactgtactgaactggattgcaggtgtatccacgaagttttgccaagtgaatctagctgtggctgctaacctgtgtactgaactgctgatttccagacaacacagacaggagttggtccaagaacagtttctaaacaagtccacttttttcatatcctctcttttctactacctctggtggtgggctacaagggagggtaaaacatttaagaaccatcattaaaaataaggtttaaaaattgaagttacagtgtggaatacaaaatattgagttccatatcctgagacattctggcttgcttaagttgagtagctagagatacttcataaataactgcattacaatctgtccataagtggctgtgttttggtcagggtatagtgaatatatgtaggttgccaataggttccacacctttgttgcctacataccagaatgatttatttatattcttgagttatttgtcctggggctctgtaggcacagcatatatactgtagtttgatattttaaaatttcatttcattgttggctctctctctctctctctctctctctctctctctctctctctctctctctatgtctctcatccccctttcttacactgtcatagatgttttatagatcatctaccactccattgaggctgtgaatttttaatggtgc

SEQ ID NO: 1019 - DNA, 1200 bp, mus musculus
aagttatcaagtgtgacgaagaaggacccttcatatgcatcaaggggaaagccaccaagagaaagttttatttctgaacacctatgccccaaatgcaagagcacccacattcataaaagaaactttagtaaagctcaaaacacaaattgaaccccacacaataatgggagagttcaacacgccactctcaccaatggacaggtcattgaaatagaagtgagaggatcccgcaatacctcacctgggcatatatccagaagatatttcaactggtaataaggacacatgctccactatgttcatagcaggcttatttataatagccagaagctggaaagaacccagatgcccttccacaggggaatggatacagaaaatgtggtacatttacacaatggagtactactcagctattaaaaacaacgaatttatgaaattcctaggcaaatggatggatctggaaggtattatcctaagtgaggcaactcaatcacaaaagaactcacatgatatgtactcactgataagtggatattagcccagaaacttagaatacccaagatacaatttgcaaaacacatgaaactcaagaagaacaaagaccaaagtgtggatactttgccacttcttagaattgggaacaaaacacccatggaaggagttacagagacaaagtttggagctgagatgaaaggatggatcatctagagactgctgcacccagggatccatcccataatcagcctccaaacgcagataccattgcatatgccagcatgattttgctgaaaggaccctgtctcttgtgaagctatgccagtgcctggcaaacacagaagtgaatgctcacagtcatctattggatggaacacagggcccccaatggaggagctagagaaagtacccaaggagctaaaggggtttgcaaccctataggtggaacaacaatatgaactaaccagtacctccagagcttgtgtctctagctgcatatgtagtcggccaccattgggaagagaggccccttggtcttgcaaactttatatgccccagtacaggggaacaccagagccaagaagtgggagtgggtgggtaggggagcagaggtggggggagggtatggtagactttcgggatcgcatttgaaatgtaaatgaagaaaatacctaataaaaaattggaaaaaaaagaaatgagaca

SEQ ID NO: 1020 - DNA, 1000 bp, mus musculus
ggttcataaaactaagtataggtttcatgacctcattccctcaggacaactatctcaagcccatgccagacaaggttcaaggccactcccctgaatacagaagccaacagtggatattgcctaatcacctgaaccacccaattaagaagtggggccagctttcctgaaggctatagctagttaagagatatggaggctcttcctctcacatgccttcaggggccacatctcccaaactgcccaggaaagtagtaggacctgtgaggagccgccctcacatttgccattacatgatggctctgacatccgttgctcatagtaaaatgtgtgcaggcgtcagggtatcgttccattacctaagccctgcctctcttgtggtgttaactgactgatagtgggcagccaatcctgggggtgcacgtctccaactgttttttcgcagcctataaaagggaagggttttctgctctctgggtctcctctcctgaagctgatcatctatctctccagatgtattaaagctttactgcagaaggatccgagtgacctgcgtgcgtttttctggcaagtcggtagcgtgggtcatctggtgccggaatcccgggaattaacatcgctggtgttggggagtactcccgaagatggggcggattcagaactgcagggaaaaggtaagttcagagagatatatctgatcgtgaacctcttatcccttttgatttcggtcttcaccctaagaaggggtggtagaagctctagtgttggttgctgtctatcgagtgtggtgctgaaatttgctatccatcatggctggtgctaaaattttctgtccattgacgctggtgctgaaattttatttctgtccatcgaggctggtgctgctgtccatcgaggctggtgttgaaatttcaggtgtggtcagtccgacgtagataagcggcagcaccgaggtatctcgtaagcctcccatagataagggagcagagcaccgtgtttactt

SEQ ID NO: 1021 - DNA, 1000 bp, mus musculus
gtgatgatggaattctgtggaatctctagaaagctgtcagtctctgtagcccctcccccttgcacttggctttgagctgtgtgtcaggcccaactagacagtgactattctaaactctatgtctcttctaaactctgttgcttttaacactgcagcctctcaccaccaatagcagagcacaaatgtgaaagtgctgcccatgccaagtttcagaccctgccccctgcaatagagctgtgggactgctgacaaagaaacaaagacagggctggctgaggtctggtaaacaaggcaaggcagggggtgggggtgggggaagagggggcgggcacaataactcctggtgggcagacagaagtgggcaaggggtgggcagggcaaaagagccaaggcaaatgctgcttgggcagggtgaaagcacctgctgaggcctgccaggcaggacaggcactttgcctaaaagcctttcacttaaccctttcctttctgctttgaaaaaaaaaaaactgggagaagaaaggttgcagggtacaatgtacctcccccccaccatccatatcagtcctggaaaactgcattgaagctgtgctcctccacaggaatacctgaatcataatttttaaccgcaaaattttttgctttgctttctaaattttttttctctctctagtattcatgatatatctcaaaaattctttcaacttgtataaacttttctatacggtgcaaaagtcatccaatccttaattaataaccagttttcttttacagaagaactgttaactgcctacccagtggcacaataaacatgatattttcttttttagccatccaaacagacttggatgtgctcctaagcaaaccattgcaggcttaacttttgctatgcactctatcaagataccctctgctggtgtatggcccctttgttataattactaaactggtctatctccacaaggggcctgctgccacagatccacctgagacagcaccaact

SEQ ID NO: 1022 - DNA, 1200 bp, mus musculus
cccaaaataatagtttcagttttatttatttacttttttagaaccaaggttgttgcaaaatcttagaatatagattgggcatttatacctttcttttttgataacactgtattgcattttataatctactctcttattgcttatttcttttgttactggttgtttttctatgacatatataatatagaaactgctaatttgttaagacatttttctcccatcctatatcctatgtcttcatccaattaataccataatgttgggaacaaaataaaggggggcccagggggagcccgggggaagtgggggaaaggaaaagaggcccattctccgccagaatttccctattctctggtcaatcaggcatgggagggctgctacctatcctatccactcatccctgggtgggcattcctgtatcccagtattcagggggtatccaaatggcaggcctgcctggggaaccccctcccaaccactttgctaaagccaccgggttgtaggagagaaggatgagtggaagaggctcccagcaatgaccagagtggacagcaggccttgaaagtgcagagaccatctatggtttaagatctttattatagaaatgcaggggaaagagaggaagtggaaaagggagagagagagaaagaggcagagagagagagagagagagagagagagagagagagagagagagagagagaaagctagagagagagagagaaagctagagagagagagagaaagctagagagagagaaaaaaaggagaaaggagaggagaagagtaagaaaagggaagaagagcaagaagtgagagaagtgagtggtaagaggaaaaaggagtaagagagcaaggtggggggctgagcaccccttttttatggtcttcattgttgctaggtaactggggaggagtttagcctgaaggtcagaaccttgggccattgcttacatgactactgaccatgcttctcttgtgggggttgtgggaggtgataccttaagaaggggccagagttccaggaacatgagggaatgcctaccatattatgtaggagaattatgaccattaggtttcagacctcagttcgactggagaccagtctgtaattccccacactataccttgttttagagattaattttaatttcatgatgttgtacttgtcaatagttgaccttatttatctagttcccc

SEQ ID NO: 1023 - DNA, 1400 bp, mus musculus
ctaaaacttattctttctctctcatgttcaaattctaattcttaatctccttcttctgggaattctgccagagaagggagaggaggcacagtggtagcttctgatagttactccccaacaagaaaagatggttgcagggaccacatcgggaccctcattagctagtttatcatttaaatctctgcctacgttttgccattttttatggtgtagctctgccccatcaattataaaccaggagcaagcttgatctataaaaataaaaatgtttatcaaatcttttttcttaactcgaactcccctttccctgagagaagctttcaggtctctgatgaagaccgctgcgtttgacagtttagttgccatttcttagcggagacaaatcactcactgaggatggcttctcctatgtgcagtaagagcgctcctcacaacagcttattcttctattcgagatgaacttctcttggagttagtctccggggtttcctccgggcaaaggtccttgtctggaacctcacattgaaggcaccactggtcccatccagcaagacttagttattccgtaggtcgagaaggaccagggcctgaaagagaaatgagttgagaaagggaagcaagaccaagcaaaaaggtgtcaaggtctgtttaatgaaggcaaagaaccaggttatacgcacacagtgagagaaaattggaaaggggtcgatggggtataattaaacacagtgaaagggatggacatctggggcagatgctgattacaggcttcttgcaatttatcttggaaagccggccctaaaactgtcgcaggcagccttcaaacattctgcagtttatcttggagtgccagccctgaccccacagtcccaggaagccatcaaacatcttgtagctatcttgtttatctagtttatctgccataaacagtcccaagcaccaaacagagacatggaggtgtaggtgaagcttccttaatctaagcagttctaggtgccaagtgaaggacagagtggagctggcagtctcaggcaccaggtggaggcaatgaagtagggggtgacataattcccttcaaagggtcagccggattttagggtgagagtaactgtgggacttagtttccatggtttggtctctcatatttaactaatttaatagtttttaattaggagcctgacccattttatgaccagcctagaagcagttttccactgttgtaacagatttcctcctcataaggttatggctataacagtcacttgtagccttaattttcctatctgaaacctgcacatttaagccacttggtgatttgctgtatttgtaagaaagtcttaactcctagaaattgaatatctacctcttaaagtgaacaacctgaagaccaagattttgga

SEQ ID NO: 1024 - DNA, 1400 bp, mus musculus
gcttctaacatcttttcaaggttctgtctccaaacttaattttcctttcttcgtttctaatcatgacctataaaatcctatatctttaattacagtgtttgctaacctgttaccgagtcttaaatttgcctgtttgttgatcagtttcatctatgaaattctgcattttttgttctaacctcttttctacctctggtctccaatctccattttccaacttgtcacttattatgatgtgtaaaatcccctaataccttctctatggctcataattttttttctctagggtccaatcttttgagaagacctggtaaaccaagattacaagtaacgttgtaataatgataactggcaagataccaagttcctttaaatccatcctgatcagaccacacaaaatatcatcccataaaacccaaaggggggcttccagttaatgctagtgccatcccaccttgggtccaaacttagcagagagtcccacagtccccagaggactttcactccacaggtgccccggaacacccagaacttaggatcactggagagtggaacacaacatctgttccaacagaaacttgagtgcctagggccagctggagcatggactaggaacccctccagactactggctcgggttccttcaggtcaccacccttctacctcaggtttgaaatcagtggagatctccatggtccctagaggacataccacttccaggttctctaacacacccaggatcttaggatcccaggatcccaggagcttagtcacatcagtatctcagggcctcagaggacacttgacagccaagaactctgacacacacagaatctcaacatcacatgaacccagaatcacaggatcccaataaaagctggactctcagaagttctgactcaactgggattacaggaatgactggctccaatcagaagcagagaggacagggaacacttgagataatcagatagcaggaggcaagcataagatcagaagcaacaggaacaaacgttacttggcaatcatcagaacccaattctcccaccaaagcaagtcctgtttacaccatcacaccagaaaagcaagatatagatctaaagtcacttctcctgatgatgatggattagtataagaaggacataataactcccttaaagaaatacaggagaacagatccaaacaggtgaaattattgaagaaaaccatccatcatctaaaattggaagtagaaacaataaagaaatcacaaagggagacaactctggaaatagaaaacctaggaaagaagtctagagccatatatgcaaacataacaaacagaataaaagagatggaagacagaatctcaggtgcagaagataccatagaaaacattgacagggctatcaaaaattgca

SEQ ID NO: 1025 - DNA, 1000 bp, mus musculus
tttgttttaagcagaagttttgaaagagtctttgacaaatacctgatgggctatcaggttttatacagagactaatggtaccttcagccaacactagagagttactaaaaccagaggattcagttgtcccttcagcttgtttaaatcaacacaatggagaaaaggaatagcttagtagaaaaggacaggttgcttaaagccagaattgagagagagggagctcacatttctgtggaatctgaagttctgttgaattgtccgaagaactgggtaaagtgtgtcagctgtccttgctccaagttttatgccaggtattggtttttgaaccagggcactatactgcagggatccctatgaagcatatttggaagcactaagtgagattgacagtggtagaccaggccagagcaaattctcttctactaggtattactgctaaataagacagacaattccagacagtctttggtgaagtaattcattacttcattctttgaagatagtgacttatactcatttagaggtgatttagggtagaagagaagacactatttccttagtttgagatgttatgcatacctcatcttcataagcaggacttttgtgtcttgctcctaggtgacggattttaacaatcctctcatgggatagtgtaagtatatgttccaagacatgaacctggtcagaagtagattacatgccaaagattcttagatattatggagatttataaacccacttgaacttaacaagttttatgtatgttgtcatggtccattgagacacagaaaagggaagaaaagaatttttaaaagagaagaaataaagcgataaagaaagatgaagtgttatacatgaagagagaagatactaactcactctggatgaagcagaaaagtagagctccaactttttacaggcatacatagacataaacttatatatagaatggagcatagcctcatgaagaaaggtccagtaacctgaaattttttgttct

SEQ ID NO: 1026 - DNA, 1600 bp, mus musculus
tatatttttaaggaggtcagttggcaggacatctgacttgagcaagttgtttcttgtctaaattatgtttgatgaaataaattttgtggtttctgaagcaaaagactttaactattcctcactaatttattttaattggtgactgcaataacatgaagagctcactttgctgggtttgaaaggcagtgagctgagtgaacagtcaactccaatacttgtgaggtatagttttgagcatattctttgagaaatttcaggaaaatgacttaaacttttgtgcatatgttcttacatgtctctatgatccttcataaaaggatgttaggggtccttacctaaagcatggcaaaaggaggagatcaaagagtgaactatgctgaatgttatcaacaattttcctcgagaataagggcccttaacattcttcatgaatgttgaagaataaggaactcacttggctgtgccccttacttctgaaagtactacattcaatgggaggatgtccaacctgcctcaactcaaaacaaagtcgtaagacccagtacactcatctacaaaaaataagccacaagtttgtttagttcctttattgtatgaatgacaactacaaaattatactactacaattgaaaatgcctcaactcttgcatatgcatttcagaaaatgttttaagtgacaagtggagtatgcctgccatcaactcggagctccgacaatggaccagcaatttgtggagattgtacaaggtagttgtgcattacactggattcaacatcttcacaattacatagctcctgaaatgtgtaagtgttcctaatatatctgacccagatgctggagcttggtagtcaaagaagctgccatgcaattctaggtgtaccatttacaaaatgagcagacatatgttgtcagtgacctccggggttgcttaccacactccttgttggtgtacagtgtacataggaacaaccttctcaggcttcttctctcaaatgctttgggactcccaccatggacataaggctccactggctttgctattttgtgacgttgccatggagcaaacaagatactactcaaattggtgtcctgccagtatgtgttatactctacaaatatgtactttgaggtttctatgattttttaaaaatagtcaatgctaacaatctttcctaattactttgtggtttaaatttattgtatagtactaatcatttttgttttaataaaatccattaaaaaagcaatgcaaggaatgatcgctttacctcatagttatacaaactagtctctgatatcaaagagatgtggtggctggtgtttagagcatttggtaactttattcctagcaaggaaataaatgaatggatgaaagtgatcatcaagggttttcttattttatcatgtctagcacaataatagatgcatgaatctaacaattcaacttactaagactagattatcccctataatttgtaatgttcagtgattataaatcctgttaaacaaaaataagcaaatcattaatcatatattttcaatgtgattggcttagaattgtatttataaaacaatgaatagttaatatgccaccctgtt

SEQ ID NO: 1027 - DNA, 1000 bp, mus musculus
ttaggatgtatggttgtggacctggaggtttctatggttcaggaacatctgatccactgaaggtgacaagtgaggtggttggaaaatgaagaaccccctgtgatgagggctgcgcagtgcaacttggcttggcctagagggctcagagcacaggaagtatgtgttggtcaaggaaagcttacctaatttgctcaggatggaggagagatgtaaagaaagtagagttccccttgggagagcagtttcctaagggtagcatgccttagccaagagaataatcaaatttccaatgtctggatatttaaactatagactgaatatatttgataatttgcagtaattaagacaaaggatgagaccaggtccttcattttaaaatagagataatttagaatgatttaaatgttctttgtaaggcaaaaataaaaggcatttagagaactacttaatatttcaattatttaaacctgaacttcctgattacttatttgcaacatgcccctttaactccaaactacatctgataataagaatgctccttattcctttcgcctctctggttggcgccagcaccaggtcaccttggaagcagaatcggcagacacccccacagtacccagagggactccacacttaggaacactggtgagcagaacacaacaatcggttttaatcctatctcataggtcctgagacagcagaagggaagcagaaaaccagcctgaccaggggcacaagtcccttccagtcagcaccagcaccgggtcaccttggaagcagaattggcagacacccccacagtccccagagggactccacaccatcttagggtcactggtgagtggaacacaacattagttctaatccaatcacgtgggactgagacagcaaaatggaagcagaaaaccagcctgaccaggggcaaaggtcccttccatttggcaccagcataggatcacctagggcatggatttggctgacacccctacagtccccagag

SEQ ID NO: 1028 - DNA, 1400 bp, mus musculus
cattcctccttgcaaaagatatttaatctctagcccaccctgaggaattgatatgtaaccattttccatggtgaacaatcaataaacagtttggaatcaaggactgtccctttcatcaagaatcgctgcagtgtggacagagaaagccttcaactactgagccactacctaagtctcccacagaaggcctctctgagcttccagaaaaacgttcactaagctaaagactttctaagcaggagctcccatttccccagctggctcatcattgtttttgtccccaaccagctgggggcaggggtggaggtggcggtggggtggggtgggccagcaaatccatttccaactcttcacaacccaaaagtgcctggatgtctaggagtttgacagcacttgatcctggccttatcacaggcctgtggaccctgacactttgttcccaacttctctcaaattttccagctgcaactgatgccaggcagtcagggaacgtcagcttcggcctcccacatcctaggctttgtttgcccaccctatgagcagtgtctcatgagtccttaaggcccaacacctggcagaggcagcggtgcagggtaaataaaagcagtctagcttcctgattttcatctctccagctgagcttccacactccagagatggggcagaatgcagactcacagtaaccctcatcagctacttgactccatgggaatctaataaggacctcctccatttagtcaagcttcatccacttccttgcttttagttaccttcccagccatcccattgcacatggcctagccactaggtccagaaaggggccagtatttcaggcatgactctgatctctaccccaccatagactcttcttcagctgatcttgtccatgtggttcccataacagaccattttcaataggacagatcctattgagactcctccaagacgctcaggccaccactctgacttgaaattgtagccaattgggttaaaaagaataaaaggcacaaccaacatcctaactctaaatgcctacatgtcatcgtccaaaaccaagcaatacacaaaaacaataagtatgtcttctacaaaatcattaatcccataatgatggtatactggctggttttgtgtgttaacttgacacaggttggagttatcacataactggagcttcatttggggaaaaactccatgagatccagctgtggagtattttctcagttggtgatcaaggaggggagggcccattgtgagtggtgccatccatgggctgacagttcttgggttctataagaaaacaagcaaagcaagccagggaaagcaagccagtaagaaacatccctccatggcctctgcatcagctcctgtttcctgacctgcttgagttccagtcctga

SEQ ID NO: 1029 - DNA, 1000 bp, mus musculus
taaacaactggaaccttttgtgtagaagttaattatttttcacttctttatttacctattcatttgatatcccaattgcagccctctttctgccagtctgcttttgacattacacagctcctctccacgcttcctcaattttttccctaagaaggggaagctcctacctctgtgggtatcaaaccatgctggcacatcaagtcactgcagaactaggagcatccttttccactgaggccagacaaggcaatccagttagaggaacaggatccaaaggcatgcaacagagtcaaagacagcctaggctccagttactgggggacccagataaagaccaactgcacctctgctatatatgttttggggacctaggtccagctcatacttgctctttggttggtggtccagtttctgggagcccctaaggttccaggttaattgacactgttggtcttcttctggagatcctatctcattcaggtccctcaatccttcctccaaattacaagactcacctagctccatttaatgtttaactgtgtatttctgtatctgtttccattgactgctaggtgaagcctctcagcagacagatgtgctaggctcctgtttgcaagcatgacagagtatctttaatagtgtcagggattggttcttgtccatgggattggtcccaattttggccaataatttggaggccactcccttctctgctccatctttgttcctacacatcttgtaggcaggagacattttgggtaaaatgttgtgttggtgacttagtgtccccttccctccctatttgaaaccccacctaggtaaaggaggtgacttgttgaggctccatatctctcactgataggagtctcagctaaggtcacccctgtacactcctggcagcctccctatcccagagatgccctctactaattctggatctcttcctagcacctcctccacacctgataccctccttttaactccctccataccacctttc

SEQ ID NO: 1030 - DNA, 1200 bp, mus musculus
cagaaagatccgccgggaccaagaactccgccagggactggaggaagagcagctgaggcgccaggaacgtgacagaaaattccgtgaggaacaagagctcggccaagaactggaggaagagcggctgcgggacagaaagatccgccgggagcaagagctccgccgggaacgcgagcaagagcagcggcgccgcctggagcgtgaggaagagcagcagcgtctccatgagcgtgaggaagagcagcggcgccgccaggagcgcgagcaagagcagcagcggtgcctggagcgtgaggaggaacaatttcgctttgaggagcagcagcgccgccgccaggaacgcgagcaacagttgagacaggagcgcgacagaagagtccttgaggaagaagagcttcgtcaggaaagggaggagctgctgcaccgccaggtgggtggcaggaaattccgggaagaggagcgactccgcctggaaagagaggaacagcagcgtcgtctccaggagcgtgacaacagaagattccgcgaggaagtagagctcaggcaagaaagggaagggcagcagcttcgccaagagcgtgacagaaaattccgtgaggtagaagagcttcgccaggaagaacagcgccgccgccaggagcgtgacaggaaattccgggaagagaaacacccacgcgaggaacgcgaggaacagcagttgcgcagggagaagcgagatggtcaatacctggctgaggagcagtttgccagggatacgattcgtcgccaggaacaagaactacgtcaagaagaggaacaaagacgtcgccaagagcgggagagaaaattccaagaagagcaaatccgtcgtaggcaagaggagcagaggcgccgccaaatcctggagcctggtacacgccagtttgccaatgtcccagtgcgttccagccctctctatgagtacatccaggagcagaggtctcaataccgcccttaaaagatgctgcaaacatcctggcaccagccaaagcttcaagcaaaagaaaatgagaaacactagggtatccagcgataactcaagtgtttctggttgtgggaaaactctctgatcttagaatgtgtcttttcttacagaatcttaaactatactaatttcatttcctttaattcctgtctttcattcttccacaggtagttcttttttgcaagatgtctttgttc

SEQ ID NO: 1031 - DNA, 1400 bp, mus musculus
ttcagttggggtgaggcctccatgagatacaactgtaaggcattttctcaatcagtgatcaaggaggaaaggccccttgtgggtgggaccatctctgggctggtagtcttgggttctataagagagcaggctgagcaagccagaggaagcaagccagtaaagaacatccctccatggtttctgcatcagcacctgctttctgacctggttgagttccagtcctgacttctttgatgatgaacagcagtgtggaagtgtaagctgaataaaccctttcctccccaacttgtttcttggtcatgatgttttgtccaggaacagaaaccctgactaaaacagaggtctaataggttatcatcatggtgggaagcatgtcatcatttaggcatgcttggtgcttgaaaatccaacagctctacatcttatagcagactctaacctagaaccacgtgatccaagctgcccactgctgctgattgctggcactggaacatgctccctttgcttcactgcctaggcttggctggcttagaaattgttctgtaatctgaccttgaactcagagatctgcatgcctctgtgtcctgaatgctgggattaagagcctgtactactaggcctggacataatccactacatttttacaagatgcttataaattctgggctgtagttccttccagatagtcaagttgacagttgagaagagctatcactgctgtcaagaagcaactattctttggacctaatagttttggccactggtggtttgagaaatctgtgtagagagaggacacttaggaaaggagataggttagaagtttgaaggagttcccagtagtggggagattctatcagaatctgcttattttgtctccttggaattcagggctggtgggggagtaccctcatagaggcaggtagagggtggtgggaatagggagcttccagaggggaggcctagagaagagataacatttgaaatgtaaataaagaatatatccattaaaagaaaaaatcacttaaaaaagtgtacgtacccttatgaatacatcaaataaaaaagaataataaacttataaaaacaaaaaggaaaagaggtcatcccagaaggattgctatagagttgggcattagactggtaggtgttctacaaaaagtaatggataggggaagatctatagacatcttccatgtttcacattcaggattagtcagtgagttatcagtgagtgcatgctggagttacgggtagaatacagcaaggaaatagggggagagaccttataaagaattgtcagtgggactcatatgagatgtagtcaggcagaaagaaagagttcagctgtgggtatgatatagctctatagatgaacataggcgattgaagttggcgtggag

SEQ ID NO: 1032 - DNA, 1000 bp, mus musculus
cgtgagtgagatctctcggtgttcacagaaatctcatcaactttagtatcactcactttcttgttcttttgagacgaggtctcttgcccaggctggcctccaactcagtctatagctgagattgaccttttagcctctggacctgttgcctccaccactcaagtgatggagttacatgtatgttccagcaagcccaacttattctcactttaaaggaaactgaggcacagagttcagtaactgctcaagattgtgtttctagtatgcaaagtcagggttagaattcaggaaaactgtcgccagagctataaagtccccactgtacttgacttcagttaaaggagacagtggtcacagttgtcatcaatggggacaatagcagggcttcacaacaaagacagtctttatggttgagtgtttgtgggtggagttttctcaggctggcagagagacccaccctctgtgaagagtgatggctgacaggtcctctgtatgtttctcagggccagtgtggttcctgttgggctttcagctctgccggggccctggagggccaactcaagaagaaaactggtaaactcttagctctgagtccccagaatcttgtggactgtgtgactgagaattatggctgtggaggcggctatatgaccactgccttccaatacgtgcagcagaacggaggcattgactctgaagatgcttacccatatgtgggccaggtgagaccaccgtagtatgtagccgtgggctgctccttccccgggcatggttttgttttctgttagcatatcctgctcctttccattttttttttccttttaattttgagacaatatcttactctgtatcccaaactgatcaactaggtatcctaggctggccaccctttttttgagacaagatctcatatagcccatgttgtccttaaaagtactatgtagctgaagacaaccctgaattcttcctacctcaagcttccaacaggcctgggttccag

SEQ ID NO: 1033 - DNA, 1000 bp, mus musculus
ctaagggactcagtgtcctctcctggccccaacataggcacaggagcactgtgtatctatttaaaccacacacaaataaataaaataattttgatcatgaggaaaaacatgatcaaaatgtatgaaaatttttttcccaatttttttccctcttccttcatcagccgggtctcatgtgcccaagctggtcctcaactcatcgtgtagccaagtatgatcttgaatccctgatcctcctgcctctacctcccaaagagtaaaattatagacacgtgtcactagaccctattttacattttttaaatctcggtagacatcatcttttttgcgtttttgttaacttgacacaggctagagtcattttggaagaggagacctcaactgagatgatgcctgccgcagcctgacgcctaggtctgcatcttcatggatgatggattgggaggactcagcccacggtgggcagggcccccctgggctggtggtcctgggtacgataagaaggcaagctgagcaagccagtaagcagtgttcctcaatggcctcgatcagctcctgcttccaggttcctgccaaggcatccctcagtcatggactgtgctgtggaaccataagctgaaatacaccctcccctcccaagttgcttttggccatagtatagtgttttatcccaggagtagaaaccctagacagtgctcatttcacaccgaggaaaatgacccatgtatgtttgggtgtgcaagtgcatatagagggaaccaaagctaaaagcacccccctccacacacacacacacacacacacacacacacacacacacacacacacacaaagaagggatgaaatcagatctgtagggctcagacagtgaagtgtgtacctcaccagccccaggaactgggatgggaccacagaaaccaagtaaacactctgggcatatcatgccctcacaatcccatgctcaagggcaagcagtggtattctggggctccctggccag

SEQ ID NO: 1034 - DNA, 1000 bp, mus musculus
agtccagcaccccttcatgataaaagtcctggggaagcccagcatggacgtgtatgcctttaatcccagcactcaggaagcagaagcaggaaggtctctgggttcacttagaagtgagggatgctatagaattggttgctaaagctgatggacaagcccgacatcagtggaggaaaacagattttggaagaggcggtgtttgtgttcaatagatacttgaacattaacggttttccctcagtggtagagaaatgggaaggtaaaagtgcttgtgatgtcttggttgccaccctgattacagctggaaggaactaaaacccacactgggtgtgcctgggttacaccttccaggttgatatgagctccaccttcccgtggcagcctgtgtaagaacttggaagaaggaagctggctctttgtcggcttgcccttgctcttgctggaaagtcctcacttcagtggcacagaagcctgcttcttcaggattccagcgtgtactgaagacagccgagacctcctgcctcatggactgaacaactagtggattcttggtaaacattgttggattagctggctgtagcctgtaagccactctaataaataatatgtatactacattaatatccatatgagttatatactgtttatgtgaatagataaatacgcattaatatacatatatgagtatgtatagaggatcagctctgctcctctagaaaattctgactaatacagtgcagtttgtgagatgactagagatgtgaaattcagatgctcacatttgaatgtcctaaggcctgcatagggagttggggaaagatttaacggagtggtgtcgttcctgtgggaggaaattctggctggcactaatgcccctgactgggcacacagactgggcacctcagggttgccccacaggtttgtaatggcaatgagagcattgtgcatgagcaggcatgtgcggctttcaccggagctaggaaacaccgggggacttggt

SEQ ID NO: 1035 - DNA, 1000 bp, mus musculus
gcccagaattcttcttctttgttttctattttcttccagcctgtctgaatttgttttctatcctttccaggctaagtctcttctgggtaggttagcttgatcatctcaggccatccttaggctgtccatcagctcttgcactgcctgagatgcctgggttccgctgccattttcatgagaacctaacagagcacacgacagggactgtgtgtccagaacacagcctagcatgtggtggactttcagaactctggtcatcacgaattattaggcatgggtaaaatgcaaatatggaggcgtgaagcatgttcatgtctccagttggcctctggtgtagaaggaggaccaggaagaagttgattttcttggtaatggactgtcagctccagctgggaggatgcagggcagagctgtggcaggctgttttgtgtgtttgtgcaacatgaatgatgtgaaagttaatgatttcaggtggtgtgggtggggcccctgcttcagctggcgtgtccatcctcactagatctaggaaaggcccttttactgtacagctaagaaaaccataggggttgcctgggtgccagcagggcgggaaatagaaaagagaaagtcaggggtgaagaagcacctctgataatatcgccgtgagagtgggaatagtcgcactgtgggatgcgtttgggctttacttcagcaagtagggttggtggagctgtctgtcctccttgggtgggcccggctgtcagctgccatgagaaacagtcttctggcaggcagctcatgggatagctgtgcttagctgcacagcaggtcagattctgtgcattcgaaggctaggggtggcctttcttcaaggaggtgtattacatacgtgtggccttctgataccttgtgtaggatcctgccatagagtaccaggcagcaacccttcttcctgggcttctttctaagaaatgtcccacttccgattcagggccatgtgctgtcacgtggcttgcacact

SEQ ID NO: 1036 - DNA, 1400 bp, mus musculus
gaactctcaaaacctttttttttgcggattacacatttttattagatattttcttcatttacatttcaaatgctatcccaaaagtcccctataccctccccccaccccaccctgctacacaacctacccgatcccacttcctggctctggcattctcctgtactggggcatataatcttcacaagaccaagggcctctcttcccaataatggtgcaactagagacagggtttgacagcaggtacctctcattggcttggactgagagtttggggaaacggtttttgcatgtgggaatgcttggtgctgttccaaccaggctgataggcatgcctctcctgtgggagctgtggggatggtaacttttacagaggtcagggatccaggagacagggtcagaagcctgccatcccatcttacgtttgcctttggccatctggaaatctctggtgttagatattctagctgtctctggctggagtttgttcctcctgtgattctgctagcctctgtcagcactcctgggagtccaactctctctcctgagccccagtggtcaaagctctctttgtaggcaagctctcctgttgaagggaaggtacccaaaggtctgggtctcaactctgcctcctggctgaggatgaaggcccaaagataccatgtccaagaagttctgttgcttctgtggcctgagtgttctcctgctaggacttgcctctgagagaccggggatacaagatggcgctctcacctgagaccgagggctagagccctttctggagcccgactctcctcagtgattcttaggtcctcggtgtgctaaggtgcctgtggtgtggaaagtcctctgggaaccatgggaccatctgccaagtttgtgcccaaggtggggctgggctggcgcctactggaaagaacccctctccaaagctttttacatgaatggatgctgtattttgaaaaaggccttttccacatccaatgagatgatcatgtggtttttttcctatgtttgtttatatagaggattatgttgatgaatttccaaatattgaaccattcttgcatctctgggatgaagcctacttgataaaggtagatgattgttttgaaatgttcttgggtacagtttgcgagaattttattaagtatttttgcatcgatattcataagggaaattggactgtagttctctttctttgttcggtctttgtgtggtataggtaccagtgtaactgtggcttcatagaatgaattgggtagtgtaccttctcttactgtttcatggggtactttgaggaatagtagcctttgaccttctttgaaagtctgatagaattcttcactaaaatcatctgtccctggacttttcttggttgggaaacttttaatgactgcttc

SEQ ID NO: 1037 - DNA, 1000 bp, mus musculus
cacagaatgaaccagtctgggcaacttaatgttttggtctggagatatggttaggttccatccctagcactaaaaataacaataacaacaaaagaatgaatccagtgatacttagtatcattggataagaggttatcaaatctatgaaggtaagagcagacataacatcaggaaactgatctgaaagtcccctttggctgcagacaggcaagggtgctttagtatttcaatgttgcatgtttcagtgctgcatgtggacctagatggacggccagctttcagaggaccctattatctgatcctgtaaagatatgatgcttaggaggccaaggtcataggtttgttctctttgtgggtcacttcactttgctccagcccatgcctcagacctgccccctgcaacctcagctggctgccttgtaaatacacttaggctcaaataatacaggagcatgtgataggaacaggacacatctatcattactagggcagcagctgaaaacacagtctgcaccatcagtgaggactgtcagtagcgtgcttccaacttagcatagcactttgtacaggggctcaattcaaggcatctatgactagcacatgcagacctgagctcattgacctgggtaaacttaatagagcagcaactctgggcaccatagcttctgcacagagcagaacacaagcagcattcatgggacttcagccttttctaaagatagttttgccagagaacacatggggcctcctggcatgacctagagcaattgcttagacttggagatatgagcacctatctcttgattgacctgtctgctgtcaatgtttacgtccacatgcgtatacgaaggtggtatgttttagttctaggctgaagctcagtcctatgctcttcgctgaagcactgatgacagaaaagctggtctggaatctccagctacacaaataaatactgcagcaaggcctaacaggaagaccctcactacccaatttcttccag

SEQ ID NO: 1038 - DNA, 1200 bp, mus musculus
ttgttctgttgaggaatatttcccctgtgcccatatcttcgaggctttccccccccactttctcctctataaggttcactgtctctggttttatgtggagttccttggtccacttagatttgaccttagtacaaggagataggaatggatcaatttgcattttctacatgataaccacaagttgagccagaaccatttgttgaaaatgctatcttggacagtactgggtcaccttggctgccaagtccactgacacccccaaagtcctgaaaggactctccatgcgatcttaggatcactggtgagtggaatacaacttgtgttccactccaattgcaggggaccagctttagggaagcaaaaaacccgacctgaccagggtcataagtcccttcctgtgagcaccagcactggatcacctgggtgaggagtcagaggacacctccaaggtccctagacgacagcttctgaggcagaccccgtttcgggcaccagacatccgggcaccttccctgccagaggaaaggtgtccttcccacctgggagagttttgcaggagcacttggggaagtcatcttagttcccagatccttctgagactagtctgcacaggtgagattgtgtactacagaagctaacagcttctgggacaggccctgtttcaggccttcatctctgccaggaggcaggtccgaacgcaagatatctgtgcaccttccctgtaagaggagagctcgcctgcagagagtgctcagaccactgaaactcagaggagagatctagtctcccaggtctgctgatagaggctaacagaatcacgagaggaacaagctctaaccagagacaactataacaactaagtccagagattaacagatggcaaaaggcaaatgcaagaatcttactaacagaaaccaagaccactcaccatcatcagaacacagcactcccacctcatccagtccttggcaccccaacacacccaaaaacctagaccaggatttaaaagcatatctcatgatgatggtagaggacatcaagaagggctttaataactcccttaaagaaatacaggagaacactgctaaagagttacaagtccttaaagaaaaacaggaaaacacatccaaataggtagaagtccttaaagaaaaagagaaaagcagatctaaacaggtgatggaaatgaacaaaaccata

SEQ ID NO: 1039 - DNA, 1400 bp, mus musculus
gccccagatcaggcccgggtagcctgcttccctatgtaccgcagtctcgagttccgcgcgattggattggggcaggcactgtgatccactcaccagaggtcttagggtcccgtggggagtcccgtgtggacccttgcgggtgttgggcaagactctgcttgcaaggtagcccggggctcgagtcaccctgtatttctttaaaggaccaatttgtttcctccttaagggcttctacctgggtacctgtgctttcttgtattttttaaaggcagttagttacgttttctttaaggttttctatcatcttcatgacatgagattttaggtcatagtcttgcttttcaggtgtgttagggtatccaggatttgttatggtgggagagctgggttctgatggtgccaagtagagttggttttttgtttcgttttgttttgtttttggcttggtttggtttgggtttttttttttttttttttttttgcatatgttcttgtgattgcctctcaacatctggttatctcaggtgttaactggcattgctgtctctgatgagatcctgtcccgcctttgagcctgtgagtctggttgtgatgaaactccggggagtcaacttgtctctgggtgtgggagggaatctggagcaccaattctgccccaggccaagttgtgggcaggaagaaagatgtatctctggcaaggcagggcagatagggccttcttccactgggccatgtgggggtccaacttaggccaggtattggggtggggggtatctcaccagtgaatctggttgtgatggagctcctcggagtcaagctgtccctgggtgtgggagggggtctggagatccagctctgccatgcactgatttgtggggatagaagcatcttttaatggccagaagttctaaaagaaatgttcaatgtccttagtcatcagggaaaggcaaattaaagtgactctgaggttccatcttacataggcaactactgaaccaccaaccaaagaacatgcatgtgatagacctaggcctccgacacagacacatatgtatcagatgttcatcttggtcttcacatgggatccctaacaactggaacaggagctgtctctgactctgttgcctgcctttggactactttcccctaactgggctgccctttctagtctcaatagggaaagttgtgcctagtcctactgcaacttgataggccaaggtgagttgatatccatggtaggcctcccctctctgaagagaaagggagagagggatgataggagggaagaggagaggagagggagggactgagaggagaagagggaggggaagctgcaatcaagatgtaaagtaaataaataataaacaatgaggttataaggctaatgctttgatgtgtag

SEQ ID NO: 1040 - DNA, 1200 bp, mus musculus
cagccatataaaattcccccaaattgtggaaaagtacagacataagagaatctctcatttgacactccagtccttggcctgggacagtaagaaaaatgttcccaaggactgcagagatctttcccattgttcaactcagcattccacacaggacttaatgacagaaggcgttgcagttgtaattattctcctctgggtcctaccccaaccaccctgcaacaggctctctgcagccctgcccaatcccggtagaagggaaaaggcacaaagagggatgtttgtggccagacagtctccaattagtcaaaatgagaacaatgactggcttttcctctgggccagcctggaaaaacatcctgcatgtttgggtgggtgaggaaaagaattgcaaatggcattcttccggggtgtataatgtctgtgacccacgccaccccagtggtcagagcctcaggattcaaagacaccttggacaggaggcctagaaaaagtcagatgtggtaggccaaccatttcttgcatcagttagtgaggcaaaagcatcacctctgggcttaggatgcgaaggactgtcttggagttgagtcccaactctagaatgtagtcattagacacagaatagagtgggaacctacgatctgaaattttatgagagagagagagggagagagagagagagagagagagagagagagagagagagagagagagaagacacggctgctcctaggtattgcggagaagaaagtttattgtagatacaggggagaagagcatagctagaagctagaacttgggaaagtcccaagttgacatgaccctgaaccatctgaggagaggcagaggggaagggagagagggaaatgaggtgcaacaacctagagggcaaagggtaaaacaacagggtggtaaccaaaatggccagattacatagggaagagcctctggggaaccagcagcctagcccctaggttggagagttcagggtagagggtgtgccagccatcctgtaataggtctgaccactgagggattgagtccactttgatatgtaaaatcggcccctcaacatttgtcccagggattgagacctcatactctcttttctttccctaaaataattcttttccatgtgcttggcacactaacatttgaaaagacaggactatcctagatagctgatggagatgggtttctaag

SEQ ID NO: 1041 - DNA, 1200 bp, mus musculus
tgtcgcacatgctctcttcactgcagcatcagtgaccatctgaaaatggtcctgaccatcaggacatcagaatagataaagatggcattctctgctctgtcttcatccaatcctggctttattcatgtcattttactttctgtttatatttataattctgtcggtgttaacaattgctaacagttccttcccttccttgttaatgtttctagaatgtgattccttgccttccataccaatatcacctgaatcttgcactgtttctagcacccacactttggatggtcccgctttatcttctccataactcgggaactgtataaaatgttgagagcatcacagacttcaagtagacctggatgctatatattaagtgacatctcattttactttacatgtttttctttattgagtcacactgagttgattctttctgctcatgaaagtgttccagttcaatttttcacaaaagccaaactcacaaatagttgctggtgttagtaaaaatatttctctgagaatccattcagtttctgtctgcaccaggagctgatcctgtgccccagctctccatactcaaatactgtcagtggagagttggtcttcctggagtgccaacacacctgtgagcacaggtaagaccaccacttctgctcaaattcctggaccaagagggacccaaccagaaccatcaagacataggaaccaaggaacagccagggacaggatccttctggtttctgtctgcaccccagggctgaccctgtgctacagctcttcatacccaaattcctcctagaaagaactggtctcccagaagtactgacacacaggcttgcaggaaggacaaactacagtcagaaacagcaagaccagctaaaaccagagataaccagatggctagaggcaaggacaagtacataagcaacagaaaccaaggctacttggcatcatcagaacccagttctcccacaacagcaagccctagatatcctaacgcatcagaaaagcaagccctggataccccaacacatcagaaaagcaagactctgatttaaaatcacaccccatgatgatgatagagaactttaagaaggacataaataactcccttaaagaaatacaggagaacacaggtaaacagctagaagcccctagaggaaaaacaaaaatcccttaaagaattataggaaaacagaa

SEQ ID NO: 1042 - DNA, 1000 bp, mus musculus
ttgaattaatattacataaagcccgactctctcccgcagcataaatgcaccacatcggcccactgtgtaaggcagtctgttcaggaatgggggcacatctgtgagtaaggcaaacatgatcgggctcatcttctaggagtgagagacagtcactaaccaggaaataagtcaagcagaaagcatggtggaaggccataaggaagagcgcagcaaagttgctcagggcagagcagagaggccccttcgcacaaaggagataagggacgtctttctgaaaggtgatatttgagatgacttacaagaagacactagtggtgggactgagggtctagggtgtggtcagtctgcagagaagatagcaatagaaagctgagagatgagtgaacagccccctccctcaacaggaaaaatgggtgtggcccaactgcctagggttttatagagactttggacttaatgccaaagaagtcagttttgatagatgataatcctgacggcaaacattgtgttcctttcccatgtaacccgagcatcttgttgaagtttcctttaaaactgctgctttgctggcaggtaatggttgctagggaaagggagtttattttcttcagtggtatagccgctgatgttacccgtgcgcctgtaaataacctccgggctaagcaagactgagctcagtgagtcacagggaagcaaagcaaaccaaccaacacatgtgcttaaaaactagctccttttattttttttttagaaattatttgtgagtacactgtcgctgtctaaagacagatcagaagagggtaactagatcccattacagattgttgtgagccaccatgtggttgctgggaattgaactcaggacctctggaagagcagtcagtgctcttaaccatcgagacatctctccaacaccccctcccccccaaacaaaacaaaacaaaacaaaaccaactggctccttttgaaaacaagcatggctgatgcaggggatatcttt

SEQ ID NO: 1043 - DNA, 1200 bp, mus musculus
ttattattattattattattaatttcttttacccctggtttaaaaagctccagcaatgaaggtccgcataagctcgcacaagctccagaaataaagaatttgtggattcacgcaagcagacaagaagggctggagcagggcaggccatgagcgacggtggtgagctgggagcctggacagccctgactcccccacccactgcttggtctctcccctgctgactcctaggcagctgaattggaagccaacctggggctagggttgctggctcaaaaagaaagaataaatacaagaagggaaacggtggtagagtaaagccattgacagataaaagccccccgcccccagacatccgggttaagtatatcctgctctgcgcatccttcatttgttcccctcggtctccttaaagctgggagtttagtgtcccagatgtcttctgccttggcaacttggttgtgaggatagataacccttggatacaacttttccttgctgtgaggttgcataaaacatcagtggggatgggagcaaagggggtggaggacccccctggcctgtgcttttcacagctcacataaactatcttaaacatgtctggatggtttgtgtatgctcggcccagggagtggcagtattacaaggtatggccctgttgcagtaggtgtggccctgttaaaataggtgtgtcactgtgttggtgggctataagaccctcatcctagctgcctggaagtcagtcttccagtagcagccttcagatgaagatgtagaaccctcagctcctcctacaccattcctgcctagatgctgccctgcttccaccttgatgatgacggactgaacctctgaacctgtaagccagcccaattaaatgttgtcctttataagacttgccttggtcatggtatctgttcacagcagtaaaaccctaactaagacatatgtccttggcctttggttgtgaccatgaatggagactggccatggagacagattctcagtgcttgggctgtggccacagagtcagcgtttgaaatcccccagatctctatttgtcactaaggacacagtgagcaaaaccataatgaagaggccaggctacacatgccgtgacaaagcttccctcctgtctccctccatgcgaagtcccagatccacaggacccagtgacaaagcagctgtaagttttaggccttt

SEQ ID NO: 1044 - DNA, 1000 bp, mus musculus
agaacaataatcaattcccgatgcaaaattgccagtgtctaagcacataagggtggcagagcaactgaccctttacaactttgtccctttgccagaaccggaagcctgaagagccaggaaatgggacagccttccggggacaaacaggcagttctgtctctggggatgtgcttagcgctctttggtgcatatttcactgaaggtcctgttatcaggattcctgatgccatcacaggaaggagcctgaacacaacggaagcctaggaaacagatatcctagagctccagatgaacgtccccatgcctgctgtgctgtacagctgtgcctctaaaatctgagggtgggagctgttcaaggatacatcctggggtccctgtaccctagaatccagagcctggatcacacacacactgcaggctacaggaccaagaatgctctctggtcacaagccttttaggagaacttcgccatctcaaggctacatctggttggaaagattagagtaaataggtgaattaaataggatcggatccacgttgctgccagaggccatctgtggtctgggttgccagtggaaggcctgttgatggctgtgatccgtgctgccaccaaggatcaggttgatggccgtgactcgtgctgccaccagaaaccatatggaagtccatggtccgtgcttccaccagctgctatgggcaagggagcttcttttgaagtggcatcgatgactgcagactcataaaggagaatgagggacattgaaggctcctgtgacacaccccaccctccccaaaagaaatggtccacactggaagctattgagcagtattcttaaaaattgtgttaaggatgctgatgcgtagctcttcagttgatggcttccggtgggggtgggaaggacggttttctttaaggggttgacctactgggcgtttgaccatgctccagtgagtatatgggcaatataaattagacttggtggagttttttgttttcttt

SEQ ID NO: 1045 - DNA, 1000 bp, mus musculus
aatgtattgtgatgatggctatttttatgtcaacccaacatagctatagtccttttagaagaggaaacctcaactgagaaaatgccactatcaggtaagcctacagtacattttctttattgatgacctggaaaggcccaggctattgttgttgggaactattaagacaacactattgtcctgatctctgaattgggcctctcccccgaccccttgagaagaaaaagggggtcaaaagagggccacggacacaccactccgagaacaaccacagattgttccagccctaagtcagtgctggatgtcctgacctcaagatgtaccctgataccaccaagttcctgcttccctgtgtagttgccaaaagaaaaatttccactgccccatcgctcctgctgagaagtgcttcctcctttgcttgtgcatttccgctgccccattcctcctgctgaaaagtatttcctgtttgcttgtgaatttaagccttgaaccttgctaatacagtgagaccttgatgtgactcagactgcttccatgtgtcgttcattgcacaaggttctcatctctctctacccccccatttggttcttaggagaaggtccccttgagaccctcaaataactggacctgctagacgggtcatattgtatgtggtgccatcactgggtagtaatcctaggggtacataagaaaacaggctgatttccagagtggttgtacaagcttgcaatcccaccaacaatggaagagtgttcctctttctccacatcctcgccagcatctgctgttacctgagtttttgatcttagccattctgactggtgtgagatggaatctcagggttgttttgatttgcatttccctgatgattaaggatgctgaatattctttcaggagcttctcggccattcagtattgctcagttgagaattctttgttagaaaattggacatagtactaccggaggatccagcaatacctctcctgggcatatatccag

SEQ ID NO: 1046 - DNA, 1400 bp, mus musculus
catgactactctcctaatctgttggtcttgaaacaataattttttaatttttgtattgattctttgtgaatttcacagcttataacccaatcccactcatctccctgtccttctatatccactctctgcccttgcaacctcccacaacagaaaaaaataaaataagatttaaaacatgaaaatcttgtggaaaccgtggtgtgttatagtgtgccccacaatatacccttctatccacacatctttacttgcaaatgttcattgcagtgagtcattggtctggcttgaggcctctggctactgctacactatcaatactggatcttcacagagtcttggatagcccgaggttgccctgtgtcatggaaatcctgaagatttgaatctgcaagacctgccccttcacatgctccaacaaatcatagatggagatgttggggtgagccaactcaaagccttggatctggtcctgggaggtaactgatttgatcagtgcaccgactctcatgtgctcacaccactagggcaaactcagccagcaatcagggccaggtctactatactgcccagttcacgtgaagtgcagggcgaccagtcaggggtggggacagctctcccactctcatgatcttggatccagctgaccctcctacctcgccttatcctttctaccttacaaataaatgagagtcagtctatggttattttatttggctttgacaattacttggggtgggggtggggggctaatctacttttctaactgctggcctggctgcctccccagtggtgttccccagggacttgctgtttctcctggccacgtgatcacggtccatctccatttgtggagccttctcttctctttcctcttgcttcttcacccccaatcaggcaacttaaaacccacctacctcgccgggtagtggtggcacatgcctttaatcctagcacttggaaggccgaggcaggtgggtttctgagttcaaggccagcctggtctatacagagtgagttccaggatagccaagtctgtacagagaaaccctgtctcaaaaaaacaaacaaaaacaaaccaacaaaaaaagacaaaaaaacccacctatctctaatccctccagtaataggctgtagccaattttatttaaccaagagtttcaaattaaggagccaagtttgcacaacaaaaccttgtaaacctgagacctcactcccaggcctagacctttgattacagaatttagcaatctacaatctacaatacatagtcacaatctacaatacatagccacagagcaaacctcaacaatcccccttttttgtctaaataaaaaggctttttctcttacagtaataaacaacatactgtaggaacaattgtgaagtaattatgaaaatta

SEQ ID NO: 1047 - DNA, 1200 bp, mus musculus
ctatcttaatactgaaacttactcctcatttgaacattacatgtcctccaaatatctgtaagatacgggcttaggccctagtctaagctacactggaagatggctgagacattaggatgtaagtcctagggagaagtgcttgtgtcacaggtgctctcatagaagactgtgagactttggtctcttcaccccttagccatgtgctgagtgatcttactctactacatgactcccaccagaatgaactgccttgccacaaccctaagccataaggccaacaaaccaccagttgaaatctctaaagcacattaataatggcttaattggttcttcattttcattttctaacaaattatattggctctgggacctaaaaagttttaaggtgtctcattaggcatctaagtaaaccgtatgttgcagctaacatttctaaataatcaggggaaactgctgcactaagcaaatcaactgcaaagagctaatgtaacatgtagaaccaatctgtaggtggaaatttttacattttaggtcccaatttttaaaaaatgtaacggaagattgtttcaagtattgaaatctgaacttttagcctagttaggacattccatggattcaacaaaggaagacctttatgatgaaaaggctctgctccttctgatagaaggaaacagccatgtttaaaagtgatgcctgatcgaggggcagagaaagatttgatagaatgagtcagagacaggatatgctgaactctcatgagaacagacaggaaagagaggaaacttaaaataacagcacaggggcaggggttgttttacagagacgggctgcaggtgaagatggaacgggccaaagaatgaggagccaaaaaattagaacagattgccagagttagtacgaggccgtgcagagcaatccattctgaagctgagagaagcaggtccgttgaatcagtcagtttggagagtttgggccaaaacagctaagttgaatcagccagccacagttcagaaagagccagaaagggtgagcttattcagcagtaagcctccaagacaatcacatctagccaatgaaagatacatttacaggaaataaatgatcagtcatctaattctaccaaataatagatttgacctgaaagaatttaaataaggcttaagcaaaacaaagttgcttcaaaccctacaaaaaagttca

SEQ ID NO: 1048 - DNA, 1000 bp, mus musculus
atgggtaggggagtgggggtgggtgggtatgggggacttttggtatagcattggaaatgtaaatgagctaaatacctaataaaaagtggaaaaaaaaaagaaaaaaaaaaaaaagaaagcatacacacaacctctacacgttcaaaccaggaaaaatcccatcatggaaaaaggaaactggacataatgtctcacccacagctaagaagtgtttttgcaattatagctgctgagagaggggaaatcagttttcttcagcatagtgacactaaaaaaaataaaaataaaaataattgtaaaagatactgttaacaggaatctgaatggcaggaggaagacttgcagaacatcctctgcattgtgtcccagtaccagggaaagctgcaaataagagcctgtgagatggctcagcatgtaaagatgtttgccatctgacaaccttagactgattcttgggattcacatggtggaagtaaagaactgattcccctaaattgcccacttaagcatggtggcatatgtggatataaacacaaacacacacgcgcacgcacgcacacacattaaaaatttaaatagagtaccatcatctttaggcagttgacgctgaaattgtgtagatccattatcttttccttttttttttaatgtgagaaggggtttggaggtaacaggtgcacaggcacttaagcatttcatgtggagatcaaaagacaacctcgggtgtcaattcttgacttccagcctgtctgaaggtaggatctcttgttgatcacagatgcatacaccaggtaggctaacctgagcttccagtgatcctcatgtttctcattcccctcttggcataggtaccctgagacacagacttatgctaccagtatatccccgctttccataagttctgaggatctaactctgctcctcacacttgggtggtaaaaatatgttaatacctaaatattatataggaacacagttaatttactcttagattttcctt

SEQ ID NO: 1049 - DNA, 1000 bp, mus musculus
gtaaggaatgtttttgagtgggctgaagagatggctcagaagctaagagcaagtacacacacacacacaactagttcatgtgtaccacacacatgtaaggtacctacagacaccagatcccctggaactggaactcgagttataagctgtcttgagctgcctaatatgggtactgggaatcaaccccaggccctctacatgctcttaacctcttcgtcatctctccaggtccaaatctgagctgtcaagaaacgctggctgaacaacgcagcagaggtagcaaatccaacaggcccaacagccttgtttcaggcattaccacaagccacatgacacccacattggcaatccctgttctttgacgactgacctatgtattttcgtttcctttaagccaccttgtgataaaatttccctggtaacaaactacaggcttcccatcccagactagaaacacagcaggcatgggaagcaaatctgcactcatcggataaggagccaggacatgggggaggatgctgagcagcaaagtcctttcagttgctgctggccaggggtggttttcaagttccaaatattccatatcactgggctaaaaggaaccctgagatgagtaaaaccagcccccgtggtcccagtcccagtcccagtggcactgacagtcacagaggtagcaatccagaaggccacagactattccaggtcacacactgtacttgtcatttgtccataaaaaatattatacattcacacacacagagagagagggggggggagagggagagggagagggagagggagggagagggagagagagaaactgtgcagaagtcagaaatgttcataaactgacaagagtacctctcttaaatatataaaacttacacttgcactttgtgtgtgtgtgtactttcatgtgtgggggtgttcatgtatgtggaggccagataaccttggatgctattccctggtagtggtcctttttaactctgtattttta

SEQ ID NO: 1050 - DNA, 1200 bp, mus musculus
ttttttttaaagatttatttatttattatatgtaagtacattgtagctgtcttcagacactccagaagagggaatcagatctcgttacagatggttgtgagccaccatgtggttgctgggatttgaactctggaccttcggaagagcagtcgggtgctcttacccactgagccatctcaccagccctccttgaagttttttatcatcagtaagaagaccctattgggagagcaaaagaatggcaactttcctcagctagtgactggctgacaggaatgtgacctgttgagactctgaaatagtcagaacttttgtgaagtaaccgcggattgctcagtcaagcagaaattacctaaatataagaaagctcaccccctggctctctagctcacccgccgactctctagctcagtggcattcttgaaggcaaaatgaacatgccagcccagatacaggtgtatcatgccagggagcagaactgtggttgttgatttttactgatgtaatagttactttaagcaccagctcaaagggcttgtcttacttcagttaccttgaaactctctgaattgaccatcctaagatgaaaatatttagaggaaaatgtgttactagccatctgtttctgatataaaatataaaactaaacaaaaggacaagaaattggataaagcagaacatgtatgaggaaagcttgggaaatgagactctagagaatagggccttgaaaagcttccgcacattcctgggaacctcaaagacccagttgttttgtttttttttttgtttttttttttaaagatttatttatttattatatgtaagtacactgcagctgtcttcagacataccagaagagggcatcagctctcataacagatggttgtgagccaccatgtggttgctgggatttgaactcaggacctttggaagagcagccagtgctcttaaccactgagccatctctccagcccaaagacccagtttttgacagagttgggcatgctgagaaaatacctggttttcaagtctttttaagcccgtatattaccttaattcatgaaaaaaaagacaaaatccaacatcattttatgataaaaatattaaaaaatgttagttatgtaaggaatgtcctgcctagataacatttattttggacaaaagtggaaataaaatctctgatggttgtgaaatacctga

SEQ ID NO: 1051 - DNA, 1000 bp, mus musculus
cgcctaggtcaattctagccacagctgtgaacaactgtcccagcagatgtttaaagatggtgtctgtggcagaactaaactagctggagtgagctcagttctatcacccataggccacacacaggcccagtctaacactggcccaatgctgaacgtcactggctagcaaaacagaacccttagagctcctgcttctctgaatccgttcaacttctcagaccataatgaagagaagtagctgcatgcagaaacccactaggaaacaaaacaacaagcagccgaggctgcctgcgagagcagagaacagtccttactcactccacacacttggcctgaaggactgcggcagtcttagggcaacacatcaccgcagtcattttatttgttcgacaaatatttggtgctagggatgtggcttagtgactgaacatgtattcagcgtggtcacagccctgagttaatcttcaacaacaaaaattactacaacaaatatttaccaagtatctacatcaagctctgtcaagctttatgggagagtaaatggcagagtgacacatgcagcaggtgccggtctgtgaccttcggtctgtgaccttaggctagggaaacttgtcagagcacgactcagggcatgctctgcttcttttcatcccaggtgtcatctccccaccagttctgaggggatgaaggcagatgaggaggggaggaagacccagcaacagcaggtaccaggagggttcgggatgggctcaaaccttggtacttctgttctcctcattatcagatgaggacaagaaatgggaaggtgtcctgaggcaaatcaagtcggcctttcaagtcagcggaataaataaataaactaataagcataatagggctggagaaatggctcagtggttaagagtgccgactgctcttccgaaggtcatgagttcaaaccccagcaaccacatgatggctcacaaccatccgaaatgagatttgatgccctcttctgggt

SEQ ID NO: 1052 - DNA, 1000 bp, mus musculus; identical to SEQ ID NO: 1051

SEQ ID NO: 1053 - DNA, 1000 bp, mus musculus
aatgatatttaatatgacaactaacagtttgagttatctctatcagaaggaaaatagtaatgcaacagatgaattcatccttttctggcttcattaaaaacatgtacaagagctgtgcgccatcttccctgggaacccagcagaggccccaaaggtccccagaggactcttcactccgcagggcccctagaacagccagggccttgggatcactggtgaggggaaagcaacatcagctccaaaacattccggagggtcttgtgccagcaggagcagggacaaaggaaccccttctaaccagaggcctggatccattctagttggggccagctggtcgccatcttcccagcgaacccagcagagggcgccaaggtccccagaggactctccacacctcaggccccctagcacacccaggacctttgtatcccttgagagcacgtgggcagcagaagcaacagagcttcttggataaggtccctttgggccttcaccctaaaccaggagacagagctgagacccagaccccaggccaccttccttgcctgaggagagtccacctctagggagggctctgattccaggactcaggaagtggatctgagctggagacttctggatacctttcctgcaagaggagagcttgcctgaagagagtgctctgaccactgggactctcactgggtgagagttggactcccaggagtgctgacagagactaagagaatcacagtagaaacaagttccagccagagacagctagatcatctaacaccagagaagaacagatggtgaaagcaagcataagaacaatactaacagaaaccgataccactgggcatcatcagaacccagtacgcccaccacagcgagtcctggatactccaacacatccgaaaaacaagactcggatttaaaatcatatttcatgatggtggtagaggattttaagaagggcattaataactcacttaaagaaatacagaagaacacagtgaaa

SEQ ID NO: 1054 - DNA, 1000 bp, mus musculus
gttaatttatataatttggatattagccctctgatgaagtgctctacagtggagagggtgaaattgtactgtccacctcgagtggtggggcaggatatcaactagagggaggagattgctatcccactgtcaaaagatctatcttagaatttctcctgactgaaggaacaaaaatagagaagaaaatgatagaatggagatccagagaccagcccaaattgggttaaagctcaaggaggggccccagggcctgacacttttactgatgctgtggtgtgcttgcagacaggagcgtagcatgattggcttgcaagaagcccaacaagcagcagaaagattctgatgtaggtaactagcagccaaccaatggactgaagctggggacttctgtggttgaattggggataagctggaggaggagggcaaccccatgggaagaccagcaatctcaactaacctggaaccctgagaaccctcagacactgagccaccaaccaggcagaatacaatatgttatatgaggccaacaacacatatacagcagagactgctttatctgccctctgcccttggtgagaaagaatgcacctaaccctggagagacttgaggccccagggtgtgggtaggcttgctagggtggaggtatgtgggaggaactataggatggggagtgctcagggggcaggaagggtgggggataaagaatggactcttaaaaagaattaaagaatataaaaaataaaaatgaaaaaaaacccacaaataattcaatgtaatcactgtcagcagtgggctttgaagttagaaactagggatagatatgacactcaatgggtctatctcttagttactcttttctaaaataaaacctataatgtgaatgatcaaatgtgtcaaaaagtaaggaattatattgtttttcaactttaatgcatatctctatatatctgtgaattcataatgtatatttaaaatatagaatatattttaaaagtaata

SEQ ID NO: 1055 - DNA, 1200 bp, mus musculus
cagttttgttttgttttgtttttgacgtctgactattggctattcatattttgagacatcattccatctggataaatagaatatgactgacatgaaaaacataaagactttatcacattgaggccccaatctaccatttcaaaagcaagattagactgaatattatactgtaggaccctgaaaggcagcctagttccttgtccagaataggcttgaaaccttggtaaccccgaaaggacagaaggcattttgccatgctcctggacaacatgttcctgacagaaggccatagccctccatagctttgtggccatcagtcatacagggaaatcctaatcccctccataggtaaaggatgtgaccacaggtcatgtagcctcaagacagatctccatcttaatgacgtacctaaaggcctgaagggctcagccaattaagctttccttcccagacactcctccttgaaaaaagaatttaactcaggcctccctgaggactgatgtacagttttttctcatctaatttctgccatgacaaaaaaagccttaaaacactggattgcctcatttgattaggataggccatggggagcaatggggtacttctcctagatatctgggcatctaatctcctatggagggttctgtgtgtccccagtgaccaccaagccaagctagtagcagacaagccaaggattatcctcaaaggacacagccagatctcccccacttgtcctaagtcaccaggccagatcagtcttggggcccccagtctgttctcagctcttttgcagaatcctatggcacctgggtgtccagcagcctgagaattatatggccttgtcacagaccttcggacccccgagccatctctggttgtctcctggacttcagactgtgctcccccacctgcagaatggtgtttcacagcttccccatagtccaacacccccaatttaccagagtgggctaagagccatcaaactcccatgtccttcctttccaagtggcactagccttgtggtggggcagatgcaggaccacaacaaaccctacataattcaagaatcaatagcatcacaatttgtacaaaaggaaaaaggagggaaaagaagataagagatggaaggatattaaaaatttacgtttcacaaggaagcctgctcactactcagttttaccttatataaccatcaatatc

SEQ ID NO: 1056 - DNA, 1000 bp, mus musculus
tcaatggaaaagagaggccctgttctgaaatttcaagaatgggttctgctgaaatcatggcagacaagagagcttgaagagtggcatataaatggtaattttagggaagaatgttaataattttgtagaaatcaatatttaataaaacaggcataactttccagactcccaagaacactggtactgtaaaagtttcatactggttcttcctgccagttccatgctcacagaaataagagtcaaactcaaaatgtattcataaatcccttgtccagatatcttgactcttctctaattagatataacataaaagataccatttattctaacctatattctgtcacatagctagttacctgtgtgcatatagtatgcatccatctcattgccccattgtctcatcttcccagaaaatatctagtgcctggtactgacctagaatcttccaagcctcctagaagccccacctcccctttcttacgtaagatataggttatcaaagttattatcacctggaaccacatccatacagaaacaacatattttctctatattgtaaggtgcttatgtacaaaattttcatcacctttgcatattatataacaccatgtcaataccatacagaaaatacacataatattctttggaaattctacagaaattaagaggaagatgttatcaataaatgataaagaatggatctgttattgagttttaagaattaatataattcggattggaataaaaacttacaatggactatgtgtgcagagtcttgcccaacacccgcaagggtccacacgggactccccacgggaccctaagacctctggtgagtggatcacagtgcctgccccaatccaatcgcgcggaacttgagactgcggtacatagggaagcaggctacccgggcctgatctggggcacaagtcccttccgctcgactcgagactcgagccccgggctaccttgccagcagagtcttgcccaacacccgcaa

SEQ ID NO: 1057 - DNA, 1200 bp, mus musculus
tgatgttttatttatctacatttcaaatgttattccctttcctggtttcccctccggaaacccccccttccatcctctcttccactgcttctatgaggatgctcccccacccactcacccacccacccacccacccactcactcctgcctatccaccctgttattcccctacactgggccattgatctttcacaggaccaaggacgtctcctcatattgttgttcaacaaggccatcctctgctacatatgtggctggagccatggatttctccatgtgtactcttattccaaggcaatattgaagaatcaaactttacactaatgtgcttggcattgtgtccacacatacagtagatgttgtagctaacaggccaacaggagcaaactccctcactgtttattctcagagatatgggaatgggcaagaaaatacaagaggctgcaaagactagagtattccataatctgtgagtggggagtgtgaattcagtgattagtgtatgatcatggaaaagaaatgtccagaagaaagttcggtaagaccttaaatcaggaggggaactttgaagcaattcaaaggacacacaaatgagaaagaggatgtagtattgagagactgaactgaacatacattcagggtctgatggctaatagtgttattggagctaaaaaggtttgcagtctcattgggggaggaacagtgtcaaccggccagataccacagatatcgtggggaatgcatcaccaaccaaacagtacacatggagagacccatggctctggccacatatgtgacagaggaacactttgttggacatcagtgggaggaacagcccttgggcctgatgttgttcaatggctcagtgtaggcaatgccaaggcaggaaaatgggcataggttggtaggagaataccctcatagaggcagggtgagggggttgtcacaggggatttctgaaggggagaactggaaagggggccaggtggtggtgacgcacgactttgatcccagcacttgggaggcagaggcagtagaatttctgagttcgaggccagcctggtctacagagtgagttccaggacagccagggctatacagagaaaccctttctcgaagaaccaataaataaataaataaataaataaataaataaacaaacaaacaaacaaaataaaataaaagagaaaagaaaaaaga

SEQ ID NO: 1058 - DNA, 1400 bp, mus musculus
tccctttagctccttgggtactttctctagctccttcattgggggccctgtgatccatccaatagctgactgtgagcatccacttctgtgtttgctaagccctggcatagactatgccgggactttttagaatttaatgacaatcaagacacatcataccaaaacctatgagaaacaatgaaagcaatggtaagaagaaaatggatagctctaagagcccctataaagaaactccagagaacttaacattagcagcttgacagcacatctgaaagctcgagaacaaaaagaagcaaatacatccaagaggagtagacagcaggaaacaaactcagggctgaaatcaaccaagtggaaactaaaagaactatacaaagaataaaccaaaccaggagctggttctttgagaatatcaacaagatatataaacccttagccagacttactagagggcacagggacaacatcctaattaacaaaatcagaggggcttcctggccagcagagttgcctgacacgcgcaagggcccacacaggattccccacgggatcctaagacctctggtgagtggaacacagcgccggccccaatccaatcacgcggacctgagactgtggtacatagggaagcagactacccgggcctgacccgggacaaaagccccttccgctccactcgagccccaggcttcctggccagcggagttgcctgacacccgcaagggcccacacaggattccccacgggatcctaagacctctggtgagtggaacacagcgccggccccaatccaatcgcgtggaacctgagactgcggtacatagggaagcagactacccgggcctgaccggggcaaaagccccttccgctccactcgagtcccgggcttccttgccagcggagtcgcctgacacccacaagggcccacacaggattccccacgggatcctaagacctctagtgagtggaacacaacttctgccaggagtccggttcgaacaccagatatctgggtaccttccctgcaagaagagagctttcctgcagagaatactctacccactgaaaccaaggagagtgctaccctcccaggtctgcttatagaggctaacagagtcacctgaagaacaagctcttaacagtgacaactaaaacagctagcttcagagattaccagatggcgaaaggcaaacgtaagaatcctactaagagaaatcaagaccactcaccatcatcagaacacagcactcccaccccacctagtcctgggcaccccaacacaaccgaaaatctagacccagatttaaaaacatttttcatgatgatgatagaggacatcaagaaggactttcataagtcacttaaagaattacaggagagcactgctaaagagttacagg

SEQ ID NO: 1059 - DNA, 1000 bp, mus musculus
attagctgaccccctcagaaggacaggacacctggtacttgtctgccgtctcacttttgccttgggctcctcactctcttaggagtttggtaactgtaagtcaatagtcaatacttcttgaacctgagcaactgcaagcatgtttgtgattctgtctaatggctggggctgcaaagccaggcaagggctgtctcttggtccacagtaaactcgctaaggagattctcccacctctaccaccaacagatgccaagaaggagatcactctatccttcaagctctggccacactgctgccacggcccagcagagctgccgagcagagaggaaggcctgactgcagggcacagacctgaaaatccagggaagctcagtgaaagcccagcttcctggactgggacctgagaaccaaccgagggaggctcatttgaatgtatcctaagcgtcccagaaggaaaccacctctgcaatccggttttgacccacagccaatttgagccctgctgctccccctagcgggagaaggaagcagtgagctagagtttgaggatacacaaggatttgtaaacacttggaggctggctcaccccaagggaggactcatccatccctggcagggcaggatcctgagatccaccagggatgccatttcccttttatctttctctcctctgggatctggagagtgattgagataatttaccatttaatgtgggcagatggcttaattaggctcaatcgcaagacattcacagtggctctgagtgtgtgaatgactgggggcgggggtgggggtggataagaccagccagatgtgtcttcatcctctgccctgtcacccaggctggcccaaaggttccaggatagtcacagggtcattctgagtaggaatctagccttggtcagagcagctggacagcccctagctcatgcaacaggagattcctctggtttttttaaactcataactagttcttgtgatagcagcaacaaccaaagcc

SEQ ID NO: 1060 - DNA, 1600 bp, mus musculus
ttaaatttaaattttaggttttagaaggtccaaacgcagtcacaaccaagtgaggggacctagggttacctggtctgtgaaccaggaataactcagaagccacagctggagaagctcagccttagaaacgggtgagaggcagagcagagcagttgcaggcctggaaacagctgggagaaggggtagtggggaggggctaacagcagcagtcttgccctggggagaccctgggggcatcgggctgcacattcccacagggagtgagagacttgggcagagacctgactctactaggtggagagactagtcagcctggtcctccaggatacagggtaggacagatgtgactctcagaaaaccaacccctctgactgccccacgccagacccctgcagccctcagaaggtgagcatgtagattatgtggtaaattgccatatgttgtttgagctcactgagaagctgactctgaaagatccaagcatgtttgtctcatatcacagagctttggggggcaggggatgggtgtgctgcttgaagtttaatgataaaaataaataaaatatttttaaagtaaagaacagctatgcagagacatctgtatagtataaggctgttggcctgtgtgccggggctgttcctcagctagcccatctaagcttaactttgccattgcttcccgtttgccttttcttcttgggcaggtaatggagcgacaagcattgactcatcctgctagcctggcactgctcacccagcaactaaacactgagaacacagggacccacttccatagccagttgatccaatacgtgtgggctatcccaacagtctcagtttcccccaaggactcctccggggatggcaccccatctctgctacaggagggaaggaaagagcaaaacagccctagagtaaagacacacttgggaaatgctagaaggtgaaccatgtgcaacagaggatgccattgtgtaatcccaacatgtaaaaaggagaggctggaagctcagccagaggaggccatccaaaatgagaaagttcaatccggaacttcagttggctgtctcagttttcctagccactttttccctggagttgtgagcccttgattttctgacatcatctctgtttgctgctattgttcctgtgcctagaagcctcatccaaggggtcaatagcttttcctcagggggcttctgatagatattttgagtgaccaatttgatgatattctgctgtctatctatctacaccttgctactctttcaacttggcttactacgtaagtgataaattcactcattcaaaacaaagtacaagccgtagatacacacgcaccactcttacagaggacctgaatttggtccccaaaattcacatgagcaagttcacaactgcttttaactgcagatcccagaggatctgacacctttggccccatgcaaccacgtgcaagtatccacaaacacacaaccgcggacatccatataaataaaaatagggctgtgtgtggaggcacactctaaatgccaaggcttgggaggcagaggcaggtggatctctccgagttcccatgtttccactgctagaacaagggg

SEQ ID NO: 1061 - DNA, 1000 bp, mus musculus
ctatctatctatctatctatctatctatctatctatctatctatctatctatctatccatctatccatccatccatccatccatccatccatccatccatccatccatccatcgagagctaacccaatctgtaagttgtgttacgctagagaaccctgactaatacagttgtgaagcagtgctgggactcagttgtgaagcagtgctggggctcagttgtgaagcagtgctggggctcagtggtagagcacttgctgaacacggtgagagcctgtgttaaatccctagcattggaagaaacaacaacagtgattccatccactaacagtgtaagcaagcacacacatgctgtgccactggtagcaatttgcattatggaatatttatgtaagttggcagacattcacatccacagaatgcagcattccctgtaaaaataaaagtctgcaggagcaattcaaagttagaatgctctgaggtcaggcagagatctgaaataaagactccctgtggtggtctgaataggtatggccctcagagagccatgtgtttgaatgcttggcccacagggaatggcactcactattaagaggcatggccttgttggagtaggtgtggccttgatggaggaagtgtgtcactgtaggggtgaactttagggtctcctatgcttaagcaccatccagtgtggaattacagtctattgctggctgccttcaggtcaagatgtagaactctcagctcctccagcaccatgcctgcctgcatgctgccatgcttcctgccctgacaataatggattgaacctctgaactgtaagccagccccaattaaatgtcttttgtaagagttgcctggtcatggtgtctcttcacagcaatagaaaccctaactagaacactctcttctgtaatgcagatacctatgggcctatgtatattacccaacctcacagataatacattgtttttgaaaatcatcaggtattgtattcatggga

SEQ ID NO: 1062 - DNA, 1200 bp, mus musculus
caaaatacagcttcctggttgcatttttcccccctaagaaatattactttcaaaacataagataaataaatataaaacaacagtttttaaaaataggtttttatgaccctttctaggtgctacacaggccctgggtgggagaccacaccagagatgacccctgcctggtgccacacagcaggaaacaacactctgagagcacttctgagattaccccagccccccagaggcccccagcaatactaagatgagcaagcaaatggtgacaagatggaagagaaggagaagcagaaggatgtgggcacaatgaagcgaggcagagctggagactcgagggtattgagtaataacccgatatgatgccagtgatgccacctaaggccatggtaaggtcctggcctgtgctgtcactggggccaggtctaagtctgtggccctgcagcagcaggggtttggtaccactaaaggccaggtctaagctgacctggggccatgttgattgtctgagggctgtgtagaatccctttcctgggcatcattggtgagctggcctcaaggccaagagagcaagagagctggccccttcaccagcctggagtacttgggagaatggccccgcaccttgcttgggcagcacagtagagctggccctggttgtgggggttacaggtgagccagccaagagggcatgagaactgaagagctggcactgccccttgccggctgcagcacgtgatgacagcctgggcaggaccgacaagttcactccagtggtgtgggtgtgggagagctgctgggctgacctgctcagacacttctcaggcccagattcagggttttgagttggccaactcccaacatctaccccactgatgaactgctggattccacgaaggggctgattctacagatccaagaaacgataggatctccatgacacagggccaacaacgggctatccaggaggagtcccagtaaggcttcactattgataatgtagcaaaagccagagcctcaaaccggaccaatgattccttgcaatggaagtttgtaatgaaaacctgaagcaaaaagggtatattgtagaaaacgctgcgacacactacagcttccacaatgagatctattttttctttgggcgggggaggttgtaaaggcagggggtgggcatgaagggtcagcatgacaagtgggatttgc

SEQ ID NO: 1063 - DNA, 1000 bp, mus musculus
gcagtacacatatggtcatatgtgcagcagaacacagatggagacatgtacagaagtacacatatggtcacatgtgcagcagtacacagatggacacatgtacagcagtacccagatggacacatgtacagcaatacacatatggtcacatgtgcagcagaacacagatggagacatgtacagcagtacacatatggtcacatgtacagcagtacagagatggacacatgtacagcagtacccagatggacacatgtacagcagtacacagatggagacatgtgcagcagtacagagatggacacatgtacagcagtacacagatggacacatgtacagcagtacacagatggagacatgtgcagcagtacagagatggacacatgtacagcagtacacagatggacacatgtacagcagtacacagatagaaatgtaaatcagtacacagatggagacacattcagcaatatatagatggagacattgttgaatggttaaagagatgggaatagagccaggagggcaaagtaagaaagaaaatgtcctattgtgtgcaagaaatgcaaagatggaagattgtagttcttatttcccagaatgttacagacatatagaatcagcctgcagagatggtatgatgttgaaaatagtaaccgtcacttcagaggttttactacagagcagggataatcatgggtcgctggattagggagagtgcaaaagcatgcggcaacatttgttggttgtgatagggtgctgcacacatgaatccacagcagctgtgacagcatgaacaagacccgtggaaaatcaggccagctaaaattacagcacagacaggggaggctccctcatgaaacgccatctccgaagagctattggagaaatggacggctgctgtgggagggggagagctctctccaaggatgtgagcctgagactcgccctgtgctgcaggagatggccctgcacccatctcatgcatgtagcatcaagc

SEQ ID NO: 1064 - DNA, 1000 bp, mus musculus
aatctaagatgaccttaagtcacctaggttcagaccccaaaccagagctccactttagtgcaaaggcctctttccaataagcatttcctgggtcgctccatgtgaccttgccgttgatctcacgtcttggctctgtcctcagcatagtcacgctctgtcttttatgtcttccctccctaaatgctggtcgttcagggtcttgacttccatttcagatgagcttgttaaaattcttcacaaagacaaagattctgtcaggttttccttcagatccaagtagaatgtcccctgtgatgggcaggtgctaccttgggagctaccttggtctctccaccagtacccctactcccacatcaacacagacatgagggcagagaggccatagccccaaggagttggctcacgtggggtctggatcctcccccctacacttccagagctcaaggcactgataagactcttccatacttatcaactagaccatcatgggtctctccctcaccttcttctcttcttgaggactaataaagtacgggggtgtccatccttgggatttagagatggctgtgggcagcttttgagtataaactcataggatgaactgagttaatctacgcaggagtgaggctcctgtggtgtgggagaggccagacttatggggcaaagtagatgtgggtcaggatcaggaccaggctggatcatcctgaacttccacattctgacaagaaacccctcccgtttctaatttgcattgttagtcgtgaaaagtatttcaaggtgaaagctcggagcatattgtatcagactattcgtctaaatcgtgacttttgaacacgtaggtatggacggcttccgtgtccactcttggtccacagttcaccaacgcacagctgttgtggttgcctgcataagagcaagccagccaacattctagcacggaggaggaatgtgttctccagggtccactactagctacagaattacggacagtcgtttttgt

SEQ ID NO: 1065 - DNA, 1000 bp, mus musculus
atttcacagaaatgggcaacctgacatgatcaaaagaccaaagtgtgttacaagttctggctgcagtgtctagagattgtcctttctagccagctatttggacactaaatacttcatctgaaaggaagaagagttctctttatagaaggcaccaagcaaacaccccactaagtgcagagcataagagcagcagtgcctgatttgcagtatcaaaatctagactgtatttatgttgagttatatacagcaagaaaaagagaagggaacaatgttactcatgtcaagagatcaactgtatcaatttctggtttgaggatttttaactggaaatgataaacagtcacactcatttgtgcttttatataagaaacaggacacaggtcaaaatcaatacgtccaaaggcatgtaaagcaatgtttaaaagaaatattaattttattattaataatacattaatatttattattaaataagcaatattagaccctttaatagatatttgtaggagcaatttatttacgttgcttctaaagacaacacatatgaagttttcttatccaagaaaagttgataatctgttctaggtgaattaattgggctttcatacaagtatcatcagctggaaaagtataccggaaatctagttcacacataaaaacaaagacacacacacaaattcctttctgtgactagcgacctcatcttgcaataatatccaagttttcaaatattggacaaggtccatttctatcagttatgcagtttttcccccttatagctccaaattcaatccagggccagacatatgatagcagacactctgctggtctgctctacctgatcctttgactcttgcagacttggtttttgcccggtaactcggaatgaccttgacatccgagggtaactcagttgatctttctagtgtaacttctttgacttcctggaataacctcctctaagtcctgaaatttcagatgtgcatcaccacatcattaa

SEQ ID NO: 1066 - DNA, 1200 bp, mus musculus
ttaagtctatatagaatataaaatagagatacaaaactatatagtatttctaaagtttataagaaataaatagaatatatcacaattatttgaatatttcatacttgtagtctgatgttatgaaaaatgataaaattctgttaatattctttttatttgtttatatctagaatgctttatttatttacattccaaatgttgcctcctttcatggtccccacttcaagagttctttacccattccctacatctttgcctgtgggagggtactttttcacttacctatacccacctgcacaacctccacactcacttcccaatccacccaccgacccttacctcactccccctcatgcaactgtagtccctgaagcatcaggtctttataggattaggtgcatcttctaccactgaagccagacaaggcagtcctctgttgcatatgtgacgaaggcacatgtgtgttctttgattaatggcttagcctctgggagcacccaggggaccaggttaattaatattgttagtattcctatggcgttgccatttccttcagttccttcaatccttccccgaactcttccactggggtcccagaccttggtccaatagttagctgttaagtaactgcacctatctcagtcagctactggtagaccctctcagaggagcaccatgctgggctcctgtctgtaagcacaacatggaattagtaatcgtgtcagggtttgttgcctgcccattgaatggaacccaagacacattagtcactggatggcctttctttcaatgtctgctccattttgtccctgcatttcctttaggcagaaataactctgggaaaaatattttgaaggtgtattactgactttatcactccactggggaccctgcctgtctactggaggtagggtcctcaggttccatctccccagcattggacatttcacccaatcttgcataccagatctctgggtttttctagaggttcgcctcctcccacctagcttcatattttccttcattcacctgtccctctgggatcctctacattctccacctataactgatcagagggctaatatcggaaatatgtaaagaactcaagatattagactaaaaaaaaaaagcccaaagaatccaatttaaaaatgaggtacagtgctaagcagactattctcaacagagaaatcttgaatg

SEQ ID NO: 1067 - DNA, 1000 bp, mus musculus
ttgtttacatttcaaatataatccccttttccaggtttccttctacaaactccctaccccatgccccttcctccatgcttctatgagagtgctcccccacccatcgcctcagcaccctagcattcccctatcctggataattgagcctccacaggaccaagggtctcccttcccactggtgcctgataagtcactcctctgctacatatgcaactggagccatgggtttatccatgtatacgcttttgatggtggtttagtcccagggagttctgggtggtccagttagctgatattgttctttatacggggttgcaaccccttcaattccttcagtccttcccctagctcttccattggggtccacgtctatgtttggctgtgagtatctatgtctgtattgataaggtgctggcataacctctcagagaacagccataccaggctcttattggtgaacgcttcttggcattaacaacagtgtttgatttggtgtctggggataggatggatccctaggtagggcagtctctggatggccttccctctagtctctattccattatttttttttttgcccctgcctttcctttggacaggaacacaggaacatttccggattaagaattttgagatgtgtggtgtccccctcaaatgggggcatgcctacctacagaggtggtctctacaggttgtatttcttctttgttgtgtattttgactaaagtcattaccattgggtcctgcaagtcttttacttctgtggagtttgggagtttttctctatagagtcttctgatattttttggttatgttgctatttcctgggtactctatattaccccacttgacaataacacatgtcaatttgtttcttctattcagggaacttatttgagaatttggagtaacttctggatgtggttaatcaagggcttgggtggtgaactgacacttagggaatttagagtagcttaaaggtttttgtgtctggatgtgt

SEQ ID NO: 1068 - DNA, 1600 bp, mus musculus
tctttcaatgttgaggaacacgacaaagatgggaatatagtggttcttgagggtaaaggaaagaatctagctttgcaagataaaagtgcaaggtggaatttcaagacatgatggagaacactgaatatctatgatggttttgttacattaacacagcgctgaaatgttgcatcttcatattaaatgccagtgatacttgcagactttttaccagccattactcttcatttcttggtggttcttgttctcttctggtacctcctcctttttctcctcttcctcttcctcttcctcttcctcttcctcttcctcttcctccttatcctcttcctttttaaattgttttatttatttacattccaaatgttgcccccttcctggtcccccttcaaatagttcttaacctcatttcccctcctctttgccactcaaatggtgctccctcacccattcacccaacaaccacccacccaccctcccttgtctcaaagacccactcccaactcacatcccttcgcccacatccacttaccctggaacatacagacactacagtattaggtgtatcctctcccactgaggccagacaaggtatttctctactacatatatgccagggaccacagaacagtccatgtatctttggttggttccttagtctctgggagttcctaggggttcaggttagttgatagtgttagtattcctattgggttaccattgtcttcagctcctaatccttcccctaattcttctgcgggggtcccaacatcaacctaattcttggctgtacatatgtgcatctgtctcagtcagttgctttcctcagtcagaggaaagcatgctagagcattctgtctgcaagcacaacatggcatcagtaataatgtcaggttttggtgcctgctcatgggatgaatcccatgttgagctgatctttggatggccttttcttctatctctgcacagtacttttctctgcattgcctttaaacaggaataattctgggtcaatgattttgaaggcagtttggtgaccccatccctcaacctggaggtggtctcttcaggttgtatcttcccagtcttgggcattttggctaaagcaatcctcatatcccagatttctggaacattatagaggatccctctgtccccaaccttcctctgagctgcatatttcaatttattcccttgatcctctggacttgtatcttcacatacctgattctaccctttttcccttccccaccctcctgccaccttgttctctccctccctcttcttcccttcgttaatttgtagccacttctaagtggaactgaagcatgctaacttgggccttcttgttaaatttcttattgtctgtaggttttatcatgggtattttgaactttttgactaatatacagttattagtgagtacataacatgcatttccttttgagtctaggatacctctctttgaatgactacgataatactttgttctcatggtttatttgaaattcctttaacatataaaaataatttacctttaaaaattgtgtaatttcactacaactgtatacttttatcttgtaatttatgaatcaactct

SEQ ID NO: 1069 - DNA, 1000 bp, mus musculus
atgataacatgatccagggcacaaactttgctgtcagtcccatggtccccagtggactctccactacccagacaccctagcatgcccaggatcttagttaggatcatgggtgaatggaacacaatatctgttccaacataactgggagtgcttgggaccagtaggagcagggacacaggagccctgcctgaccagtggctccagttcattcaggtcaacattggtctaacttggtttcaaactcagcaaacagccctacggtcccccaaggaggttccacttccatgtgtccaaacatgtccaggatcttaggatcctaggatcccaggagcttggtaacaccaggatctcagggtttcagaggaagctttattgccaagaactctgatatacccacaatctcaggatcactggatcacagaataacaggatctcagagaaagcaagactctgaggagatctgaatcaactgggattacgggatgaataggatctgatcagctatatcgagggcagagagtacttgagataatcagatggaggggtgcaagcataagaacagaagcaacagaaactaaggttactgggcataatcagaacccaactctcccacaacagcaagtcctggatataccatcaaaccagaaaagcaagatatgaatctaaagtcacttctcatgatgatgatggaggactataagaaggacgtgattaattcccttaacaaaacacaggagaacacaggtatataggtagaagctctcaaagaggaaacacaaaatcccttaaagaattatagtaaaaaaacattcaaacaggtgaaagaattgaacaaaactcaagggtcaggtgttggtggtacacatctttaatcccagcacttgggtggcagaggtaggcggatttctgagttcaaggtcagcctggtctacaaagtgagttccaggacagccagaactatacagagaaaacctgtctcaaaaacaaaacaaaacaaaac

SEQ ID NO: 1070 - DNA, 1000 bp, mus musculus
tctagtacttttttttcaggtcaataacctctgcatcaaagagtcttggtgtggtttgtagtactaggtataggttccctcatattgaatgtttctttctttttttttttattacgtattttcctcaattacatttccaatgctatcccaaaagtcccccacaccctcccccccactcccctacccacccattcccattttttggccctggcattcccctgtactggggcatataaagtttgtgtgtccgatgggcctctctttccagtgatggctgaccaggccatcttttgatacatatgtagctagagtcaagagctactgggtactggttagttcataatattgcacctacagggttgcagatatctttagctccttggatactttctctagctcctccattgggggccctgtgatccatccaatagttgactgtgagcatccagttctgtgtttgctaggccccggtctagtttcacaagaggcagctatagacagtggtttcatttccctgaagctattgtactgctggggacttttttcactttagtccttgttgtagtttgcaagctttacagttcattatgattcttgatttttttcttcttctccttgacagtttgcacagtatattccaagaggatgagatccaatttccaggtatgaagcttccaggaaagaagcttccagggcagttacttcttcatttctccaaattctgtgtcaaaattttaccagatacaaccagctctatctgcaatcccagaaggctgttgacatcagggacaacctgcttaacctgcaaccccagagccctgcatctataaggcacgagaccaaaggctagcataagaacataatcaatattagccagggctatgtgacacacgcagaacccagcctccctacaactgcaagctttcatatccttacacactcaaatcataagaaaatgaccctaaatctactattaagaagattctagaggcctttacag

SEQ ID NO: 1071 - DNA, 1000 bp, mus musculus
aaccagtaccccggagctcttgtttttagctgcatatgtatcaaaagatggcctagtaggccatcactgcaaagagaggcccattggacttgcaaactttatatgtcccagtacaggggaacgccagggccaaaaagtgggagtgggtgggtaggggggtgggagggtgggtatgggggacttttgctatagcattggaaatgtaaatgagctaaatacctaataaaaaattaaaaaaagaataactggtgtgtgtgtgtgtgtgtgtgtgtgtgtgtgtgtgtgtgtgtgtgtgtgtgtgttgtgtgttttcttttttttttttaatttttaaaaaattaatcgttcctttccttttttttactggatacatttttaacttacatttcaaatgttatccccttttctggttttacatctcaaatgatattccatttcccctttacccctccacaagtcccccatctcacaacctctctcctccctctcctccatccccttctacccatccaccatctcctgccccactcctctagcatccccctacactgggacatccaacctcttctacaaggccaagggcctcccctcccattgatttgagacaaggccattctctgctccctatgtatctggagccatggatcccttcctgtgcactccgtggttggtggtctagtccctggaagcactgggtagtccatccagttgatattattcttccaatggctttacaatccccctcggctcctccagtccttctgccagctccacaaccagggtccctgagctcggtctggtggttggatctaagcatccacatttgcattggtcagttgctggctgaacctatttgctgatctgagatggcccttgggcaggtgcacatgtgcaaccagccaggaacttaaagagctgtagacaaaactacacagtacaatggttcatccaaggaacacaggtaagaactctggaatgagagtactctgtgatttcagca

SEQ ID NO: 1072 - DNA, 1000 bp, mus musculus
attttgaagagcaggagaatatattttaacaagaatgttattgactgattagaacaccacttacaaattaaattataaacagaaatcaatataataaaacagatataaaaggcatttaagggccaggcagtgatggtgcacacctttaatcccagcacttggaaggcagaggcaggcaggtttctgagttcgaggccagcctagtctacaacgtgagttccaggacagccagggctacacagagaaaccctgtattgaaaaaaacaaaaccaaaaccaaaacaaacaaacaaaaaaaaaggcatttaaggaatggggaaagactggcagtaatgaatttgtgttaaggtaaatttgtgtttgttttcaatttttatttagatacaaaataattttaaacagttgcaagctgttttgagattgaatgcaaatctgcaagatactatgttaatgattcactcttttcttggtaaaacttatactattctttaaaggttacgatttgcctttgtagctacatttttatattcgttcaacaaaacattctaggaaatgttatgtaattataattattaatccataggtagctacaatatttcaatctttttctgtaaaaatgaccaaaaattagacttcagttctggatcttctcagccctgtgctcccaaacataagattcttcctctgccattgtctaggtctggactcgcctctcagaccagaggagatttgcaggaccccaagagtatcctagctcctgtgggaacctgtggcagtctcagaactaaccagctcagaaccctgccaaaaaacccatcctatttggatacattggacactccagctgaatctgcctaagccacagcaaacatagtaggataccctgatatccatgtctggaccactgcttcccccatcaggatcatccaaccaactgaaggaaaaaacagatgcctaaagggacaggataaaaacataatcaacaagttccagggcaatat

SEQ ID NO: 1073 - DNA, 1600 bp, mus musculus
aaagaaatgcttcatgcactactacacaataagtagcaggattatataaaacagtatattaatcttaaaattgtcaaattgaatgttacacattatgaaacacagtaaaatatgttttttgttttatattgacataagaaacaagtttactttaactcatgtaaagattctatgataaataatataaagtattaaatgaaataataaataagggaaattcaattatcacaatatacatttattatgtgacagcaaagaatttgctaccaaatattagattggagatagaaagtattgaaaagcgtctctgaccctaaaatgaaacaatagtgaactgctggattcagaagaggtaactccccaaagacacctcatcctgtgatgctttattataataagtagtcaccagatttcaaaactacatctgattttttttctggtaggtttttaactgttatatcattaaagcagaaaaagttttgtactccatctgtaacataataggccagatgttgggcagatagataaaaaagcatgtgtcatctacctttttagaagacagtaagtaatttgggtagaaatcacctagaactcaacttaatcatattatattttaatataataaaatatgttaaataaaaactgtaacacttccggtctggacctttacctgcatccttggcatatctgcatggctacccctagacaccaaagcttgcctgtctcccaggaggtctgccttaaccaaggacgcaggagaactactctaaccaggacacaggagtcttgctcaaaccacagacaacactgcttgcctcccaggatgcctcttctaactcagcaccatctgcctccaaggattcctgctataatctgagacaaccaggccagttaacatcataaataaccagatggcaaaggcaagtacaagaacataagcaacagaatccagtgtaatttgacaccaacagaacccagttctaccacagcaaattgaagatatgttaaggcacctgaaaagcaggattcagacctaaaatcccacataataaagatgatagaatcatttaaggaggatttaaataactcccctaaagaaacacacacacacaaatgcaatcaaacaagtgagggaagtgaaaaaagggtcccagagattaaacaacaaagaaaacataaatacatgcaaccctggtgatggacaacttaggaaagataacaggaactacagatataagcatcataaacagaatacaagagatagaagtaagaatctcaggtgtagaagataccatagaaaatattgacacatcagtcaaagaaaatgcaaagtgtacaaagttcctaactgaaaacatccaggaaagttgagacacaatgaaaagaccaaacctatgagtaataggaacagaaaagggtaaagattgctggttcaaaagactagaaaacatcttcaacaaaattataagaaaactctgctaacataaagaaagaaatggccataaatgcacaagaagcaaacagaacaccaaatagattggaccagaaaaaaaaatcttaccaccacatattaatcaaaacactaaaggtacaggacaaa

SEQ ID NO: 1074 - DNA, 1000 bp, mus musculus
cattatgctgctcatttcttccaaatatttccttcttccttctttccttctctccttcctaccttctctttgcctttcctgctcccttctttcttctttgtccccaaagttcctctttctatcattctaggatctctaacacacacacatactggttctgacataaacaaatctcagtttcttttgacctattcttctgagaaggaacatctagtagtatttattagattgtatgggtggagacagcaaagaggctcagagagtcaagagactaaatggaaatgggatgggggaggttcccaggactcaatgtgggtgaccttaggtaaagtgcccaacaatgaggatatggaacctgaagagaccacctccagtagaggcatagggacaccaacctacctaaaaattttcaacccaaaattgttcctgtctagaagaaattcagggacaaaagtggagcacacactggaaaaattgaccaaagaatgactggcccaacttagagtccatcctatggacaagtagtaaccccttatgtgattactgttgttcttacagagaggagcctaacatggctgtcctctgagatgctctttcagcagctgacagacagatacaaatatagccaagcactggactgagttcagggaccctgtggaatagttagaagaaggattgaagaaactgaaggggatggtaacttcacaggaagaccaacagtgtcaactaacctggaaccttagaagttcccagagactgagctaccagtcatagagtattcacatgctgtagcacagtaatgtcttctctggcctcagtggagacttgatgccccagaaagggaggataccagttggcagaggggggggtcaccctctcagaagcaaagggagggaggttgagggaagaactctgtaaggggaaacttgtaaggaggccaatatttggcatataaataaacaaaataattattttttaaaagttcctgtaataatttaaa

SEQ ID NO: 1075 - DNA, 1000 bp, mus musculus
gtttgccatactgctgttccctaactagatctcctttcagtttgtcccaagaggcgacagttaacgaccctgagcaagcataccatggtgccacacggtctatctccctgacaaatccctctatagtcttagtggcgatttttaggccacactgcttcaggaccgaccttaacgccactattacaaatgagagatactgccgctgtccaggcctaaccgctactgaaactggtcgctgtccaggccttaccgcaactgaaactggtcactgtccaggcgctgttcaggcctgaccgcgactaagaaccagtcagcagttccagtggtggaagcaaaatgaaaccgaaaggaaaagtgcaatcactgtgcaaacaatcaaaagggcatctaactctggagaaatttcaagactgtacgtaccttacagagccttacgtgttcctcagttctggttctgccccgtgaatgagggatctcccttgcaccagtgtgatggtataaagttcccgggttcctcggcgccacttattgccctggcttttgtccccgccagcaagaacacactcaggacaactggaatcttctgtggcaaagctttattgcttacttctcaggaagaccccgaacccagaaaatggagtcgcttatatagccctcagccatggcgtttcagcacctgatgtggcgtgacagctcctcattcgttgctcacccatcaccccactactatgccccgagatgggcagtgcctaggagtgagttcactctcgcacctgtgtacaaggcttgtttactagttaggcacagcggaggccagtgccatcttataatggcgattgctcacggcacgcatggctctccacagcgattgctctcagcacacacagctctccacagcgattgctcgccgcaggcacagctctccacaaataatgggaacagattcaatgaatcaaaggtctgttgtgaggttcaagtttgccacccacaatatgatgct

SEQ ID NO: 1076 - DNA, 1000 bp, mus musculus
tgttaaaagttctttgaggagtcactttatcgtaaatatgtgataaccacttatacaaatactctgctggatcaggaggggagtaggggtagggaggatgggtgggtggccatgagaatgaatggaaatctgcaactgactgggtggaggttggggaaggcatcactaggaagagacagagacccaggataggggacgtgccaagaatcaatgagactcataccactgtagatatgaactggggaggttgcctcctatggccaggcaggaatcctggtggagtgatagggctaccaacctaaccataaaactttcgacccaaaacttatcctgtctacaagaaataccgggattaggatggagcagagactgtgggaacggtcaaccaataactggccaacttgagacccatcctatgaagaagcaccaattcctgacactattaatgatactgttatgtttgcaaacaggagccttgcaaggctgtcctctgagaagtcccactcagcagctgactcagacaattgcaaacacccacagccaaagagtagttggagtttagggactcttattgaaaacaagaggaagaaactccataggaagactaaaagaatcaactaacctggaccctttagagactgaagcaccaagaaaagaaaacacacaggctggagctatgcctccatgcacgcacacatctagcagatgtgcagttgttcttcatgtggatctcaaacaactagagtgggagctatcccaaatgctgtagcctatatatggggtatgttctagctgggctgcctcatctggcttcagtgacagaggaaatgcctagcctcccagagacttgaagtactagaatgggaggagaccgagtgggcccccaccccctcagaggagaagtggagggggaaagggagaaggattgtgggaggggttgaacaggaagggggcagtgagtgggatgcagaatgaatgaatggataaataaataaataag

SEQ ID NO: 1077 - DNA, 1200 bp, mus musculus
cccatgtatcctatcagataaccatggactaaagctagacttcaataacaacaaaaacaacagaaaacatacatacccatggaaactgaacaaccttgaactattcaaggataacttggccaggaaagaaataagaaagaaattaaagacttcttagaatttaactaaaactaaggcacaacatacctaaacttaccggacacaatgaaaacagggctaagataaaaattaagcactaagtgcccatgtgctacggactggcctcagttggcccctcaatccacaggagaatcagagtcctggtacaggtgggcaggggttggagtcggtgaaaaggtgacaaacagatgtggacacaagggagtgctgtatctgaatattatttctcaaagcaagcaccagacttataatacagaagaaaaacaagaaagctgggcgaatacattagccaaggtacatagagatgcatgatggttctttacacaaaataaagaaaatgcacacataaaaagctagtgggagccaagcagtgtttacaactgagataggaacagccctatctaagatcagctaaacattggagccaggtgaaagatctgatggaatgctagtctattgttaaacccaccactaggagttccttagtaaatacctaattatgcaattcctccaggcctagtgaaaaacatgcaccaggggaattccattctactaaccctttcatgaataatacaatactgtagttcctccttaaaccccaacccaccttctttctactattatgtaatgtaggctgccgttcatatctgtaatgagaattctaagtttactattttgaactagccctgagaatacttgctcctattcggcaaactgagatgcctgattactgtcaacactggggcatttcctctggatgaataacattcttacaaaattccaagcccagggtcagctcaaggactgcttaggacattggtgaaagccagaccgtagacttcaacctgatttaggtattagtaaaatcatttcttggaatcacctataataaaacaatgctgaaagaaagcgtacagattcgtatacctactaatgcagggacaggtttggagcgttcctgccaaggttccaggagagtttgtttccatgaaactctttgcctctggactgcatccaagcctttaggtctgtcacacagtt

SEQ ID NO: 1078 - DNA, 1200 bp, mus musculus
tcacttgtttggatatgttttcctgtttttacataaggacttctacctgtttggttttgttttcctgtttttctttaaggacttgtaactctttagcagtgttctcctgtatttctttaagtgagttattaaagtccttcttaatgtcctctaccatcatcatgagatatgcttttaaatccgggtctagcttttcagttgtgttggggtgcccaggactaggtggggtgggagtgctgcgttctaatgatggtgggtggtcttgatttctgttagtaggattcttacgtttgctttttgccatctggtattctctggaactagttgttaagttgtctctggttagagcttgttcctcaggtgattatgttcgcctctatcagcagacctgggagactagctctatccttagtttcagtggtcagagtactctctgcaggcaagctctcttcttgcagggaaggtgctcagatatctggtgtttgaacctgcctcctggtagaagttgtgttccactcacagaggtcttaggatcccgtggcagatattgtgtggtccttgtgggtgtccggagactccccagatcagggaccccggtgctgcagtgggccagaagggacttgagccccagatcaggccaggttatctgctttcttaattaatgcagtctcaacttctgtgcgattggattggagcaggtgctgtgttccagtcaccagaggtcttaggatcccgtggcagatattgtgtgggtccttgtgggtgtccggaggctccccgggccagggaccccggtgctgcagactttccttcaaaatattataactggtttcttttttctttcatgttgtgatattagaagagttagagagagactaaatgtttgcatataatataattctctttcaatactacttaacgacaataatagaatacatatgttagtaactttttgttttagaaaagatttggaaatataaaattcttgaaacaacagtagacaggtagaagtccttatagaaacaggtagaagtccttatagaaaaacaggaaaacacatccaaacagatgatggaaatgaacaaaaccatactagacctaaaaagggaagtaaacacaataaagaaaacccaaagtgaggcaacgctggagatagaaaacctaggaaagaaatctggaaccatagatgctagcatcagc

SEQ ID NO: 1079 - DNA, 1000 bp, mus musculus
tttaaagctgaattactccagagtactaaacaatgaaagtgagtactcactggggctgcaaaatgtagctagtgcaggaagttgaatttgcctgagacttactaagatgttgcaattttatctttctgtctaaacctgtatccaactgatataaatgtccaatattggaggtgcatctaaggattgcattgggctgtcagatgaaagtcaacggagagaactcacttctgggtttgcttacaatttgagaagtagtacttgacagcagtgaataccactgctctcctgagacctagtgaagtgaaggggcaatagtaacaaagaaacaatgagcagttcttcaaccagatgaaagagaattccatttatgtttatcatagagtctcaatagtggttctacaatgtttactgtctgtaagttacatgggaccttagaggatagtgtttcagatcaatgaacatgaaatttcataggcttgaatattataaaatagaattagtaccagttgtatgtaaaataatttgaaagtatttttaattgaatttttaattggatattttctttatttatatttcaaatgttatcccctttcttggttttccctctgaaaaacaccctcctcctttcccctaaccacctccccctgctcaccaacccacccactcctgcttcctggcgctggcattccccacactggggcatagagccttgataggaaaaagggcttctcctccaattgatgtctgagtaggccatccactgctgcatatgcgtctggagctgtgagtcccaccatgtgtgctctttgattggtggtatagtctctgggatttctgggggtactggctagaactcctggcaacatgtacttataagaaaaatgacttgatatacatagaattatgcgtaattttgagacaatgactgttgctatcctgaagaattaatggctaacaggaactttcaaaagtcttcatagatttggggaaatgcagtaga

SEQ ID NO: 1080 - DNA, 1200 bp, mus musculus
ccttttctactttacatgtaagataaaaaatgttattaaattattaagccacattacctcttttgatttgaagaccattgtacctatccttttctccaaaattttccattttggttctattttacatagatcttttaaaatatagtttgcattattctttaagagtttcaaaccattttgatcatatatatcccaatctctcctttacattcaccgtccattgggatccctgtttgtgtgtgttgctgtttccgtattggtggaatagaagtggtataactaataatacactcagtatggtcaccaaattactcattaaatattataattcacagtggcccacaaaaatacaacaagggaaagaagataatattatattttcacttgcaggagcttagttattatggaatatttaagctaaattagcttcgatgttgccttacttttttttccttttttattagatattttcttcatttacgtttccagtgctatcccaaaagtcccccataccctcccctctactctcctctgcccccacgtccacctcttggccctggcattcccctgtatatcccctgcatataaagtttgcacaaccaatgggcctctctttccactaatggccgactaggccatcttctgctacatatgcagctagagacatgagctcggggatactggttagttcatattgttgttccaactatagggttgcagatccctttagctccttgggtactttctctaggtcctacattgggggccctgtgatccatccaatagctgactgtgagcatccacttctgtgtttgctaagccccggcatagtctcacaagagagagttatatcaaggtcctttcagcaaaatcttgctagtgtatgcaatggtgtcagtgtttggaagctgattatgagatggatccccagatatggcagtctctagatggtccatccttttgtctcagctccaaaatttgtctctgtaactccttccatgggtgtttgttcccatttctaagaaggggcaaagtgtccacactttggtcttcattcttctttttttttttttccattttttattaggtatttaactcatttacatttccaatgctataccaaaagtcccccatatccacccacccccactcccctgcccacccactccccctttttggccctggtattcccctgtactg

SEQ ID NO: 1081 - DNA, 1200 bp, mus musculus
gtcactacaagttgtggagagagacaagcagtctgaaatcttctgatgtaacttgacaaaggataggcgattgatcaagaagctatctataggagcagcagagattaaagccccatgtgctttctaagaacacaactgtccctagaaaaatccctcaagctgacatttttctcagaaggcagataaccatctacttgagactcacatctggaatgaagctcagcacctatcagtctataaaatgaaactagaaattaaaatctgaaatataaattaagaagtacaagaagcaggaaacacatctccaaacagggttaggagacattacctttagaacaaaatctgatagagacaacaggaaagaaaagcttccagccaacaatccatgtgaacccagatcaaagaccatttaatagaacataggcaaaccaattacaaacatacatagggtgaatatttcataaccaattttcattaaactgggaatggagggaaacttgagaaaaactgatatattgcttttacagtacaaggagtgaaggacaccacaagcaaatctacaaaatcaactaatcagggcactgaagagtgcacagtgattatatccccagccagggaacttgcataaagatactgaaatatattaatggtcattagtgaagctgtagaaagtgggaaacaggccattgagaaagagcacatgccatagagtttccattgtatggtatccactgctgaagataggacggtaccttgggtactttctctagctctcaatgggatgagaggcccttagtcttgcatagattatatgctccagtacaggtgaatgccacagccaggaagcagtagtgggtgggttaggcagcagggcggggatggggaatgggtataggggacattcgaaaaggaaactaggaaagggaatagcttttgaaatgtaaatgaagaaaatatctgattaaaaagaaaagataggacagtaccttcctgaagagtggacagtgcaattaacacaccatcctagaaagcatgtagctttacatataaatagtgaatctttcctccatttgtatttgaaattacacagatatcagttttaagtaaatgttgaccctaacagcacaacagacacagtatagaagagattttgaccccgtattttaaaacaatatctaaaatgcaagacagaaagcattt

SEQ ID NO: 1082 - DNA, 1600 bp, mus musculus
tttaatggcatgactccagaggaaggattctgtagagatttacaagcccttttcttcaacaaaagacttcctagtaacatgagatgctctgtcactgtgtttgactataatgcatatgtaacataatccacaaatgcttgttgccatttacaaacttgttcacataagttaacaagagcaacacaatcagtaaatgtaaaaatcaaaaaacttggcaatacaatattatgagtcctgtgctagaaagttatgcatactgtcagaaactatgcgttcaatatccgtaagtagttcattatgtaagcaaccaaatagaacaagatccagagaatctgagaattctttgataaaaacctgcctgcctctgtgcattttcggctaaagagaagagggagatagaacctgttgagaccacctccagtagattggcatggctcctggtggagggatggggccacccacccatctcaaaaatttttaacctagaaatgttcctgtccaaaggaagaacacacacaaaaattggaacagagattgaaggtagagccagatggaggctgccctacaatcatgtctgcaaacaccaaacccaacacttgctgtggtcaagaggtgcttgctaacaggaacctagtgtggctgttccttggaaagtaccgccagcaaccgaccaatgcaaatgtggatgcttggagccaaccatcagaaggagctcagggaacctggttgagcaacaggcggaaggactggaggagcagaggggaattgcagcacaattggaagaacagcataggctggcctgaccacccagttctctcagagtctagaccaccaaccaaggagtgtacctggagtgatccatgactccagatacatatgtagcagaggatggccttgcctgacagcaatgggagaggaggccattggtcctgtggtggtttgatgccccagtgtaaggggatgctggagcagtgggacctgagagtgtgggtggatgggggagcaccctcatacaggcaagagggaatgggaagggaagatttgggatggtggtttggtggaggtggtaaccgggaaatggggtatcatttgagatgtaaacaaatggaatgattgaaaaaaaaacctgtctgtcccttagtttatatagaagatatcatgatgctgatttacaaatctctgtaggacttaaagcattaaagctttgctgaacactttgagggtggtggtccttggatattcttacccgcgttctcgcgaccggccaggaagaacgcaacaaaccggaatcttctgcggcaaaagctttattgcttacatcttcaggagccagagagcaagagagcaagagcaagaaagcaagagcaagaaaaagaacaagaacaagaaagagaaaaagaacaagaacaggaaagcaagagagagaaaaagcaagaacaagagagagaaaaagaatggcaaaaccccgtcccttttaaggagaattatcctccgcctaggacgtattactccctgattggctgcagcccatcagctcagttgtcatcacgagaaaggcagaacacatggcgggaaaactgcccctgcacgtgtgcagatt

SEQ ID NO: 1083 - DNA, 1000 bp, mus musculus
gttatgctgactcttcacagcacttaaaccttaactaagacaccccctctagttcttccccagctttgacatatagaatctctgcaggcctaggcgtttttcccactgaggccagaaaagacagccaagttaggcaaatggattctacaaagaagaaacatctttaggaatagcccacctcctgttgtgaagaaccatatgaacatggatctacacatgtgctgcatatgtgtatgtgtatgggggagctaggtccatcccctgtattctcattgattggtggttccgtctctaagagcccttgagggttcaatttaattagctacatttatcttcctctaaaattcctttgtctttcctcagtctttccctaaatcttccataagagctcctgagctccattcaatgtttggctgtgagtctctgtatctgtctgaagcagctgatggatggggcatatcagaggatagccatgatagactgctatctgcaagcataacagagtattgtttatagtgtcagggattggtgcttgcacatgggatgggtctcttgttgggttggttattgtttggcaattccctcagtctctgctccattccctgtccctgcattttttgtaggcaggataaattttgggttgaaagttttgtggctggattggtatccctattgctccactggggttcctgctcagctacagaaagtagcctcttcaggtgccacatccccactgctgtgagtctcagataaagtcatccctacagattcttgggagcctcccctatcccaggtctctagcaggtacttgagatgcccctcacctcaacgccctgaagatgaagattctattcattgtcaaggttgtctgggcatctcccaggtctctcttcacacctaatcctgaaccctcacccctttctccaattcatcccctttccatctagttctcttcctccatgtggctccaactattttattccccattcaagtatccttg

SEQ ID NO: 1084 - DNA, 1000 bp, mus musculus
gggacacttatccctaaacaggatgtctccatcaaattcttcccttcagtactcagggaatcctgaggagatgagggcagaagattcaaaaatgctagaggtgttggaggacacctaggacacaagggcctctatattaataagactgacacacatatgaactcagaaaggctgaggtggcatgcaagaacctgcataggtctgcctcagatgggctcctagagctagaaagaagtggacatacacataccagtccacaacacagaagctatctccaattgataacttgaaaatgaaagcttcctccaaggaagtgtctttgagaaaacaaactactcctaagggtaggcttcatgcccagcagtaaagggccgacagagtaaatggccagtggagcatgatcaaccaaccaggaaccacatttgggaatctgtctttcccagcagcaattggttgtcagtagttattatctgtggatgagactttaagcccagcccctttctccatgctggtattcttcctggattgaaattgcaaaggtcttcagcccaacttgagatccatgaatgggcaccaaagcctgacactattactgatgctatgttgtggttacagacaagagcctaggatggctgtcctctgagagactcccagcagctgtatgaaacagattcagatacatacaaccaaccactggacttgaggtcaggaacccctatggaagagttaagataagcattgaaggagctgaagaggatggcaaccccataggaagtccaaaagtattaacaaacccagacccctgagagatcccagaaactaagctatcaaccaaagagaatacatggactggccccaggcccttggcacatacatagcagaggactgccttctttggcctcagttggtgaggatatgcctaatcctgcagagacttgaagccctagggtggggagttgcccgaggagggggtagaggggagcgcactcacagaggcaaa

SEQ ID NO: 1085 - DNA, 1400 bp, mus musculus
ttaaatactttattttatagaaaattgaactagtagacaatgatttaaaatttactaaaatatcttcatgtacattggcttatgaaagaatctttttccaaggtttcattttatctatgatgttgaatgtaactccacacaaagcctgccgctgagaagctcttacagttgagtagcaatacaaggcttgttttcctctcttcttactttcactctagttgaataaaaagatgaaacagaggcctgtaacaagagataatcaatggtggtgactttagcagtgattctctacattggggatgtggaacatgaagcacctacctcctgtagccagataggaaccccagtggagtgatagagacatcaacctactcacaatactttcaaccccaaatttatcctctgtacaagaaattcaggaagaggaaaaggagcagagactgagtgaatggccacccaataaccagaccaattgagaccaagtgagacccattgtgagcaccaatccctgacactactaaagatattctattatgtttacagaccagagcatgttgtcctctgagagtctgcacccagcacatgactcagacagatactgacagacacatctaaacaacggatagagcttggggactctcatagaaaaataggaggaaggattgatgctcccaaaggagattggaattccacaggaagaccaacagagtcaactaatttggaccctttagctctcagagtctgaaacaccaatcaaagagcatacaaaggctgaacgtaggactccctgcacaaatataacagatgtgcagcttgacttccctgtgggtcctgaacaactggaatgggggctatcctcaaagctgttgcctgcacatgagatatgttctactatctgggctgccttgtctggcctcagtgggaaagaaagcctctagttttcaaagaggcatgaggtaccagagtggggtggagtgatacacagggagatctcacccactcagaggagaaggggtggggattggagaagaaatctgaaaggggttagctgggaggggagcaatgagtgggatgtaaagtaaataagtaaaaaaaaaattaaataagtgaaggtaaatttttagtaattccaagaatgctttataaataatactcttcaaatagttgatttctacatctttagttctttctttgcctccttgactcatatttattaaatcccagagtgattattttgtttgttaatatgtaggtgtgtattctaagtattcactaccaataaaaccacttacctactgaaccagatcttgattctgactgtcaggccttagaattcccaagacttatttttctgaaaaaaatttaaaaattatcaatatcttctgttaaaatacagtcca

SEQ ID NO: 1086 - DNA, 1200 bp, mus musculus
tatactatatgtcatatacgatatactatatatctgattttaagtacatagaataattttgctttattcttttaaaaaataatatttaatcagtacttggttcacattatgtgtactatatacttcaggtagaattatgaaaaacagagctcacaaattttaaaaatccccattcattctaaatttttaatgaattcctaaataaactccaagtttccattgactttattttaagaatatacactcattcaaaagaaaacgatcccatctaaaaaacttttaacacaaaacttaccgtgtttataagaaatgcaggcactgggagggagcagagactgagagaatagcaaaccaaaaaccaggccaacttgagacccatcccatgggcaagcaccaatccctgacactattgatgatactctgttatgtttgcagacagaaactgttgtcctctgagaggcccacccagcacctgacccagagagacccagacacccacagtcaaacagtggatggagcttggggtctcttatggaagagtaggaggaaggattgcagacctgagagggataggaactccacaggaaaaccaacagagacaactaacctggactcttgggtctcagagagtctgaaccaacaaccaaagaacatacacaggctggacctaggcttcctcgctcacatgtaacagatgtgcagcttggtctttatgtggatatcaaacaactggagctggagctatcccaaaagctgctgcatataatgtggaatatgctcttcttgctgggctgccttgtctggcctcagtgggagaggatgcacctagcctcaccaagaattgaagtgccaggatgggaagatacccaggagggaccccactcactcagaggagagtgagagtgggtttgggggaaggattggaggagagggtaattgaaaggcggcagtgagcagaatgtaaagtgattaagtaaaataaatacatttttaaaaattagaaatactaaaatattctgttctttaatatatctagatttaaaaaattcagctttgtaagctcttagtggaggagtatgcagacatcaggaaactatttaaaaatgttatcatcagaaaaatcagtctcttttgattttcaattacaagttttatttctacattatatctgggaattgaattcctatgtgttgattctat

SEQ ID NO: 1087 - DNA, 1800 bp, mus musculus
cacagtacattggaaatcatttggcctcttcctagtaaccctaaatactcatattctgtttctaaatatgtgttgtgtctaatgtccactggtgttgcagggagagcatcatgagatgatatacatgctctacttcattggatgactaaagtgacatcctcagcaaaacatgaagcaggtactacatgtctccatatttccaacaaatatttcaaaatatatcagaatgcaatgtcacttcaacttaaaaaagaaaagaaaaaactctattaatgtctattttaggccgaggatgcacctcaatggtggagtgtgtgaggagccgccctcacatttgccattataagatggcgctgacagctgtgttctaagtagtaaacataatctgcacacgtgcaggggcagttttcccgccatgtgttctgcctttctcgtgatgacaactgagccgatgggctgcagccaatcagggagtaatatgtcctaggcggaggataattctccttaaaagggacggggttttgccattctttttctctctcttgttcttgctttttctctctcttgttcttgctttttacggggttttgccattctttttctctctcttgttcttgctttttctctctcttgttcttgcttttttctctctcttgttcttgctttttctctctcatgttcttgctttttctctctcttgctcttgttgttcttcttgctcttgttctttttctctctcttgctctctctcttgctttcttgttcttgttctttttcttgctttctttctctctcttgccctgacacttgctctcttgctctctggctcctgaagatgtaagcaataaagctttgccgcagaagattccggtttgctgtgttcttcctggccggtcgcgagaacgcgtgcaagagttggtgccgaaacccgggacgggacgagaagacccgggacgagaagacccgggaagggaaatcctgggacgagaagacctgggacgagaagacctgggacgagaagacctgggacgagaagacctgggacgagaagacctgggacgagaagacctgggacgagaaaacctgggacggaaactaccatcaccagcgcaaggaagatccctcattccggaaccagaactgcgggtcatggtaatgaagtgttcccgtaaaacagactgttgagaaggattcaactgcgtgaattcagaactcttcagctggggaatggtggtaatgaagtgttcccgtaaaacagactgttgagaaggattcaactgcgtgaattcagaactcttcagctggggaacggtggtaataaagtgttcccgcaacacagactgttgagaaggattcaactgtgtgaattcagaactcttcagctggggaatggtggtaatgaagtgttcccgtaaaacagactgttgagaaggattcaactgcgtgaattcagaactcttcagctggggaacggtggtaataaagtgttcccacaacacagactgttgagaaggattcaactgcgtgaattcagaactcttcagctggggaatggtggtaatgaagtgttcccacaacacagactgttgagaaggattcaactgcgtgaattcagaactcttcagctggggaacagggtacccgtaagtatagctttacaaggtaagtctggtcttgaactttctaacgaaattcaagacagtctatcagaagtaaagtgggaaatagctttacaaggtaagtctggccttgaactttctaacgaaattcaagacagtctatcagaagtaaagtgggaaa

SEQ ID NO: 1088 - DNA, 1000 bp, mus musculus
ttatgtggggccgtgaaagacagcctgttttggttgaatgaggcttgctccggagacctagtagaaaactctataagtgatggaaaagtgagccacgttcccagagacagatgtctgacaccacagggcccccaattccataattctgggactatcagtcacacagataaagcccaaagctcctgacattctggctagacttcacccccacagtttcctgactatagccaggtatgctcctccccacaattacctggcaacatcaaggtagcccagcccactataaaaggagctgcttgtttcctcctcgctctcttaaactctcatctttcttactctcatatctactcctccttctctccctcccttcccccttctctccatgtggccatggctggtctccctctttctaccttttttctttctccctgcctttctacaataaagctctaaaaccacagactgtctctgctcaccaaggcacatggtccttgaactatggaatagtctttcacctaaagagctgcatctaacctcccatggacactccagccatagatcggaccaaggactttctcctgtatgggaacttcccagcactccctctctccctgtcctcccctcccttcaagtcctggggatgaccaagcctcccctggggccccaattttcttctcagctcttctgcagtgtccagtggcatctgggatgctgaaggctgagaacctgtaatctctggcctcagtgaggcccagagacttctgactgccccttgcccaccccctgcaggactgggttcagtggcttcccacagccagacacccacccaggatcgcatggaaaaagtgcagcagtcctccagagtctgcctacccagagcactggaactctggcgggactggggttttctccaattcccttgattcccccacgcccagtgccccacaatgttataaggaaactctactgaaatgcaatgtattttgattttcttttcctg

SEQ ID NO: 1089 - DNA, 1000 bp, mus musculus; identical to SEQ ID NO: 1088

SEQ ID NO: 1090 - DNA, 1200 bp, mus musculus
tgtgcatgtatgcatttatatatacatatgtattcctgaacataacttgtttaaccaatataatgttacttctctctctctctctctctctctctctctctctctgtgtgtgtgtgtgtgtgtgtgtgtgtgtgtgtgtgtgtgtggtgtgttttcaggggtaactatttggcattggacagccagctgatatgttcttctctggggaagaccaccttgcctcctcccagatttcctgtagctatctatagctctttgtgtaggattgaagctctctctctgtgtgtgtgtgtgtgtgtgtgtgtgtgtgtgcgtgcgtgcacgtgtatgcgagagtacgtgcatgtgttgtctttttttcccccatccagtttaactaacatgatcattcatgtcatacttgctcacgttcaggtggtcatgtcgatgaaaggagtgagtctgccccatactctgcagatgctacctccgccaggtctgatgctgcaatcattaccatagctagaaaacaaatgcaacctaatggggttgcaaaccccttcagctccttcagaactttctctaaccccataggaagaatggcaatatcaacaaaccagattcttcagagctcccagggactaaaccaccaaacgaagagcacacacggctccagctgcatatatggtgaggataccatgaaccttcagaaatagggctcagaaacccctgagctggaactgacctgaatgtcccatccctagggactagctttcatggcactagaaaaggtgacatgcaagcttccaaagatgagcagcaatcaatagtcctaccctgctactatgccttatgaaccacatcaatggccagcagagcacagtactctaaagctgcagtagtggcacacatactttggcagtagccaacagctctataattggatggaacacttgctcaacaatggctaaaattttcctggtactggaaatgtggctaactattattaagtgctagtgaacttgtgattattggaggagaatctataaccactaatttaccaaaccaagataatccgtaaaaacaatctataaatgtatgcctttaaacccaaagataagtgtagtcttcatccctcatcaaggaaatttctctttgcaacagatggagagagaccacaagagaaaaccacaaccaatcaatatgcagagttttagattt

SEQ ID NO: 1091 - DNA, 1000 bp, mus musculus
tcaagaactcagggtaggagtttggagacaggagccgaagcagaagacatggaggaatgagtcttactggcttgctctctgtggcttcctcttcttatgcaacccaggaccacatgccccgtaattgtaccacccacataagctgggccctaccacatcaatcatcagtcacgaaaatgcccctcagacacactcgcaggctaatttgaaggaggcgattcctcagcttaagtcctctcttggtcaagttgacaaaaactgttcagaacaggagtggcgatagctgaggtcattcattccagaagtattctccacacttgtgataatggaaggctagtccttagagagcagaaggggtctgaggtaacaggcattgtttctctttgagataagattgtgtgcttcaaggctgatctttttatgcatggtctttgtgtctatacttccttaggtcttggattaactgtctcgcctaatgtagaagacttctcattgtatgttgctctttgttctggaagaagagtgtcatgttgcagtatcaggggtctctgctactgatccctccccaccccctctcgcttctggcaggattttactatgtagttggaattggcattgaacttgtactctccctgactctgcttccttagtgtcgacattagacacatgcttcactgtacacagttcatgctatggaatagtcaaaagcagcaacagctgtaatgtgcctaacaagtagaaatccaggttgttgctctacatgtacattacacactctggcactacagtacccatgccagttgtaggtggctggtgacaaaaactagctagcatcaatggccaatacatttcaataatacttagtgctttttgctggtagacatttgctaatgggtattatgcatggaacaaaaggcttacagaatggtgcccagggacacacagcttctgcaatctcagcagtggactgaggcaagacgacaaggagttcaaggacatt

SEQ ID NO: 1092 - DNA, 1200 bp, mus musculus
atgaatgatgctgtcagtcacagcagaggggtgtgcttgtcacacttagttacttctcaaggccatcctggggccaagggcagctagacaaggtacggctatgagtagagcgtttgagggcgcagggaaagagacccagatctgactggaaccaattctcaactttcccaagggaaactccttgagtgtggcaagacgttaagcacattggttctagtgcagaacgctggcccttactacttgtaagaacctgtcaaagagctggttgaagcacatatccctagactcgtgtccaaacatttggatttagtgagtctagagtgtggtgaggtttgcttttctaacaagttccagctattgatgagccagcatgtggatcaacggccagacggcctgacctccggcactgtctccacctcttaccacagtcatatgggtccctcagtcagcttctccctgaaatgagttagtggcttcctatttcagaatgttttggggtagggttagtgagggaagccatgtaagcaagagaacaaacctgaaagcaagctcaatacataaatattacgtttgtgaaatactttaaatagcactctatctcactctccagaatgaaaaccaaagctctgctagtctgagtagctgcctgttcatccctgagggaaggagcagggaaacagagagaaatttctgggcaccagggccatctcagggcacaaggctgagatgtcctgcaaccttgtgcagacgctgaacacccacacagtctgaaactcacgaccttcacgtaggaaatgaatctttttaaacaagtgtgagaagcagatattgatgaagtccgtgcctcacttctgccaaaggaagagaacacactgtccagggtcatcaagatgggaagttgaggccgtactgaaccagggctagagccctaactgggatgctggcattactctctccctgcaggggaggaggggctgatgacagcacacgtacatagctctccgaggaggccaagaagtgcagtcacagtcccaagcttccaacaggatacttggggtagccgagttacagccaagatatgtctgtgtctgactgctgagaaagagaaaaaattttaacttttgctttaataaaatgcacaatcatgcatttaaaaaaaaaaaaaaaacaaaccctcttttgagccaatagaacatgata

SEQ ID NO: 1093 - DNA, 1000 bp, mus musculus
tgggagatatctaatgtgaggaaatagtggaattaatcaatataccaataggtaactagagaagaattactacagaaactgtgggatttcttccttgaaaaatacagatgagatgaataaaaatatatattccttcaacttttcatgacaataaataaagtccaggcttctgtgatgaagaggacttactggtcttgcagaagatctggatttaatcccattacatacactgtacagctcccaactgcatgtaattcctgcttcaggtgatctggtgctttcttctggcctttgtaccccccccaccaccaccacacacacacacacacacacacacacaccactgtcatagacatagatacacaaacaagagcaaaatataacttaggaaagaattcaggcttccattttagtgagagatagctgtagtgcctcatagggagtgccacaaagaggatgtggccttgttgaagtagatcaagccttggaggaagtatgtcactgttggggtgggctttgaaggctcaggagttcaaactacaccaagtgtggctgacagtctcctgctgcctcttaatcaagatgtagaactcagcttcttctccagctccaggtctgcctgcatgctgccatggttcccaccatggcaataatggactgaacctctgaaactgaaagccagcccaattaaatgctttcctttataagagctgctgaggtcatagtgtcttctcacagcaatagaaattctaagacaataactgaaaactctccttgtctccagcaaatttacaagcctgtctagtgaaatttacaagtctgtctactgatcaaatgtaacaccactttagtttgctctattaactatgtgtttaggtagccttaataggaaaactatggctcttctctctctgttctcttagaatcagtctctcagtctcttccctagtactaaaacagatcgccagctgcagcctcccttaccactgtgcagcacatc

SEQ ID NO: 1094 - DNA, 1400 bp, mus musculus
actctctccaaatttaacaagctttccagtgtcctatgatcaaagtctgcttaataaaatgttctttttaaattttttagtacttattacattgtgtgtttgggtgcacatgccttatcatacatctggacatcacaggacaacctagaggcattgactttctcccagataagtcatgaggattgatatcaggattcttatgtgctgagtcatctcaccagcccataatatttatatatgaatggtcaatatatagccatgaagataaagaccttgtggtttattttttctggaagaagataatcatttattatcctgatcattcaaacgatacttttgtgaaaatcataaatttatttttaattggatattttctttatttacatttcaaacatcatcccctttccaggtttccccttcagaagccctttatcccactaccccctccccctgcttatgtgaggttgttcccccacccacctactcctgactccctgccctttaattcccctatactagggcatctagccttcacagggccaagggacttttctcccattgatgcccaacaatgttacatatgtggttggagccatgggttcctccatctgtactccttggttggtggtttagtctctgggagctctggggggtctggttggttgatattgtcgttcttcttatgggtttgcaaaccccttcagctccttcagtcctttctctaactgttccattggggaccccatgctcagtccaatggttggctgcaagcttccacctctgtatttgtcagactctgtcggagcctctcaggagacagctatatcagattccttcagcaagcacttcttggcatctacaatagggtctgtatttggtgaatgtttatggaatggatcgccaggtgggcagtctctagatgtcctttccttcagtctgctccatattttgtctccatatttcttccgctgagtattttattctccctcctaagaaggaccaaagcatccacactttggtcttccttcttcttgagcttcatgtggtctgtgaattgtatcttgggtattgtaagcttttggtctaatatccacttatcagtgagtgcataccatttgtgttcttttgtgcttgggttagctcactcaggatgatatatatatatataatatagtgcactatttcaaatatccactacttttattatttctctacaggtgtattgcatttaagttttagtctgcaaagtataaaggcatcttcttgctctgaaaatttcttcagattttgcattgtagtaaaattttgctacttatcttgtaaagttaataaaagttttatgctttattcttgttaaacagctcctgtataaatcacagggcaagccaaagagtttatac

SEQ ID NO: 1095 - DNA, 1200 bp, mus musculus
ctctatctatctatctatctatctatctatatatatatatcatctctatctctatatttgtggactatatcaaaggtattaaaaatccagtttatatcaattatcttttgttaagttataggatgtttacaggatgacttggtgacttgcaatctatgtggtgatctgtaaccccttatactacaagaatatcttttacagaatattcctcttttttttttttttttttttttttttgtcgagacagggtctctctgtacagccctggctgtcctggaactcactttgtagaccaggctggcctcgaactcagaaatccgcctgcgtctgcctgacaagtgctgggtttaaaggtgtgtgccaccactgcccggctacagaatattcctttacagaagaaaaaaatgagatatttttacagttgattctaactttgtcccactttctttttgtgtaattaaaacttagagcaagtagataaatagcctttgcttgtgctttgaaatgattttaatagctgaaaccaaattaaatacacacatatgtgtgtgtgtaaacatagacacagacatacacacacaatctgcatatgtgttctagaaatttgatgttttgcatacattcacagaatcagcttaccttatgtatttgttattatggacctaattttagatggctcttatgaccacatttatttggcgttttagaaaccaagtttgattaaattgaggacaaagcaataaggaattcaaaaaatatgataccatttatattttttttctgaataatccattacactgctggagcgttcatatttctgaattgctagcagtaagtgttgtggggtcagggactaaccagtgagtgaaagtcagaactcaaaatgaagtgtcttttctgtttagcactgggcacccgtagaaactgataatgtttgattaatgaatgccaggctagcggcagcaaaaacatctgcaaaaagtgatttattatttcaaaggtatcagaagcgtgtggtatcttgcagatttaagtatgtgtgcctgaataaaataaatgagatgcaacatgtgaaaaatgaaaacacattactggtacaggatgtgtcacaagcagggtacttttgttcaagtacactttgtcatggggacttttaatgctgttctgaatacaaatcatttagctggttcataaaatctc

SEQ ID NO: 1096 - DNA, 1000 bp, mus musculus
ctgccagctatactgtgtacacattttcccatggaggaaaaacttcagaaataaggagtactctctttatccatcccaacagctgcactctcacaacccctagctcttggcaggaagtcatgtcagatttaaatgggtcactgaaggaaagacttattcttcacatgggaactggaaacgagttttggcctttggagacagggagtccatggagagatggggagggctattaaatccccaccctacatggtaaatcaatggaataagcagaaacttctgaggatctgactgacatctgcctccagcctcccaagtagccaggcctgaggcagaactctctcagcttttctcctcagaggcatgaactcatccacagtgtctcttctggtgttttgtgcctcctccgtgttttgaacaccccgtctatgtaaaacttagcatgggctgagcacatcctccctccctggatatttgcattttaagccttttatctctagctatagattgaagggctttggttacagttaaaggaatttcaaacagttgcaactagatggatgagattagtttgggtcctgaggggctcttctttgtccctaaaaatcctcgtattgtcagctatactagatgcagacatgaataggctttgttctgacaccattctataagctctgtggaaacacagtgcctactgtgaccaccagtgtcaaacactgagaagagtcctcctgcctctacctttctcttttattctttgaaccttctgagacatctattggcatctttcaaattttttgcttcctggtttgtggcattttcttctgtctcacagatgaatttgttggtctcatgagtaattattgctttgacatcttcagagcatgacttgcctcctgttattttttatgtcaatggttatatcttacttctattactttacagaaattatggtttttatctagtttctctcctcttgtgtcataagttggtatggtttcgg

SEQ ID NO: 1097 - DNA, 1200 bp, mus musculus
taactcttttgcagtgttctcctgtatttctttaagtgagttattaaagtccttcttgatgtcctctaccatcatcatgagatatgcttttaaatctgggtctagcttttcaggtgtgttggggtgcccaggactgggtgaggtaggagtgctatgttctgatgatggtgagtggtcttgatttctgttagtaagattcttatgtctgccttttgccatctggtaatctctggagtcagttgttaaagttgtctctggttagagcttgttcctctcatgattctgttagcctctatcagcagacctgggagactagatctctcctgagttttagtggtcaaagcactttctgcaggcaagctctcctcttgcagggaaggtgcacagatatctggtgttttttcctgcctcctggcagaaaatgaaggcccgaagcagggcctgtcccagaagctgttagcttctgtattccacactctcacctgtgcagactagtcttggagggatcaggcaaccaagatggctcccccaggtgctctgtcaaagccctccagggcaggatggacacttctcctctggcagggaaggtgcccaaatgtctggagccagaaaaggggtctgcctcagaagctgtcctctagggaccttgggggtgtctgctgactccgtgcccaaggtgacttggtgctggcacagactggaagagatttgtgaccctggtcaggctgggctttctgcttccctaatgctgtctcaggtccctcgcagttggattggaacagaagttgtgttccactcaccagaggtcgtaagattgagtggatagtcctctagagaccttgggggtgtccgaagactctgagcccaggtgacccggtgctggcactgacctgaaggctttgttgtgcttttaacatacaaaaggattcatttacaaaaataattaaagaaagaaaaaggtcagggtgaaaaacgtaggcaaagtcatgttgttatatcccacagagaagcaaacctggaacaacttgcaagctaacttgtacattcttaacctggataaaaggcttgtttgctcagaggtaatcatgctaattgtgacaaagagctcttttaagcactgactaattgtgttgtagatgccatctacatgaaacataatttacttctattggctgagtgggacaatgatgtgagtcaagg

SEQ ID NO: 1098 - DNA, 1000 bp, mus musculus
tttgcctggctcagctctcctggaatgtccaaagtcgattctccaaggctcagtgcaccaagacactgctgtctcttccaaataccctaagctctccaatatcctttcacttcatgcattcaactccagagcatcctgggactagtactgcccctgcctcatctcacctagtgttggggtgatgggcaagtgccaccatgtctcacagttctcttagcacttagtaaataactctgcctttcttccttctgtctggcttgcgttgcatgtagaacctggagactgcagggccctttaaactgtatttccgatcctggatactgtaataatcaacaatccatgcaattctttttgcctcaatgatttcagtggctagaacatggtctcctataggcacaattacatgttttgtgaataaatgaccaattgttttatgataaaaaaacaaaagaaatcctacttgctcttctggcttccatgaaagtctgtgcttatgtgcatgtagtcacatacaagcagacacacatgtacatgattaaaaataaaatcttgactcaggagcgcacaagctgtagaagcagcagagcacctcggacaggctcctacggcctacatctgcacccgtgaggtgaagctgatcctcagtcccctgtgcaccctccctgccagggaagagctggccgaccctgggactcaggtgacattgctatttcctctccggtgactctctaagacaggtccactcaggagctcacaggcctcagaagtggcgttctgctggaaagggtcctatgggcctacatttgcacccaggatggagggctgttctgcaaccctctatgcactgctcttgccaggagagagctggtctcccagaagtgctgacagaggcttacagactcacaagaggaacaggctccagccagggacagcaagaacatctaacaccagagattaccagatggtgaaaggcaaatgcaagaatcttaccaacagaaac

SEQ ID NO: 1099 - DNA, 1200 bp, mus musculus
tattattgatgctatggtgtgcttgcagacaagagcctagcagtactgtcctctgtgtctcagttagcacaacaagcagctgactgagacaaatgcagataattacacccacccattagactgaagttggggaacccctgtggttgaattatggaaaagctggaagaagctaaggaggagggcaaccctatagatagaccagcagtctcaactaacatgtacccctgagatctctcagacactaagccaccaggcagcatacagtagcctgtctgaggctcttgacacatatacagcagatgactccctggtctggccctagtgggtgaagatgcacttaacactaagagacttgaggccccagggcgtagggaggcctgttggaggagggatatgctcttggagacaaagggaggaggaataggatgagagactacaagagggtgcacatggagggggatacttactggactgtgaaaaataaaagtaattaaaagaagaagaaggaagtggaagaagaggaggaggagaaagaggaggagaaagttagccaatgcttatgaagacaatgacaatctattaaaattatcttctacactaagctaaacaaagaaaatttacacaaagctaccaaaaaatgtatggagatcctcattcttcttcaagagcaacactgctgaagccgacgtggtttcgcagctctgcttcttgacccctctttgtttctcatttctctagaatagaacatgcatggaagtggctccagactttcgcatgacttgccgtctggaggtaatggtgacctggcctgtctggccaaacagtgctgcaaaatccatgcagcaggtgcttgggggaaggaatacaacctatgcgcctgcataggaaccaattgaacttcaccctggcacccaagagggggaaagtcatttgtagttgtgaagtccttacactgacacatatttaaatatagaattgttatatgccatttatttttatttctcttctcactaatattgaagcttagttagagacctggttttgttcaggacaacagtcgagtggacaggatagatcctggaacacagtgacattttgtgatggaattcatgaaattataatgtggtacacacactcacacacacacacacacacacacacacacacacacacactcactcactcactcacactactggc

SEQ ID NO: 1100 - DNA, 1000 bp, mus musculus
ccttcccagtctcagacattggtttctatacggtagctcaatggcctaggctgaacacagttggccctcacaatgcactgcataaggtcacttgagacacagtaagttgtgaggatgaggactgttccctcttagtgagccacagtcgaagcaggaaggtccttttacagtcactactcctcctactctgtcacactagctcgtggtaattgtgtatcgttcaacagggtcctgtagctatgcaggcaaaagaggtgaaggaaagacaaagcggaatgatccactccaggcacactggcccctgctattcttcacaccaagtctactccttccaaagacttttcatattttgtggagagccgcaatagcttccgccattacaagatggcgccggcttccgctgtgcctgcaggaattttccagtaaacaagcattgtgcgcatgtgcaaaagagtattggcgccaagtcacagcccatcaggggcgtatcaatgggatcatgagcaagcagccagtcaggtgtggacacgccgcagcgcctctttggggctctgggtcttcctcttcatgctgaagctagcgtaataaagcattgctgcagaaggatccggttgtctgcgtgtgttcttgctggcgagacgatagcggcgggacaatatttgttttctcattgatctcagatagcctctctccagatagccaagggccttgcaatcccttctttttagtcttgacttcaactcattttctcatagaagccttctctggtcaccctatttcttgttttatttgttttccttagcccacatagctatctagcatagtatatatcttacattttcctttccattgtgcatctccatccctggactataaacaccgtaaggggaggagtatgttccacatgagtgtatccccatctcttagaatctggtacacagccagattcctaataaatacctgttttataaataaacagatatcaaccacatctaaaaaa

SEQ ID NO: 1101 - DNA, 1000 bp, mus musculus
tatccagtgaggagtgccgtgggacctcaggtggttgctccgggaaaagatttcttcccaagagttacagctcttggaacaaaagactcagaggacagagtagttctcatgcacctttacttccctggatatttatatacagttgtgggcgtgattcagggttcgacagcagatacctctcattggcttggacttagagtttgggggaaaccttatttgcatgtgggaaggattggtgctgctcctatgtgactgatagacacacacctctcctggggggggggggggggtctgtgggagtggtaacttcgacaggagcccggggtccaggagatatgattgactgtctcccatccgtcccatgtaggtggaaatcaccacccacccggaaccccccccacaccggggttcaaaacccatgctcaactggagaccaggctgtctgtgcgcagcccactgccccacactaatcctctgaaactctaagtgttttcttttataagcattgccttggtcatggtgtctctcctcagcaataaaacagcgatgaaacaaagcacattggggggttgtgtagaaactttcttgggtgaaaagagaacatgaatggagactgtttaagaagccctggtggaattgcatatactagcaagcgtttgctgaaaggaccctgatataactgtctcttatgtgagattaggccggggcctagcaaacacataagtggatgctcacagtcagctattggatggatcacagggcccccaatggaggagctagagaaagtacccaaggagctaaagagatctgcaaccctgtaggtacaacaacattatgaactaaccagtaccccggagctcttgactctagctgcatatgtatcaaaagatggcctagtcggccatcactgcaaagagaggcccattggacatgcaaactttatatgccccagtacaggggaacgccagggccaaaaagtgggaatgggtgggtaggggag

SEQ ID NO: 1102 - DNA, 1200 bp, mus musculus
tgcgaagacacaacttgacactgtgccagagagcatggggcaggcagcacatcagcaggggacaatcacctcagagaggcagaggaccagaggttggaggtgataaagctcagccctgacctcctgcagctggggctatagtcccgatgacaatgacctttaatgtcactgtattataatcccttctcagttcagctcgccacacacaattctcagctctggtttctgccccattttaattttcactaaaaccacagtaaaccaaggaaaaggctaagaatggccagccctgaatcttaagagtctgttcttggtttgataaccacgtagggtatcttcaatttgtcatatgtattctgtccctgggacagtctaactgtatttgtcagttcttcaagaaagaaataaacaccctggcaggtgacttaagaaactgaaactcacctctggttaacagagctctgtaagatgatcgctggctgaccaaaatgtaacagtaggaagagaaagtaagactgtcacacggaaccaccatggtcacggaacagcactgccaagaaccattcctcccagtcctaggaaggagaccaagtagatgtatgcctgctgtgtaaatacaacagcctgaagtcaaatccctaacactcatgcaaaagccaagcccaatggcacacatctgtaagcccaggactgcatgtgacacaggaggatcccaagggtttgaggtcaaccagctgaggctaccagtgatctccacgctcagtgagagatgctgtcctaaaaagaaagaagagctgaagagatggctcagagcttaagagcactggctgctcttccagaggacccaggttctgttcctagcacttacgtggcttggctgttcacaattatctgtaacttcagatgcagaggctccaactccctcttttggcctccttaggcagtacacatatgtggagcacaggtacagacataggcaaaatatccatatacaaaaagaaaaattacataattttcttaattaagaagaataaaatactgggctagagagctggctcagtggttaagagcaccatctgctcttccagaggtcctgagttcaattcccagcaaccacatggtagctcacaaccatctgtaatgggatctgatgccctcttctggtgtgtctaaagacagtgacagtgtactcacatacat

SEQ ID NO: 1103 - DNA, 1000 bp, mus musculus
atttgaaatctcccaactgaaaaaaatcccggagtctgatgaatgtagtatcgaattctaccaaaatttaaaagagaaacttattgaaggatcttacatatttctctctctatatttaatgatgccactactaccctgataccaaaacaacacaaagacacaacaacaacaacaacaacaacaacaacaacaacaacaacattataggacctgggagtgacctgaagagagacatccaagtggtcacccagggtccctggtaggtgtcagtcattatgctgagtgactgagtgatggagagatgggaaagagagtatagctgtggagagatgggagagaaagtgaagccaattggttcattctctgtgtagaaaggtggaactggagaagctatggcagtcagacacaggccgatatgagaagcttgtacaacaacgggggccatggtgatgtctgactcaggctgctgccaagggcatgtctgggtcaacggttctattgcagcttggatctgtgctgatatctatggcccatgttaccaccaaaagccatatggatgtacctggtttgggctgctgccaggggccatgttgatgtccaagcactgtgctgagctggccctgcctcaacacatttgggaacatggccctgcctctcttgccttggcagcatgggactgctggcagtggtggtgtgggtatgggagacatggctcttatgaatgagtacaagagaactggcctcactccttacctgggcagcacagttgaactgaccttgatggcatgggtgccagagatctggtagactgaccaacttaggcctcacctaggcccagatccagagctctgagttggcttaacccaacatctaccctacctatgaactgctggagcacatgaaagggctggtcccccagaaccaaagcctcaggttctccatgacacaaagcagcaacaggatagccaagaggagtcccagtgaaaatcaagtattgata

SEQ ID NO: 1104 - DNA, 1600 bp, mus musculus
gactctagctgcatatgtatcaaaagatggcctagtaggccatcactggaaagagaggcccattggacttgcaaactttatatgccccagtacaggggaacaccagggccaaaaagtgggagtgggtgggtgggagggtgtgggggacttttgggatagcattggaaatgtaaatgaggaaaatacctaataaaaaatgtatataaaaaaaaaaaagaaagaaagaggagcctcagttgagaagataccatcaccaggttgcttgaaggcaactttgtaaggcattttcttgatgaacctgtgatatgggaggagccatcccattgtgggtggtgccggtcttggacagggtgtcctggggtgtataagaaagcaggctaagccagagggagcaagtcataagcagccttcatccatagcctttgtttcggttcctgcctcgggtgcttgccctgacctgctcagtgatagagtatgacctgggagcgctaagatgaaacgaaccttctttcccgggttgctcttggtcttcatacttcatctcagcaacaattgatacatgagccgtttctgtgcattctaggaggtaatttgaaactcttctggattcagctaggaagctgtctactttagcttgtagctagctgctcggacccatctgccccctccggagcctagagacttccagtcacctctcatttgctcctgacctctcctggtccatggggaaacacataccatttgtgggcacgaggcagcaaacttcctggttctttgccaaaactgcttgccaacctgtgttctccctttccagatttcctgagcgtgtcaggtcacagccctctctgacccattagctgtcctcacaccgcctttcaggtcagctcatctcagactccactcaaaaattcttctcctacatggtctgaagtgaaggccagggtttctgagcccctgccctccactgtctgtatccacgttctggtacgtacagtcacagggacctggctgaggatgcgagccctgcagaagtagcgcgccattgttatctttgtaaagcctactgctctgttctgaactcgggttagtgcgcagccgctcctctctggggtttcttggctaagacgccagcttcactatcgttctgcatgcatgcacacgccatttccagccagctaagtacaaagccctttatcatagttttctgtgttaaaatatgggctaaacatggaatagaattttagtctacaaattattttcaaggaaaacgtctagaaactttcaatggtcttaagaggagagactttacaacttgcgcaggccctgccttgcagaaaaggactaatttccttccagggcatcatgcatccttggcctggggacttcctccttatactgaaccacacctccgttcctggctttacctggttgttgatcctggtgcctcagaaacacaatctctcaacactctttttctcttctttctccttctccccagtggttggttggttggctcaaagcagggtctcactctgtagctgaggttggccctctgagtggcccttctattttagtcccttgagtgctgggcttacagaca

SEQ ID NO: 1105 - DNA, 1200 bp, mus musculus
taatttttgtcattatataataatatagaaatgagaagtaattatacacacacacacacacacccaagcacacacacatcaactcaaagtatcaggaaaaaattctatattgctcaaaaatactgttgttattttaacttaattattttatttatttaaatttcaaatgttccccttcccagtctcccttccacgaattcccaccacattccccctctccattttgcctctaagagggttctctccacctacattcctgctcccacctcacacttctagaatatcccttcactaggccatcaagcctccacaggactaagagccgtccctcccactgatgccagatgaggcatacctctgttatatacgtagcaggagctatgaaaactggcccctatatacagtctttggttggtaccttagtctctgggacctctgaggagtgcagttagttgatacttttgttcttcctatgtggttgcaataatccttcagctccttcagtccttatcctagatcttccatcggggtcctcaggctcagtccaatggctggctttcagtatctgcatttcccttagtcaggtgttggcagagcctctcagaggatacctataccagactcctgcctgcaagcacatcttagccttagcagtagtgtcagggtttggtgtctgctaataggatagatctcaaggtgggttggtcactggatggcctttccttcagtctctgctccattttattttttgtcccttcatttcctttagataggaacaatcctgtgttaaaattttaagatcgatggatggcccatccctcaactgggggccatatctatctattgggggtgccttcttcaggatctatctcctccattgttgtgcatctcagctaactcatctctatttggtcctgagaacctcttccatccctggcaacagggatgttctagtggttccacctgttcaccacccctaaatggacttctctcctgtctccctcattcctccatacatgatcttggccccttttttggatccatctaccctttccaacccaggttcctctctgcctctgtcacccgtgaataatttgtattaccgttctaagtaggattgaagcatccacattttggtattctttcatgttaagcttcacatggtctgtgagttgcatcataagaattctgagcttttga

SEQ ID NO: 1106 - DNA, 1200 bp, mus musculus
tttgtaaatggtagatatttaaagactagagtatacatgttatggatggtaagtgtaataacatgccaattaaggatcaattataacatacataccatggcaatagaagttagaagggtgaatttaagggaagggtgatagagaacgtatgtgaattcttgctacttgtgatactttatctcaatgaagttagtatcactctgaaaagcacctggagagatggactggtagttaaaaatacttgttacacagccatgagaattggaactcccatctcagcagtgaaatgataagccaaggcgtcctgaatatgtctgtacctccagctgtgagagatttgccactctctctgctcttcaagtgcacagaaacagtgtgctcgcacacatactggcataaactcaaacgctaacacacacataaataataaaccttttaaaaactgcactgaaaatatgttgaattatgagaaggctttatctaagcttaccttatttacatttgtaccaagaggaggcattatgtttttttcctgtttttccccaaattaaccacattgatcatttatttaactggtcttgctaaggtatttgtgtcactatttatttctaactcatcagacaaataacaaaatcttgtaaggaacactgtaaaacattgtaaaatggactagcgtgctggggtgtagtcctgacaaatcactgtagcggacagatggtttttcattattggctacatggaaatacaagcctgcaacttgtttgctacggatgcctactcatctgtgagacagtaaagtctgtgcggcttggccggagcacacaataaatcttccctcccatccgcgtgagcatctgcgggaaacagcgtgagagtgtatatttgctgggaaagcacattccatcttaggtctttctgaggcaagttacaagaaaaactagtgggatgtttattaagatattaagggctactctttaaatatatctttttaaaaaaacataaatatttacggttctttgttttgctgactcatatttctagtgcttaactttggaataagctgttttgctatgaaacaatcccttggaagaaataaacgcatcttcatagttacttaaatatgttttatagatagaaaaaaattaaataactaataacattttatgcaacatacatataaaaatatatgtgcttactaca

SEQ ID NO: 1107 - DNA, 1000 bp, mus musculus
ttgttgttcataacagttctatagtttttttttttttatgagagcactaataaaaatagcttaggcatgtattattatatttgaaaggtgaaagacaataagcaggtaatgagattggtatatcagaagacctacctgtggggcagtgggctgtgcacagatagccttgtctccagttgagcatagtcttgatccctggggaatctgatggggggtgatttccacctacatggaatggaaggcgtttgatcatgtctcctagacccctggctcctgtcgaagttactgcctccacatcccccacaggagaggtgtgtgactatcagtcacatagacaatgtcccaagatcctagcattctggctagactccactgcacagttacttgaatatagccagatatgctcctccccacagttacctgatagcccagcccactataaaaggagctgcttggttcctccttgctctctttaagctctcacctttcttactctttagccctccttctctctcacacttccctcctcactccacgtggccatggccagcctctcttcctctttctacattctttctttccccctgccggtaagaacacactcaagacaaccagaatcttctgtggcaaagctttattgcttacttctcaggaagaccccgaacccagaaaatggcactgcttatatagaccgcagtgtgacgtttcagcacctgatgtggcatgacagctcctgattcgttgctcacctatcaccccattaccacgccccaagaatgggcagtgactaagagtgagttcactctcgcacctgtgtacaaggcttgtttactagttaggcacagcagaggccagtaccatcttataatggcaattgctcgcggcatggctctccacatctccccctttttattttattaaaatgaggctggactaggtctgtgtaattatgcccatctgctgtggctcctgtcttaggtcgtttctccaatgtcacagc

SEQ ID NO: 1108 - DNA, 1000 bp, mus musculus
tattcaagagagtaggagggcttcctaggcccatccggttattatggtggtctgctatggaaattgtgagggagatgctcagtgttgggggccaagttgggatagggactcctcagcaaccgagtgcctctcatttgctctcagtgtccttgctgaggtgggtggtccatggtttcttattccttagaggccatataggccatgaggtccaccaccctgctgctgtagctgtattctttgtcataccaggaaatgaactttacaaagttgctattgagagcaacgccagcctgaatatcaatggtggaagagagagagctgttgttgaagtcgcaggagacaacctggtactcagtgtagcccaggatgcccttaagtgggatctcgggcacctgtttcaccaccttcttgatgtcgtcatacttggcaggtttctccaggtggcaagttagattcacaatgtatacattgggagtaggaacatgaaaggccatgcctgttatcttcccattcaactctgggatgaccttgcccacagccttggcagcaccagtggatgcaggtataacattctgggcagcccacagccatcacgccacagcttttccgaggggtcatcaaaagtcttctgagtgacagcgattccacgggccatggtcatgagccctttccaaagccaaagttgtcatgccaaagatgaccttggccaggaggactatgcagttggtggtgcaggatgcattgctgacaatcttgagagagttggtatatttatcgtggttcacaaccatcacaaacatgggggtatcagcagaaggggaggagatgatgcctcttttggctccacccttcaagtgggtcccagccttctccatggtggtgaagacaccagtatactccacaacatactgtgagcaccagcatcaatcatcccacttgatgttagtgggctctcactcctggaagatggtgatgggcttcccattgatgacaagcttcc

SEQ ID NO: 1109 - DNA, 1000 bp, mus musculus
caccactgggtatctccccaccctcgcacttcaagtctctgctacagtaggtgcatcctctgccactgaggccagacaaggcagcccaaatagtagaacatacccaacgtaaaggtaacagcttttgagatagctcccactccagatcttcaggacccacaagaaggtcaagctgcacatctgcaatatgtgagctgggaagcctacaaccaacctgtgtatgttccttggttggtggttcatactctgagagtcccaaggtccaggttacttgacactgttggtcttcttgtgaagttcctatctccttcagggctgcaatatttcctcctattcttctgtaagagtccccaagctcaatccaccgcttgaatgtgggtgtctgtatttgcccgaattagctgctgggtggagcctctcagaggacagtatgttcctgtctgcaagcataacagagtatcattaatagtgttagggaaaaatgcttgcccacggaataggtctcaagttgggctggttattgtttggtcattccctccgtctctgctccattccccatgcctgtattacttgtagacaggatatatttaaggttgaaagttttgtgggtaggttgatgtccctatagctccactggagttcctttctgaatgcagaagatagcttcataggttccacatccccaatgtagtgagtcacagctaaggtcacccccattgattcttgggtgtgcctctcttgccccaggccatgtctcatgctagagaatcctccgtctcctcactcctgtcagttgcaggttccctttcgtttccatggccatctagccatgtctcctgtcttttcccataactgatcctgaataccccattctcctcctcaaactcctccctctcagttccctcctccatctgcttcttatgactattttattccctcttttaaatgagattcatttgggccttccttcttgtttagcttctttgggtctgtggagtgc

SEQ ID NO: 1110 - DNA, 1000 bp, mus musculus
ttccctatgtaccgcagtctcgagttccgcgcgattggattggggcaggcactgtgatccactcaccagaggtcttagggtcccgtggggagtcctgtgtggacccttgcgggtgttgggcaagactctgctggcaaggtagcccggggctcctaggcttaaattcttgtattcggttttcctctttacagaaagggatcgcatatatttatttagctgtataatggcgtgagaggcctcatccctcaccacctttggcatttgggtgagctgagagcctgcccctgctcctcactggctgcagctctctggagagcaggccctgcaccgcatttgatcagtactctagagatgacccttctggaaggggtgcagatgagccattccccatggcatggacacaaaagatgtgatcctgccatttgtctgcagtgaggtattcattcagtcatgtacttcctacctcatccttttccacctgtgtcattcaagagagtgagagagcagtctctgaacctcgtctgggcaggacagtagagttggtcctggaggagggggcaaagggtagctagccccgtgggagtggacataggagagatggcccagccccttgctggctgtaggagttcagagagtgggctctaagctttgactgggcagcttcgtgaagctggcgctggaggtgcaaaagtgggagagggagccctcggggcaagagagcagacgaggtgaccttatcttccaccaatggctgcactgagtggtctagctgaagcaacaccagagagctggccctggtgatactaataagggagatccggtgggatgactggtgctcagcttgcacccactctgagatccaggacttggagttgacccaccctcaaaccttcatcatctgcaaactgttggagcatgtgaaagggccagtcccgctgacgcaaagctgcaggatcgccatgaaacagggaagcagaataacagggaggaggtcctgtga

SEQ ID NO: 1111 - DNA, 1000 bp, mus musculus
caccgttattcccggccctgggcaggaagattaccatgatcttaggcgtgcttcagtgacatagaaagctccaggttggcctgggagatagagtgagaacttgtctcaggaaaacaaaaacaaaaaattataaaaaatttaatcttaagaatgtgtgaagcctggccatcttgagtctgaaagtcttcaaatctcaagttctaaactccaaaatgttgagaaccatctatcagctgctgcagtcatatttgtcaactcatagatttttctttgccttatttcatatagtcttcttcaagaaaagtaaagggaaaaggaaatagaaaggatcttgaactggttgttcaaggttcaggttttctgtagaaaccctgggtcacaccaattacctgtccagctgaagccaaggtgatcagcgatgtaagccagcctttcttccatccgctcctgctcatcttggggatctacagaaggtcaaaaacagaatggccaaagagtgtctgggacaagaggggaaccatagtactgatcatccaagaaaggaattcactcgatctaatatctaatagttgcacaaattagctatcgtggcttaggtcctatgaactggtatgttttctgatttctgggataaaatggggaatgaatcccatgtggtgatttgcggaaaccatctgcttccatatccctttaatgaagacttgtaactgaacagaatgtctagttatctcaggactttctttttatgcttttgaagaaggagaacaaaacaaccgtccactcactgaatacatgaaaccccagagaaatcagagatgggctacggaggtggagaaactgaactgtgctactcatgccctgtggacctgtcagtcaccaccacgtccgatctgaaagaaagcacaagggattatctgaagcctggacttaaactgaggccaggaagatcaatgtcctattgacctttggaagaaggcaggacaaaggcatatgagctttt

SEQ ID NO: 1112 - DNA, 1000 bp, mus musculus; identical to SEQ ID NO: 1111

SEQ ID NO: 1113 - DNA, 1000 bp, mus musculus
aagaggtataagaaaccagcataaaatatgaaaaacattatagtaattaatacacatctgtcaatgataattcaatattaattagaaaaaaaacagcatccatcttcttactgcctacaagaaaaacatcatccacaataaatattcactttgtggtaaaaggataggaaaaggttagaataaagcaaatgaaagtaagaaactaacaagtgtagttgtcctaatatccgacttaaaaactaaaatattcagaagagatatggaagaatatttcacacctattaatagagaaatataccaagatgatatcacaactctaaatagttatgtgctaaacacagtccctcataactcgatagaagacatacactagaactaaagccatatagttatacccacacagtgattgtgagtgactttaaaatcatactctcatcaaggggtcatcaagacaaaaactaaatagacacactggaattaaatgacgttataagtcaaatagacccaacagagatctacagaatattctacccaaatgtcacagaatagatattcttataagaaaccaatagaagctgaggaggaaggtgatgctgtagaaggaccagcagtctcgactaacctggatccccaagatctcagacactgggccaccaaccaggcagcatataccagcttatataaggctcccaacatatatacagcagaggactgctgggtctggactcagtcagagatgatgcacctaatcctcaagagactggaggccctagggagtagggaggtttggtgggttggggattcagggggattgggacatcctcgtggagacatgaggagggggcatgggatttggaacagtcagaaggtgggccaggagggggataaaatctgtattgtaaaaaaaattaaataaaaattttaaaaaaagaaaccaatagaacattccctaaaatctatcaaacattaggacacagatcatgtctcaagatatagaagg

SEQ ID NO: 1114 - DNA, 1200 bp, mus musculus
ccttccctgaccaagtgctgcaaccagcacgacagatgctacgagacctgcgggaaaagcaagaacgactgtgacgaggagttccagtactgcctctccaagatctgcagagacgtgcagaagacgctcggactatctcagaacgtccagggtaagggtggcctgctggctgggctcggatggcttctaatagtgcagcgaacacatcaggagagaaggtgtgcttctcacaggcattcactggcatgatccagctgtgccgcttgcctgcagggaggagcgggctgaccatctttgtaatctaaaattatacacggccacaaaagcaaagtgttccgaaggagaatctgaggcagagaagggaagaattcatctcccttagatatgtagagctactcgttcagaaactaaatgccgaagcctggaagcaagctgtcatagtccgcttgggatgctgtagtaaagtgtaacaagctgaggttggttatagacgacaaatacttcaggaggtaggggttacatgctgaaggcagaaatagccatcatctggcaagtttctctgcttggtttatagaccacaccttcgagctgtatcatgagacatggggaaaggactaggcaggtctctgggattccgttttgtctgcacttctgttgtgttgcagtactgaggattacagaagtgtcttgagtgttagacaagcccttcactgttgagctatgtctggaagttataccgtttttaatgtgacttatcccgttcatgagggcactgccccggtgacccagttatttcccagagtccttcctaccctaatttctttaccttggaggttaagacttcaacagataattcttagaggaacatagatattcgtatagacagacagttgtagcaccagtgacttttagcgtgtagtgcagctgctacgttgatggctcatgtgcctctaaccccagatcaggaggctgcacgttgcttggcttttcctggggatgtgtaaagaagtgatgttcatactagattgagcaccagtaacagcccaaagaaacaatcacatcaaagtccagcaccagtgaggtcatcgaggagcctacaggagctcaagcaacgcagaatcagctacatcacctcaggttccactctggcatgggtgacaaggacttgaggaggttgcttcattagagccctgccttagt

SEQ ID NO: 1115 - DNA, 1200 bp, mus musculus; identical to SEQ ID NO: 1114

SEQ ID NO: 1116 - DNA, 1000 bp, mus musculus
tttctctggcctatcaaacactaaaacacataactatttgttggcttactgagggaagaggcgattttgcttccctttattaatgagtcaaaggctgaccattcttggctagttatcacctgtcaaccaaagccatttgtcctgagaaggttgtagaaataaactgtttgtctgtattgtgctcatcacctgaaacatgtgtgaccagaggttgagatgagtagggtaggttattttccattccagcatttcttgattgtctagaagatctcatttactagactctagtgactggacttaaactatatgcatatttgtaatgtggtggtatcttttccttttatctgaaatatactctggatagccttgctatggtgctaacataggtaataaaaattttatcaaggacaatattgagattagtgtaaaatgaaagcacattatttttgttcccctagccaacgaaaccaaggtttggagatgttacttcaagctccctagactggttgtgggtgggtccagactcctataggcctggggtcaccctgacacttcctcattgctgaggtggccccagtttctgctttctgagcttcctaagtctcatggctgttagttcactgacttggtaatgggttttgctctttctcagacccgtgcctcacatcaccaaacactcatggaattcttcaggatgggaccaacatttgtgtttgctcatagtaaccattgttttctctccactttgagatgctttccctttcctggtagagggttgtatcgctttcccatatggcatctgcaggggaggtcctctctggactctatggaactgaattccagccaaggtatatgtgttagtcatgttcctctgaaagccacagggcatgggctggggtgtagagtggtgggaaacagggatacgggcctaatgttcaatggggaagacacacaagaaagtcagtgtttacaatagcaagcctggaagcaagccaaatgc

SEQ ID NO: 1117 - DNA, 1600 bp, mus musculus
gagtataattgtggcttctggggcagaccttgtttcatggccccagacacctgggcaccttccctgccagaggagaggtgtccgccctgaccaggaggactttgcaaaagcatctgggggagccatattcggttcccagattccaccaagactggtctgcgcaggtgagagtgtggactgcagaggctaacagcttctgggacaggcagaagccacagaggtaatggggcagaccacattttgggcttcagacatcctggcaccttccctgccagaggagaggtgtctgccccgcccaagaaggatttgccacagcatctgggggagacatcttggttcccggatcaagccaagacaactctgcacaggtgaaagtgtggactatagaagctacacagattctgggacaagccttgtttcaggccttcatcttctgctaggaggcaggtctgaataccagatatctgtccatcttcactgcaagaggagagcttgcctacagagagtgctctaaccactgaaactcaggaaagagctagtcttccaggtctgctcatagagactaacagaatcatgagaggaacaagttctaaccagagacaactataaaaactaactctagagattgccagatggcaaaaggcaaaggtaagaatcttactaacagaaacccagaccactcaccatcatcagaacccagcactcccacttcagccagacctgggtaccccaacacaccagaaaagctagacccggatttaaaaacatatctcatgatgatggtggagaacattaagaaggacttttgttgggagccgccctcacattcgccgttacaagatggcgctgacatcctgtgttctaagtggtaaacaaataatctgcgcatgtgccaagggtagttctccaccccatgtgctctgcctttcaactcggccgatgggctgcagccaatcagggagtgacacgtcctaggcggaggataattctccttaaaagggacggggtttagccatttttctctcttgctctggctcttgcttcttgctcctgaagatgtaagcaataaagctcttgcgctcttgcgctcttgccctcgctcttgctctcttgcgctctggctcctaaagatgtaagcaatagagctcttgcactcttgcactcttgcactcttgctctcttgctctcttgctctcttgcgctctggctcctaaagatgtaagcaatagagctcttgggctcttgcgctctggctcctaaagatgtaagcaatagagctcttgcactcttgcactcttgcactcttgctctcttgctctcttgctctcttgcgctctggctcctaaagatgtaagcaatagagctcttgggctcttgcgctctggctcctaaagatgtaagcaatagagctcttgcactcttgcactcttgctcctgaagatgtaagcaataaagttttgctgcagaagattccggtttgctgtgttcttcctggccggtcgcgaacgcgtgtaagagactttaataactcacttaaagaaatacagaagaacactgctaaagagttgcaagtccttaaaagaaacaaacaaacaaacaa

SEQ ID NO: 1118 - DNA, 1200 bp, mus musculus
tgtttcctctttaagatattctacctgtttacctgtgttctcttgtatttctttaagggagttatttatggccttctaaaattcctctatcatcatcatgagatgtgatttttaaatcagagtcttgttttctggtgtgttggggctagccagggttcactgtggtggaaaaactgggttctgatggtgccaagtagtcttggtttctgttgcttatgttcttgtgcttgccttttgccacctggttatcttgaatgttagctggtcgtgctgactctgacttggacttgtccttcctgtaaacctgtgtgtctgtactcctgggagaccagatctctccatgaggaatttgggtatggtgagctatggtacagggtaagcttttgggtgcagagcccagaaggatcttgtccccagctgatccttggtacctgtgtcctgatggctctgtgagagtccctcttgggtcaggaatttgaagagaagttatggtcttacctgtgttctcaggtatgtaggcattcctgggaggctccctccctccctggagccctgtggcagaggattttctacaggtagagatggaaacaggaaggctcctgtccctgtccttgacacccctaggttcctaagggttccatgcaggttcctctgagcagcagtggtgtttctacctgcattcacaggcctgtccacactcctgggaggtttgctccctcctggcgctatttgggtatggaaccctgtgacaaaggatctgctacagcagttttgggttttcaagccagctttggttaccagtgttataaggtctttaaacacccaatctaaaacaaatcaaaaacacaggataaacaacattctgaaatgaatcattttgagaagatacccagaattctgataagccagttataggctaatcaactgtatgtgtaataaatacagtagtaggcatacacgatcttcagaaattcccaatgtacttatttttttcaggatattactaaacattgtcttgacctaggaatgagagcaaactaatgaggaaacaaatctgaagtccagaaaagatggaattgttaatacaggagcagtaagaagagaataaaaataaaatgaacacttttacacatctaaataaaactcaagaaacagctgtatttaggtagatgaaagaaaatcccaaaaactatggttaag

SEQ ID NO: 1119 - DNA, 1200 bp, mus musculus
tgaaactctgatctagagatttctgtcactcttcaagtgctggaattacaatggtgaccaccactacagcttcaaagcaaacttatggctacagagacgtcctaatgaatgtgtgtaaagtgctatcacatgaaactggtcattctacccaaacagggacaacacacaacaagataagataggtcttttggatttcttaaattattttttaaataactgaacaaaaaaacctgaggtcattacattctagatgtgtaaatttacaaatctttctcaggagaattcttcatgattattttggtgggatggaagattcttcataaatgggaaaggaaaatccagccgcactagtagcaatccatgtagcctgatgtaaaggagaagcttctggaaatggcagagtcatgtaagtctcacctgtcagtcaactttggcaggagtttcatgggacaagcaaaggcgagtgcctccaggactgagggaagatagcagaaatgaaataaattccttggttcttatatatttccccaaatgatcacatgacccaggtcagaggattagagaaccccttgaaggcgcatagacctagtaaaatgttacttacctctgtgagctgatgagttatagggacatttgaaattccttggagaccactaagcctccactaacaacacagaaactggtctccaaagcctaagaagagaggaagggcctacaggagagaagaagaaaaaggttgaaaagtgggggctggggcaggtcggtcagcaacagcagaggaagaggccagcctggtgcacaaagctagtttccctagtgcaacaaaagcttgtggcagggctgtgaggcagtgaatgatctcaagcaagtttgagaactcacagccaactgccaattgtagagtctgtaaggagaattctaaagctgtcttccaagtgctgagactcacaggcctactagcaacttatttgtgatgccgctctcaaaatacctgatgcatgaggtgatgatgattctcactgaagccatggtgatgtgcatcccagtgtagaaaacagctcagactgactcagaccttcttaggaatctgtcagtaggacagccataccctttcctggggatattttctccagactgtactgtcttagacatctaccgtaacaaactgaaacatctaaagaagcagggatatttgactct

SEQ ID NO: 1120 - DNA, 1000 bp, mus musculus
acaaagtaaaatgaaacaaaaggtcccccaaataccactatgttttattttatgttgaccaactactcctgggagtgtgattgatatacttagtgattctccacgggagaaaattgatttttctcattgccagcagatgttaattgcataaggattgctaattagggtgagaccccatgtctgctttcccctctcagtgctgaaatcctgactggcttgaacctgtgcttgtgtgtgctgtcttgtgtgtgctgctacagtctctgcctgcatgggtcttagggcaagagtaacaaacctgagatccttctatggcataggaagcaggattcagggcagactaagcttcacaactcccagttttttttttttttttttttaaataggatctcaagtcctttccaagttttcagtgccagatttctaattgagtgtgtgctctaacacaggtatgggataaaatgtgtcatttgattttcagaattcttggtcatatactgaaagaagctgtcttagttagggttttactgctgtgaacagacaccatgaccaaggcaactcttacaagggcaacatttaattggggctggcttacaggttcagaggttcagtctattatcatcaaggcaggaacatggcagcatctaggcaggcatggtgcaggaggagctgagagttttacatcttcacctgaaggctgctagttgaatccacacagctatggtcacttgatctttgacaagcgagctaaaaccatccagtggaaaaaagacagcattttcaacaaatggtgctggcacaactggcggttatcatgtagaagaatgcgaattgatccatttctatctccttgtactaaggtcaaatctaagtggattaaggaactccacataaaaccagtgacactgaaacttatagaggagaaagtagggaaaaacctcgaagatatgggtacaggggaaaaattcctgaatagaacagcaatggcttgtgctgtaag

SEQ ID NO: 1121 - DNA, 1400 bp, mus musculus
tctgtatttccaattatagtctcctcaatctgtatgtagactaaaaagccagaaaccatatttctctatcataaatattttatttatatgaacacaggaatttactccatttcctttctgatgtctttttaacacttttttgtattcttattttatttcagcagatatcagaaagattttcctctacagctttgcttaaatattagatcctccaatgactctagctccttctatgtccccagctttcccttgtggcattcccaagttcataactttgtcaaattattcatatgcctcccaacctctctttagtttatatttaaaaatcatatggagaatacttcattcccctttagttctcaagagtaattctgatattatttctgtctggttattttattatcctccaaaatgatgtgtcagtcttctataaacctctgagatgggattcctaaagccctctgctttaatccagcattaattagggaagcagaaaaacctggcctgaccagggtcacaagtcccttctggtcagcaccagcaccaggtcaccatgggcgctgagtcagcaaacacccccaaggtccctagaggactctccacgacatcttaggacctctggttagtggaacacaacctctgccaggaggcaggtcagaatgccagatatctgagcaccttccctgcaagaggagagcagaagagcttgcctgcagagagtactctgtccactaaaactcaggagagagctattctcccaggtctgctgatagaggctaacagaatcataagaggaacaagctctaaccagagacaactataacaactaactccagagaataccagatggcgaaagacaaatgtaagaatcttgctaacagagaccaagaccactcaccattatcagaacgcagcaatccctcctcacccagtcctgggcaccccaacacacccgaaaagctagacccagatttgaaagcatacctcatgataatggtagaggacatcaagaaggactttaataactcacttaaagaaatacagaacactgctaaagagttacaagtccttaaaggaaaacacaaccaaacaggtgatggaaatgaacaaaaccatactagacctaaaaagagaagtagacacaataaagaaaacccaaactgaggcaacgctggagatagaaacactagaaaagaaatctggaaacatagatgtgagcatcagcaacagaatacaagagatggaagagagaatctcaggtgcaaaagattccatagagaacataagcacaacaatcaaagaaaatggaaaatgcaaaatgaaaaagatcctgattcaaaatgtccaggaaatccagtacacaatgagaagatcaaacctatgaataataggagtagatg

SEQ ID NO: 1122 - DNA, 1200 bp, mus musculus
gtcctcattggtgagtctagggcagtgagctgctcccatttcctcacagtgagaggaccatgcagaaggcgaaagccttgcttgggattggaggtactgggagaaaacagatgggaaacaatatgcaatcccagtcctcactgtgcctcgaagcttagtcggccatcactgggaagagaggccccttggtcttgcaaactttatatgctgcaatacaggggaaggccaggaccaagaagtgggagcgggtgggtaggggagcaggtcggggtgtgtgtgtggtaataggggactttcaggatagcatttgaaatgtaaatgaagaaaatatctaataaaaaattggaaaaaatacacataaactaggaaaaaataagaaaagaaatggagagagggttaccccgaaaacgtcacagcacagccatgttcccaggaagctatcctactttcttccaggtgaaacctgaatagcctgtagacagcctattttcctgacaactatgggtgtgtatgctttgtgggaaaaccttgtagaagattcatgggtcaaccacagaactgttacaataatccagaacatattttcaaactctatttacatcatgactaacaaagcaataatgatttcagaaacatgcactgcaaaacattttcttcttgtatgctaatgttaaaatatatgattcagccatcagaatccattggtacagtacatgtcttcatccatgcactgatccattgatggatttatgcattgatccactgatggattcagaacttgaatagaactgggaactggaagaactatggacggtaggctattggaagaaacaggtccctgggggattatccttaaaagacaagttttctccagtctattgtggcttctccctgcttcttggctgccagaacaggagcttctctggtccctaacagagtcttttgcatggtgtccagctttgctgcagatccactgctgtgaaaccagccaaccagcattaaactctgagacaaaatatgtcctttctttactttaagtccactttccagggtgtttgtcaaagtggcagtacaagtacttaagatggagggaacggattcaaacactacaatggcccatctataagaaaaactaaaacagaaacagaacaggccaacaaagaatagaaaaataaacccaacattttatgtgggcatttt

SEQ ID NO: 1123 - DNA, 1200 bp, mus musculus
ggcagtctttcagaagcatgtatattagcgtttgaaagtcaccaactattttttctattcgtgaaaatacaaaatttgaaatcaatttatcttgcctctatgtgctatgtaaaaagttacctgttttgtggaaaattgatcacatggatttgccataaattgaaagcacagtaagccagactgatgaggccctattagttccatgaagcagacgagtacacttgtacgtccaacaatgctgcatagccggacatgtgacgaattggtatcttgcaacctagtggagaaaatccctgcagtgtatgggttccatgactgggtcatgcatcctaggtcagttgtcatttatgctccttgcactttttccccatttatatcctaatgcaaaaatgatttttcttctgaaaaagtagactatggctttatttgcctagcaatgcacaattttgtttctagagctgatttttatagttgcgaataactaatggttaaaaccaagagatatgcatgatctcatgaactccccttgctccaaagtttgctccatctgggcccccagcccaatgagctgtgcctcctatattcagggcaggtcttttctcctttaggccatcaatctgcatgccaatctctgtaaatgcccacacaaacacaactaaaatgtgctttgcaatattccatgtgtttgtatagtcaagttggctactaggatttcccaccataggaagagaatggagaagccacaactgttcagcggagcaaatgaaatagatagttatagctaaccatactgtaatgtggaaaaatgcaagtcagaaaggtaagttaagggtgcaggttcaagcactgcgcagagtgggtaccctgggcccatttcatcatgtctacccagatgggaaatgagcctcactagggaaccaggtggaagtcttgccattctgggccagggattctcatccttagcactattgacagtttaagggagatgataactgctggtgatggcttgtatatagttagatgctaaactgtgcttggggcgactagctactgaataccaacagtagatttctcttccaggttgaattatcttatgcttttagctgtcaagcattcactgggaaacaaaatatctcctggataatgactgctatataccaaccaagaagtgttaaatatgtaaacagtggctcagaagct

SEQ ID NO: 1124 - DNA, 1200 bp, mus musculus
tgggccaactaggccttgaaagagctagttcttaaaaaactctacatgaatacaacagttagaaaactcagccttacggtccttcatcatattaatggctggggaagacaaattaccactcatattgcgtgactcagaaaatggattttatgaaattcataataagtgataaaacttgtctatgactcataatgaaaatgccacatgtaatttttaaaaacatataaaattgtgaaaaagaaagatatgctccttaaaatgatgatggcagggaattttgcctttaccatcatgctgtaacaagctggattgcccaactcaaaaacctaagagaaagaatcaaagaacttatacattttaaatcaaaagttcctgtctccttctgcccagtcgttgctgctggggcagactcctagttggtctgctcctgtgaagacaccaaatccagatccatcctagaagaaccactgccctcagagcagttggtaagaacccactctgcacccctgtcctaaactgctgctcggagcctggaggactcaggaaccataacccaacaaaaaccccaccctcccaaataccactccccttctgtcccttccaccctttctgcctggtcctcgttgctggggcagattcctagttggtctgttcccataaagacaccatattctgatccggcctagaagacccactgcactcagagcagttggacaacagcttgactgctccactgaagacccaacagtctgaagatctccaggagatctactgcagccaggacaacagatcagcagcttctctgcccctgtgaagagccctgagttgaaaggccccagaggcagtctgacacatctagggccgcaggcctaccaggagacctgaagcaacccagggacaaaaatggcagactctagacagtcacccagaccaacaaacaacagggatatccagatggcaaaaggcaagcacaagacccttagcaacagaaaccaaagtacatgggaatcatcagaatccagttctcctaccacaggaagccctgaatatagcaacacacctgaaaatcatgaatctgtcctaaaatcctgtctcaggaaggtaatagagtcctttaaggaagatatcaataactcgctggaaaaaatacagaaaaacacaggtaaacaggtggaggaattgaataaagcaatccacaac

SEQ ID NO: 1125 - DNA, 1400 bp, mus musculus
gactttgaaaaataaaaagatgtataaattgtgtgaagtatttataaagtcagaactgtttatgaacctagtgagggcattctgtcatgtagtaccttctcataaagaatttaaaaatcagacagagattcaagccaggcccacataaaaatcagggaaccttagtgtaacatcagctatgacatgggatgtcagtgaagaaagcaatgatttcattgaaggtatgtgggcatttatctgtctgtctgctgtctgtctgtctatctatctctctctctctctctctctctatctatctatctatctatctatctatctatctatctatctatctatccatctatctatttatctatttgcttccactgctttcaagcaatcctgcttttggaataagaaagaaggactctgtgagcttctggagagctatgagtcttgtccttactgttgttacttagtgttactttttcatccaaagactgaggtgaccaggactggacagcattagctccaaacgtgcatgaaactcagtgttccatcaggtttccatagctgtgtgctgcaccgtcccaagcagctcttaccatatcttgaggttgatcaagaaagcctttgttaactgccagattggtacgttgacctaaggaaatgagcctttagctcctggaaatccattgtgccaaccacaacattcctaaatgcatatggaaggagagatcattgtcttggtctacctcgtcatcccacggatctgctgagtcttggcattccactcaggctgaggttggtgaagtgagagggactcgggggaccacttgaaagtctttcccagcttaattaggtcataaagattttccaggaaactgaacttcatgagagccagaagtgcctcagtattgctgacctgacacatttcaaaaatagatgcacagggctccatttccaaaagtctaccccttccacccgatcaccaccatcaaattggccgtgacttcagctcttcttctgtcctctgaggcacttgcagtggactgctgctcaagctcttgcctggtcaaacctacacacaggagacagatgggttattttaaattattttttttttaatttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctcct

SEQ ID NO: 1126 - DNA, 1000 bp, mus musculus
ttattttaaaaagcataattttactgcaggtatcagataaaacagtactctctttttttattagatattttctttatttacattttaaatgttatcccctttcctggttatccctccgaaaacccctatcctatcctcacttcccctgctcaacaacccacctactcctgcttcactgtcctggcattcccctacactagggcatcgagccttctcagaaccaatgacctctgctcccattgatgtccagcaaagccatcctctgctacatatgcagctggagccatgggtcactccatgtgtactccttggttggtggtttagtccctgggagctctaggggtactgattagttcatattgttcctcctcaaaccccttcagttccttctgtcctttctctagctgcttcattggtgagcttgtgcttagttggctgaaagcatcacctctataaccccactctcaatcacaaagttccaaatatataaagcaggatatcatctttcctataaaattaaaaataataaatttttcctcttaagccaatctcttgtaataacacagttaattgctaatatatttcatgtcttcttcattgcttcccacaattaattcagtttccaaaatgtataaaactagtctcatattgaaaattcccaaacaatggagttaattttgcacttgtattgtgctcaacactaagcaaaacttgactattaggaaacaggcaaaatcagttccctttaatgttgctctagtactggtttgactacttcaagcatgctccatactaaattttcttattcctactcctatacagataaaactgatttctccttgtctcttgcatatgctacatacaccaagacctgagatttcaaatgacatggacttgaaaaccataggtgttaacaataaaagtgataatatcttgaggttacaattctcctgtaaattaaaatacaaaccaaaaggacattgagatagccctttacctc

SEQ ID NO: 1127 - DNA, 1200 bp, mus musculus
ttggggggggggctctattccagcgagagacagagataagcaagaatgctaatgagaagctaaactgtaaagtttatgagacagaatgattgcagagttgggagctggggagtggccaggttggcagtattgctacactggacatgtgcagtctggacacagtgaccacaagactgtgacattacactgtgcagtctggatgtcagcagcatggcattacactgggcaggacatagtggatacgagactgtggcattacactgggaagtctagacacagtgggcatgagtctgtggcgttacactggacagtctggacacagtgggcacgagactgcagagttacactggacagtctggatacagtgggcactagactatgactttacactacgcagtctggatgtcagcagcatggcgttacactgggcaggacatagtaaacacgagactgtggcattataatgggcgacctgaacatagtggacacaagactgtggcgttacactgggcagtctgaacatagtggtcataagactggtgttacactggacagtctggatgcagtgggcactagactatgacgttacactgcgcagtctggatgtcagcagcatggcgttacactgggcaggatatagtagacgagactgtggcgttacactgggcggcctgaacatagtggtcataagactggcgttacactggacagtctagacgcagtgggcacaagtctgtggcattaccctgggcagcacatagttgacacgagactgtggcattacactggacagtctatagcacttaccttgagcttgcagccttcattctgacacagcttcctgaccagggctccaatgatgatcataaccgactctctgatgtcgttgcttgcaaaggaacctttgaacttactctgtagccaaacaggggtcaaataggtcatcaggacacttcagctttccaaagggacacttcccagctaataaagtaaccatcatctggggaaatgactttgtgtttctagacaacaaactcagaattttgtttttgagacacttagaaatgtgttgtctagttttgcatgaaggattgctagactgcctggccccaaatgatcttagcccctccttccaccactcccccccccccagtctgtgaaccattcagggttcggggatttgattgttcagttgttcta

SEQ ID NO: 1128 - DNA, 1200 bp, mus musculus; identical to SEQ ID NO: 1127

SEQ ID NO: 1129 - DNA, 1000 bp, mus musculus
gtgaacaatcacagttttaaacttacttctcagccttacctcccaggatggcacctggcgctaccctgtaagacactgagtgtgacaactgtggctcctctgcacagctgtaccaccaagcggagtcactccctgccgcacagtgttctcttctgtactcaggcctgaggcgactgtcggtcatttatctttagatgaggcatctgcctggtccagagccagggattagccatgtgctgcccattcctttgctgtgcgttctgctgtttttccctacttaggctttcatcttacatcctttgtgctagcccttgttcccagcctctccctgttccgaaaagcatcaccttccatcgtttgccatttgacttttctcattcattgctttgtttggaggaggaagcttgtaatctgatgccttaccctggagacttcaagctgtgcatttttagtgtgcttttccatatagcatttgtatttattctctgagaatttcacacacacacacaatacattttgatcatagccggctgtcttttccttcctttcagctcttcctggattccaagtctcccaccccccccaccccccacccccacccccgcataataattttttaattgggtacttcccaactttcagcttttgacatttttttagctagtcgattctggggagagatggattggtaacattaagaccttatttaacatcacctggcagattaacatgagaatagtttacttttcagactaatatgttatgaagtcttgcaaaacccttaaggagtttatcaactgagaaacttttcctttgtgccagccccacccgtgttggctctctgctgccttggagccagctccacccttgttagttcttttgcctctgttctgaggaaaacaagcttttgttgctgagtctgggcttggtctttgatggttgagattcagaatgtctgtctgtccgtacctgcctatctcttgtccgcggtgcctacaac

SEQ ID NO: 1130 - DNA, 1000 bp, mus musculus
gtggtgctgggttggacattttttggggggatcctgataggtgtggctactggggggctcttggtcaaatatgtttctaggtattgagtggtgacatataggaacagagacgggctatgtggatcgggccgaaggaatccacaggaggaaggaaagcaggatgttccatcagaatccgcttagtttcctgggaaaggggacagagagagaagaaggatgacagcagaaagtctgctacagagctggggattcgaatggggaattggattttgaggactggaggaggaaaaggtgaagatctgcagctatgctacctgctttcctggtagagtagcctgtggaccccgagaaatgccagctgggtctgtgagctggaataaagcaatgtgtgaggcagggaatcgggaggggaagatctatgtgaccccttggtgatgggagtagcagggatgtggatggaaaggccacggtagtgggtagtggtgtgttacagtggtgggaacgagcctgggggatcagatttggaggagataaggaagaggtgaggagctacactagtctacctgtttcccttagcaacgtgtttccagggagtgcaggaagttaggagggttcgatctgtgcgatccacagatggtggggagtggagaaggtggcagcagctagcagtctgctgcagagctggggatcatttggaggaggtgaagatctgcccctgcctgtttgctataggcttccctggctctggtggcgtgcgtgctgggcctgggggcagggagagtaaggacagatgtttgagggaagatttgtatgatctgctgcagatgggggtggcggagaagggagaccacagcaaggtcatccagtgcagtcttgggactgaggctggggccctggacttgggggagctgagggagaggagatctccctcttgtatctacagttggcctatctgcttcccacactgatatttttcttaagagatccctatcaaatattc

SEQ ID NO: 1131 - DNA, 1200 bp, mus musculus
aggaaaatacctaattaaaaaaaatagaagggtggatcattaaaaaaaatgagatgtttttgtctcccaggtccctctgagaccagtctgcacagatcaggtcatggactgtggagggtgagcaaacagactgcagaagcaacatagctcctgggataggccctgttttgggctgcagacatccaggcaccttccccatcagaggagaagcggccacccgggagggctctgacccccagagcaggtgagggagccatcttttctctcaggtccctctgagaccaatctgcacaggtcagctcatggacagggactgcagagggtgagtgagctgactgcagaagcaatacagcttctgggacagacccctgttttaagctgcagacatccaggcaccttccctgcaagagaagaggtgaccacctgggagggctcagacctccagagcaggtgagggaaccctcatgtgtcttgggtcccttggagaccagtctatgcaggtgagagcatagactgcagaggcaacccatcttctgagacaggccctgtttcaggccttcatattcagccaggaggtagatctgaacaccagacctctgtgtaccttccctgaaagaggagagcttgcctgaagagagtactctgaccactgacattcagaagagagctggacacccaggacagctgacagaagctaacagaatcacaggaggaacaggctccagccagagacaactataacaactaacactagagattaccagatggtgaaaggcaaatgtaagaatcttaaacagaaacaaagactgctcaccatcatcagaaccaagtattcccacctcagccagtcctggatacctcaacacacccgaaaagcaagatttggattcaaaattatacctcatgatgctggtagaggaccttaagaagggcattaataactcacttaaagaaatacaggagaacactgctaaacaggtagaagtccttaaagaggaaacacaaaaatctcttaaagaattacaggaaaacacaaccaaacaggtgatggaattgaacaaaaacacccaagacctaaaaagggaagtagaaacaataaagaaaacccaaagtgagacaactctggagatagaaaccctaggaaagaaatcaggaacagcaacagaatacaagagatggaagagagaatctcaggtgtag

SEQ ID NO: 1132 - DNA, 1000 bp, mus musculus
aaggagctaaagggatctgcaaccctataggtggaacaacattatgaactaaccagtaccccggagctcttgactctagctgcatatatatcaaaagatgacctagtcggccatcactggaaagagaggcccattggacttgcaaactttatatgccccagtacaggggaacaccagggccaaaaagggggagtgggtgggcaggggagtgggggtgggtggatatgggggacttttggtatagcattggaaatgtaaatgagttaaatacctaataaaaaatggaaaaaaaaataaacatccaaaaaaaaaaaaaaacaagaaagtgttaggcgtatttttcaaaacaactaagagcaagatgttagtcacagtgtaggtattttttctgatgacaacaattttatagtaattagtttaataatagtccaggtggagacagtcaacaaaacgcctcctaatgcatcgttgctttatggtatacattttaaaatcatatttttttgctgttatgtatgtaacagacacctaagttttaaagaaacatagaatggtagaagcagataaagtctcgacagtgagaaagcagcgtgagaaacgtgcataagagaatatgatatgtgagtgataggaactggaagaacaagttcgtcactgcaccttcctgtgtctggatagcaccctgccattctgctttaatcctgtgcggccttctcaaaggaagctgggaggtgatgaaggtcaggaaagtggcttaatcacagagcctacttacctcaggagtccctgtgtgcattcaactccacgttttaaacattgtccagttctaggcctctttactttcttttggctgtaaccagtcctgatgtttcccttcttgtgcctttatttcctccaagaaacaaagttataatagttgctgtattcccaattatcacatggctagcttaacctgaaacccaatgtcaacaacttaacaatgaatttaagtcacaaataa

SEQ ID NO: 1133 - DNA, 1200 bp, mus musculus
ccagcactagactattataaaaacaaaacaggcaacacttcacactaaaagactcaggagggacattgtttctaagaattttgtgtggtattatcacttgccatgtttgctttgttcctgatatcctgcattagctaggacttttatctgtgataaaaaggctgttgctttgcttcttacctcatctctctcaaatctgtccctccctcaatgtctttcttatgccagtgataaaagtattttaagttgtgggtgtgccatccatccctggtggcatctctgcaaacaacaatttaaaggttatttttacatatcacttatatgtgattaagcctttagggaatatgacaaagatacccagtggtgcagaataggaatcctttaaataaggtgaaattttcagtgataattgctgcgaggtaaaaatgtctttcattcctgagcagccagagaagagagtagcagtgatagcttgatgacatgagacattctgcaaggagcccatgctgagcgtcaatacttaggagccacctgctccagggagtctgggagctgataccagaggagagcgagatgcacaggcagggtgagaacactgcagttacaggggcgggaagtccagctgcatttatctgtaccttgtgaacacacacaagaatccgaggtaccacagcagactaagccagagggcaacatccagggagaacactgttgagatccagtgatcatagcaggaagttaacatctcaggagagaaggactgagagttttcctctccttgctttttgtctaagacgttttattttattttatttcccgaaaaaaaaaaaaaaaaaaacagtccagggcaaagtacagtgtcaaagatcaagtgcagtattccaggaaaatatcaattcagacaaaagctgtgatgctattgattttaaactgactaaaagtagattcttacaaaaaggaaccccatattgttcagagtgtagaatttgatatgggttaaggtgaactcagaaggtggcataaggagaaggactgggtcagaggtggctgagaaagaactcttaaaattaaataatgaaatgtaactcaaaaaagagtaaagttctgaatagaaacatagaaatggctaatacacacattagacattagagaaatgcaaatttaattcactaggagaaaccatgatgactataattccgt

SEQ ID NO: 1134 - DNA, 1000 bp, mus musculus
caacaggaactctcagggcccaagcatttgaataccctctgaagaatccccagaattctgaacttcacacaatcacagaaactctctgcagctagcaaaaccacacccctgttagagcaggaagcaaatcattgtcagctgctggacaatcaagaccagcccctcgtccccatccctgggattaaaatgaagtcacattcctatttctgtgtgtgtgtgtgtgtgtgtgtgtgtgtgtgtgtgtgtgtgtgtgtgatttaaagaaacaaaaactctcactacatttatgtgccaaggatattattgttcaggtattatgtttccttttctcctagatcatagtattttttttctctccatgtttggtcattttatatttgcgacgctcttactacatttcaacagaaaacttttttactacattccagccaaaataccttccattttctcattctcctttccaggaaacaatggcaaccacaaaactgagagctcttcaaaagggtctgggtgaccacacactggcctctgtccctcccctcctcactggcaagtggcactcatgtcctcgcttcatgtagacttaggggaactttgcccttgtttgttccagtcttgcacttggtactccggttgcactttattggctatttcagaagtattcttcaaggttaacacctgacttggttttaatagcacagttgacctttctgccctggtcagtccacagcattcatggcttctcttcatcttgtggattttctctaactcatggccgctctgtataacttcccatggtcacaactctcttgggagtagagactcacttcaggatgatccagagctatctcacaacttcatcggcaccaggcaagcctctcattccaccgctcatttcattcccatgctgccattctttatccatctggctaccacataattaactccgtttgtatgtctaattattttcttaatagccattccaaaaataactttctgt

SEQ ID NO: 1135 - DNA, 1200 bp, mus musculus
gtcctggtgatgatttctgtctcacaatctgcaaacttagactaagtgtgattgtgcttctgcctcttgaataaaaccttagtatattctctttccttttgggaaatcggtgacttaaatgtaacccctttagcccatgtttcccaaaaagccacatttcaatttattgattattttctttcttcttttacatttttattggatattttatttatttacatttcaactgttatcccttttcctggtttctccttcacaaatcccatatcacacctgcctccactgcttctatgaggatgctcccccactcacccacccacccactcctacctcaatgtcctagcattcccctatactggggcattgagccttcacaggacccagggcctcccctcctattgatgccagataagctacttatgcagctggtgccatgggtccctccatgtgtactctttggttgatggtttagtccctgggagctctagtgtgtgtgtgtgtgtgggggggggctggttggttgatgttgtttggtgttcttcctatgggtttgcaaactcctttagctccttcagtcctttccctaactcttctgttggagtacccgtgcttagtctgatggttggctgcaagcactagatatataaggaagaatttatatcccatacaaacaagggcaagttcatgtgtaaagcttctatttctgcttcttaacaatattctgcaagaactgaccctgttcattttggtcccctttccccaatgatctgctgtcctgtcacatcagcattccaactgaaattccagactgattagaaagactccttgtggtggccccagggtgttggcactgcaggtataaatctgtgccgaatctcctccccatccctctgtttctcctgctgtcccacgcagttctaaatgaacttgctcagagaactggaacattagctgagatttttaccagacatgacctgaggaggagcaggtgatgtctagggatgaaacaaggacttttcaaagatatatcacaggttccatggaaaacagtattgaatcttataacataatgtgtccagttctgatccttgtagtagaacaagagtggcagcattaatgtagctaataattatcttttatacacagcataattagtactattttaagttcatacagttcttctagcttttacatcattat

SEQ ID NO: 1136 - DNA, 1000 bp, mus musculus
atatgtggcaggggtaaagttttaaagaagttgtaaaactattttgcaaaataaaataatactgcaaagccaactagcagttagaggagtgcctgcatttggggggggggtattttctttatttacatttcaaaccattgcctctttcctgatttcccctccagaacacccccatcccatcccctttgcttctatgagggtgttccccaaaccactcacccacttctgactccctgccctggcattcccctacactggggcatctagcctttacaggacaaagagctccttctcccattgatgacaacaaggccatcctctgctacatatgtggctggagccatggatccttccatgtgtattctttggttggtgcctgcatttttaaattcttgaaacattttaaatgatcagttgtttgattttaggcataagtagtttatcacatgtaattcataaatgtttcctaagatcttgtcttttcattctcttagtctataaatatttttccaacgctttaaacatatgtaaaattaaaaagtctaataacttatcaataaatctgcctgctaggtagcaattacaatactttcaatgttttgagtgtattattcactacgacaattccaattatgcaaatatacttaatcccactactataattctacaattcacatgtgagatacagtgttcacaaaactctttgaaagcaatctaatataaatgtttattgatgagttctttgggatagattccaacaagcccttgagtgttcataaatgttgttaaattcttcatcctcagccccaacaccaatcaatgtaaataagattctgaatattaactagcaatccatataaattttcactatttaaaatcaaaagtcttatctgtataagactttgatgaataaatataattttaataacttattggatttatggttttcttacactctttatattcctatttatttattcatcctttcttttttaattct

SEQ ID NO: 1137 - DNA, 1400 bp, mus musculus
atacatgaaataagaaaataaatctttaaaaaaatcttttaaaaaaatgaatgaggtaaatcagacacaaaagaacatacatagtatgtactcactaatgagttgatattaaccaaaaacagtacggaatacccagaatacaacccacaaaactcaagaaagttaacaagcagaagggcccaagtgaggatgtctcaatccacttgggagggagaaaaaagaaatcatggctttgggggtgggggtggggggagaaagggacctgagtggagaagtgacaggcagaggaaagggggaacatgattagatattgagggggaattggactgaagtcctgtgggccagcagaaagaataaaaacaggaaacctcaggaggtagagatgggaggaccctcaaagggagtcaccttagatgaaatgccctacagtggggagagggagcttgtgtagtcctcttctagtggaaggacatggtatcaattggagaaatggggttgccatcttacaatcaggaactctgacccagaattgttcctgtctaaaagcactgcagtgatggaaatggataagagcctaagggaaaggaagtccagtgacaggcctagactgggatccagctaggggctagggagaggttcctgggcctgacactgttactggagctatgatgtgcttacagatgggagcctgccatggctgtcctctgagaggcacagcaagcaaccaaaagagtcaggtgcagttacttataaccaatcaatggacagaaaccagggacccctgtggttgtattagggaaaagctggaagaagctgagaaggagagcaaccctgtaagaagaccaacagtcacaacttgcctggaccccagagatatcttggacactgagccaccttccaggcaacatacacaagctgacatgaggcccctgacacatatacagcagaggacttgcctcagtgagagaagatgcacctaacccttgagagacttaaggtcccagggagtggggaggtctggtggggttgaagtgagggggtgggtacatcctcttggagacaggagaggaggtatgaaatgggggttgggggtgcagagtgagaaaagggtagtggccagactgtaaaggaagatcaaagaataataaataaataaataaataaataaataaaatgtttcttgctctcctctctgttagtagactaaaactagaatggaagtaggaaaatataaccacaaaaccaaaaataattggaatgggagaataataaggggagtctaaggaaagtctaagtcaaggtagaagaatgaccaacagggttggggatcaaattcaaccaactaaaactatccatgaacccaggagcctaaggcagggacatcctcagtcacagtgtag

SEQ ID NO: 1138 - DNA, 1200 bp, mus musculus
acaagattgataagataattatcagcacctagagaaggtatgtgtagaaagaaattacctgtgattgctactggttttctttcaaatggtgatgaactgtgttctgaaatgcatggtaaaattgttgtacatctctatacatatgataaaattctatgcactttaaatggataaattgttcagtatgtgaaaatttaaaggttgtttaaaagaaaatacccacaggcaacttctgctgcaatattcatgtcagcatatcctcagcgtgcaaatctgggaagatcgagtcacagcacagatgtcaaaagccacaaactatagcagaaatggacaggaggtaaaacaaggcaagaagccttcagtgccccttgagctggtcattaacatgtgtccttactccaatacaaaggtacatgagaactgtgaaggagggacacactctcccatcaacatgcaaagcaggcattggaaaggcaattaacagggcagcctatactcaggtagatggagaatctagcaaacattggtaaggcaattcacagataagtgtggactcgggtagatgaataaacccctccaactctagctggttttctgagaatctttaaaaagaaaccactgcaaagagagattccactgggaaattatacaacaaaacaaagaaattccaagagaaaacaagggaaatttgggtgccccagaacatagagtgcactctctttattacttagtgtctggtgttgatcacaggtaaagaagttctagggactgaacttggtaaacatcttctaaatcatgtttcttctactcaacaacagaaaaggcagtggtaacactaatcttttacctattagctgtcttcatttaatctatactatcacattctattttatgatgcttgagttgagacaccaaaaatatgatttaccaattatcacactgttaggtcccattaatagtatgaggaactaaacattgtaattcacaaagaactacagtgcaatcacttgtagtagtagtagtagtagtagtagtaatattaataacaatataagatgaaaatatcaacaaagaagaaagacaattacttggtggcccaaaataaatgcaatatttgttaatttctagctccattatctttggttaataagcattaaggacaaattctaaaaattcacccacttatccacagaggacaaa

SEQ ID NO: 1139 - DNA, 1000 bp, mus musculus
taaataacatctgaacaaagacagttgacttttcactgaccccacggaaatgcttaaatgtttggatttatccacgagaaagatgagacagtcagtgtttatatatttggatatatttgtttcaaatatgtatgtcatgtaaactgcttaagcgttttgagcatggtttagtgaattcctcttgaagttttttgtagaaatgaaacttgctgagtgcaaagctatttgctgaccagaaggagccttatgccatcagggtgagtggaagagagtacacagataaaccactcattctcactctcctcccttgtttacacttaacatccagtatagcagagtttccctaatctacatgaggttctcagccttttcattataaccattctgtgcagaaactggaaactttccaaacaggtattcatggtctcctttctttataagagatccccacttggaactgaaacaccagctcttttgaagacagctatgaacatttaatatttagctgacacaatataaagacaagtgtctcatggagcttataaacggataggttcctgaccttccaatccatctctctccttgcaaaaagagaactgttagtttgtcaacacagtgaccttctaaggaaactggccaataaagtataggcatcctaggagtctgactaacagccggcttctgcactagtctaaacctcagctgcctacacactaggtggcaatgacctatggggtcatgtgacacagtgtagcaattaataataattcaagcaacacaaaagatttctgatcatacatgactaaaacatatctccaaaccaaatgctcaatgaaccaaagtgtttccagaagtgctaactgaagcttcatctcaggacttcatttatcctttcttctgtccatccagcatgcacactttgtattacttttgcctctacacaaggaatgaatcctgaaactcattggctaaatgcaatagtcttttctgttatacattc

SEQ ID NO: 1140 - DNA, 1000 bp, mus musculus
gtatatgtatataggcattctctgttataacctcttttttaattaattatctgaatatgcaaacttgcagcgagcttttcctatgtgaacactagctcctagagttgtacaagacaaagctcagagaaaaatctccctccccctttctccctgggacttcaacttagagaagcacaattcctccctcccccaagaagctttacctagcctcctgctgtgtcactttgaggtgccaactagaggctggggaagccatctttaagggactgggtcaggctgatcagctgcagaacttcagaagcagagtacctttcacctaggacagataggaaatggtcaaaatggtccatggcttagtttctgaatgtgatataagcaatgaccccctcactgttaggtccattggattcataaccttagtttcaatatttctctgtttagttcctgtcttgatgacatgtgctttggtgaaagtagggtgttgaagtctcccactattaatgtgtggggtttgatatgtggtttaagctttagtaatgtttcttttacgaatgtgggtgcccttgcatttggagcatatatgttcaatattgagaagtcgtcctggtggcttttttcttttatgagtataaagtgtccttcccatctcttttgattaattttggttgcaagtctactgtattagatatgggaatgactactccagcctgtttcttgggtacattttcttggagaacttttttacagccctttacctggttctttattattctgtggacctggatggtttttcttaggcaggccttataggggccagcagagttggctgcaccattttaattttcagttcccagtggtccaatcaacaatgtatatggggaggctgaggcattaggttcacaaggtcaaggcttgactgagttatgagtagagacctgtgctccatcctccccactctcaatccaagggcaataaatagcataccatcccccaatggcag

SEQ ID NO: 1141 - DNA, 1000 bp, mus musculus
gttcaaaaaaaagcttcgagaggtattattcacaatatcctgctggtaaaaaagaacctaagtaccaaaacagaacgtgctataaaactataacatggacatcattcagtcaaacgatgaataagtgtgctctgtgaaatgagccagatatgtaaggaaggcccatttccatgaaaccgctagataagacaagaacctaagtagtggtgctggggcctaggaaaaagagtgcattgaatggacactggttttctttagggatgctgaaaatgttctagaacttgacagtgataataatgcttgtgtattatattacaagcctcttagaaagctttctttcagagctgagcccttgtgtgtgctaagcaagcactgttctaccaagttacgttcccaccaattaatccttatttttagacagggttttactaagctgtccaggcaagccttgaacctgcaacctcctgcttcagtgtcccacgtagctaagtttacatgctgtgccatcagccccagcaaatagtaaagtttactatatgaacctaaaatataattgaaggaaggtcctgtacatatgcctctgactccaactattaatccatactcttatataatcaaaaccaagacagttacattctacgcaccggttagcgccgctggcttggacagtgtgctatactggttctgcgtggacagcatgctctgccgtggactcagggttggtgacgcaaccagtgaaagctcctcaatgacgacactgcttttggggtgattcctggggagctcatttaacctttgctctagtgaatactttaaaaggtccaacttctgacttgattcattaaatctcgcttgtgccttgttaggaaaagagatattgttgtcatttaagccaggatattcttcaaataacataataaacggctaaaaattgtttttaaaattacttctgaaagcgcttttctgtctgttacttttcctgagccaagtaacttcatga

SEQ ID NO: 1142 - DNA, 1000 bp, mus musculus
tggccttctgactccagcaggtcacacttcacacccccactgagtcatcccttgatgttatttctttagcgtctcaccctcttctagctctaaaatacctctgagatggtctctagccactagccattcaagcctttcccctgagctggctcaaacctgccattccaaccttgtttcccactaaggtccaattcagctttctgggacagaaagctggtgtcctcagtggtctggtgtctttggtcccctgaagaactgcaacctgccctggaccccagtgtgtacacactctgtgctttaaccaagggtcagtccaatcctcaccatggctggaacccacagtatcctgtccttctctgcactcacgcctgtgcccctgacagtgggtgacttgcactcatgcctgcacccctgacagggggtgacttgcatctacacctgctctcctgacagtgggtgacttgtactcatgcctgcacctctgatagtgggtgacttgcactcacacctacgcccctgacagtgggtgacttgcactcatgcctatgcccctgacagtgggtgactgtcctttctcacctcacatatggatcacatgactaaatttcattggtttgtgtattcagccaccctccttggggaacgttggtttctctgaggccagtgacatcctcatgtatatttgtctcatgagaacacagaccaaagggcattttactgacccttccactgtctctcagaagaaagctatacacactccactggaggcgtgacctgagtcctggaaatccccagagtaccacgtggctcttgtttccaggattcacacaagacatcccttccatcgaacactcctaaagtctccctgtgccacccctgttgccaccatgagctctgccttcctctagttccactttttctggatagctccttggcccagcttagacatcacagccccctgagggttcacccttaattcatgagaccagaagaggtttgg

SEQ ID NO: 1143 - DNA, 1000 bp, mus musculus
taaatatcatatttgcagtgttctgtcaataacatcttgaaaacacacattaggtttctgtgtcaaatctattgactctaacacatgtgctgatacccatcagattacgtatttaaaccattgtcttcgagaacgtatcttcttatatctgttctgtggagacaggggcatctggatttcccaaatattagcattttataatggtttggtaagctttagtgagaagacagtggaaaacctagaatgtcacctggaagccccattgttgattccattaggctggtgtgagaaatcacctggagatggattagcgtgaggttgctgttctacacaccagtccaacagacatgagtgagggaagactctaagaagttatgtgactcaagtaagaagggcacagtgctattcctgaagacatgagcagggtaatgataatggataggatactacccagacgcatcccatccttgcctggagaaaacagcctctagtcagttcaatgagtcattttcttccactttgtggatacacatagtatcatagtggaaataaaacttcattgcttagctctatgcaaggattccattgtgagaaaaatggaaagcacttacagaatcgagactttgcatgaacatgatggagcccctcgcagtctgggatttgtttgggataaatgtacacttggcttcctgcattcctgtctttgcatctcgacgacatctcctcgacacacagctgcctccctgacactcacggaccacactggtgccagtgatgtcggtggaacacctatgataaaagcattgagttgctgtggtggtgctagctgctggacccagaggctacacacatgctaagtgagctgtctatcacaaagccacaccctcagaaccagtttggaagcttccctcactctctcttgtcctgaaatcttttcctcagtgacaactcttcttggtcatgccccaaatatttcattttgacaacagtaggcataatg

SEQ ID NO: 1144 - DNA, 1000 bp, mus musculus
aaaagtgaaatagatatgtaaaaatgataataaaaatggaatcaagccttccggtctgcggcagcaccgggttaccttgggcgcagagttggtggacacccccaaggtccctagaggactctccacgtgatcttaggaccaacggtgagtggaacacaacttctgttccattccaatcactcaggacttgagacagcattagggaagcagaaaacccagcctgaccagggtcacaagtcccttctggtcggcgccagcacctggtcaccttgggcatggagttgttggacacacccaaggtccctagaggacagcttctgaggcagaccccgtttcaggctccagacatctgggcaccttccctgccagaggtgaggtgtgcaccctgcccaggagggctttgttggagcacctgggggagccacctttgttcccggatccctccaagatgagtctacgcaggtgagagtgtggaatacagaagctaacagcctctgggacaggccctgtttcgggccttcatcttctgccaggaggcaggtccaaatgccagatatctgtgtaccttccctgcaagaggaaagcttgcctgcagagagtgctctgaccactgaaactcagtggagatctagtctcccaggtctgctgatagaggctaacagaatcatgagaggaacaagctctaaccagagaaaactataacaactaactccagagattatcagatggtgaaaggcaaatgtaagaatcttactaacagaaaccaagaccactcaccatcatcagaacacagcactcccacctcacccaatcctggacaccccaacacacccgaaagcctagacccggatttaaaagcatatctcaagatgatggtagaggacatcatgaaggactttaataactcacttaaagaaatacaggagaacactgctaaagagttacaagtccttaaagaaaaacaggaaaacacaaccaaacaggtagaagtccttaaaga

SEQ ID NO: 1145 - DNA, 1000 bp, mus musculus
ggtgaagtctctctcacctctggtccccccaggggagagcgaccccggctgcagtcaggcagggagcatcctagctatctttctccctgggtgctgcttcctacccccatactgcttcatcccttaccccaccctacactccgttctgcgggtaggagcatggttctcatgtgattttcccccttttcatggacagtacctgcacctttagcagttcggagctggcttctgttttccgttagtgctttgctgcagggacaaatgcatacaaatgcatttaggagcctacaggacaaggcatggaaaggtctcccccaccacagaaacgtaagtagcccacccgccgcccgaggggggaggaaggggctttagaccaaaccccctctcaccacccactgaatccgcagtggagctggagatctgtgctccttggtaccttttggagtagggagcctgcgagctgccgtggcatcctcctcctcttgacttctcaacttgtaaaataccgtgtttgaaaggaagcaagcttctgccagcgagtctcagtttatgctaaagcaatcctgtggctgaggaggaaaagcttgctggcctgtgtcccaacatcccctcggccactgccccaggcggttgcagagccgctctgacacccgcctgggctctaactccaactatcctctcaccccctccccttttcctctttcagttttggctgaagtcctacttccagctgtctggggcacccagcctggatgactgctaggacaccagcaatcctgtggattccgcaagcacaggattggggttaaatttaggtggtgagaaaggatgcctatctacagagcccagaaagccggaggatctgagggggtcacctcttttaattctttctctgtttttttagaagaccaacagacataactctcgcatctggagttgtagctagccctgacatacgttctgtcagtggagaagtagtgctcacagccaggatagggtt

SEQ ID NO: 1146 - DNA, 1600 bp, mus musculus
tcagcatctagttagatgatcatgtacttttttcctttgagtttgtttatatagttaattacattgatggatttacatatattgaaccatctctgcatccctgaagtgaagcctatggaactagaaagtatcatcctgagtgaggtaaccaagtcacaaaagaaaacacatgttttggatattagtgctaatgctcagaatacccaagataaaattgacagaccacatgaagctcaagaagaagaaagacaaaagtgtggttgcttcagtccttcttagtagggggaacaaaatactcatggaatgaaacatggagacaaagtctggagcagagactgaaggaaaggccatccagagactgtcccacacgtggatccatctcatatacagacaccaaacccagacactattgagggtgtcaagaagtgcatgctgacaggagcctgatatcgctgtctcctgagagaccctgccagagcttgacaaatacagggtggatgcttgcagtcaaccattggaggatctagagaaaggactgaaggagctaaagcagtttgcaatcccataggaagaacaacaatattaaccaaccagaccccccaccaaagatcccagggactgaaccactgatcagagggtagagatggtgtgacccctggctccatctgcatgtgtagcagaggatggccatgctgagcatcaacaggaggagaggtcctttgccctgtgaagccttgatgccccagtgcaggggaatgccagagaggtggtagtgggtgggtgagcagcctcacagaagcaggggaatgggggatgggataggggatttctggaggggataacaggaaatgtaaatatataaaatatcccccacaagaaattgaatgaaaattataatgacatccttctctaggcctaaagttttaaaagtcgcgtgatgctttcacactccactgacaagagcagagtagtatcagccttgcatcaaaacagctcagtattattttacacatattcgggacatagtgtatgagacaagagaaataaaacagttaacttcccccaagaagaatgacagggacctttccataatcgctcaaagtagaactgagggtcaactggtggatgagtaagcaatctaagtatattcaaagactggaaagatgttgatagctatgaaggaactggttacagacacaggcagtgccaccgatggaagtcaagctgctgttccccttttctattgccaacttgacccctccctccacccctccacgctaatccactgaggtacatgggattcagctctactgtcctctttcttcagtcactgctttcatccactcaactcttcccttttgttcacttcatttagcgaagaactttgcttttggatcatatattctcctctaccttgtgattattcttattctaggtcacttgattatctataactgccaaatactatttggtctcataattggctgcttatcttattgacctctgtcacaccatgcacacacacacagacgacagacagacacacacacagacatacacacacacacaaatttaaatctattactttgtggacagtaac

SEQ ID NO: 1147 - DNA, 1000 bp, mus musculus
agccagagagcaagagcaagagctctattgcttacatctttaggagccagagagcaagagagcaagaactctattgcttacatctttaggagccagagagcaagagtgcaagagagcaagagcaagagctctattgcttacatctttagtagccagagagcaagagcaagagagagaatggtgaaaccccgtccctttttaaggagaattatcctccgcctaggacgtgtcactccctgattggctgcagcccatcggccgagttgtcgtcacggggaaggcagagcacatggagtggagaactacccttggcacatgcgcagattatttgtttaccacttagaacacaggatgtcagcgccatcttgcaacagcgaatgtgagggcagctccccacatggttgctgggatttgaactcaggacctttgggagagcagtcagtactcttacatgctgagccatcttgccagcccaaaagaaatttagaaaataaaataactattaaattgccagttcatcttctggtaggtactttcgtgttcctttctttctcatacaagatatgtgacagaaacaatggaaggaaaaaagtattgacactggctcacagtttcagaaggttgaaaggcctggagctgcctgactgtgggagtgtggacagagccattcacaccacagtggacaagacagtagggaccatggcggagagtggaggctgggcccaaccttcagagacctgtagttcatgtcctgctttaaccagctacgctccggtctccccagacagcaccgtcagctggggacgaaatgctcagaacctgagtctgtgaggaatctttcagatttattatgccactcatccattttgtatatcttgatagtttcataggttagcatcccaatatttgatagaagctcatagaaatttttactactgaatcagatttgcatatttcttctgtcatagttatcaaattttactttctatatttttactag

SEQ ID NO: 1148 - DNA, 1400 bp, mus musculus
caagtgccttgaggaggaaacacttcctcaatgctcgtgcttgtttgtccagcttactctacagatttgagggggaattcaattccctcatataagcaagtttcatttttattattttacttatttgcatttcaaatgttgtccccttccacaaacccccaccccaccaacccacccactcctaactcacctctctagcatcccccttctctgaggcatcaaggttccacaggaccaagtgcatccctttccactaattctagataaggcagtcctctactgtgggaagccacatgtgccgttgcagggtggcgctggcttctactggccaccacgcatacacaggcggtaaagttcttttgccaagatgaggttttgagaattaaccaaagttaaccaatcagatgagagagaatttaaccaatcagatgtaggcatgcaaatgaggtgataagcataacccaagcacaaccaatccgggtgtgagacacgcctctcctaggcctatataagcagcaccagttctgggcttgggggtcttttcacctctgcaatcaagctctcccaataaacgtgtgcagaaggatcctgttgcagcgtcgttcttgctggccagtcgggcgtgcgcaagactctactacatgtgtagtgggagatattactgattcatgtgtactctttggttggtggttcagtctctgggagctctgagtggtttggttagttgatattgctgttcttcctatagggttgcaatccctaactcttccattggggtcctcgtgctcagtccaatgcttggctgtgagtatgtgcatctgtcttagccaggtgctgggagatcctcccagaggacaatcgtttcaggcccctgtctgcaagcacatcaaggcatcaggaaaagcatcagggtttggtatctgtacatgtgatggatctaaaggtagggcagtctctgaatggcttggccttcagtctttgctccatttctttgtccttgcatttcctttagacaggaacaattatgggttaaaatttttgagatgtgtgggtggccccatcccttaactgggtgacatgtcgacctactaaaggtgttctctccaggttctgtctccctgctgtttgtttgttgtttgctgttattctagtattgtcatccccactgggttctgggaacctcttgcatccctggcctctgggactttctagtgtctcccccagacccaggcccctctgctacttatttctcttcattcttctggccctctggatttctcttgtctcttcacatacatggtcctgcttcccctttttccatccccttccctctcccacccaattcgcttcctccctctgcctcccatgattactttgtcccccttttctaagtggaattg

SEQ ID NO: 1149 - DNA, 1000 bp, mus musculus
ttatctttaagccatcacattagttgcttttctgttgttgtgataaaacacctgaacaagacaattcatagaagactttatttgagcatctggttccatagaaataacagtctgtcatgtcagaggggcacatcagcaaacaacaggcacagtagctggacaaggccactgctagcacgtatttcctactgcaagcgtgcatgaagcaaagagagtaaagtaggaatgactcaagtctttaaactctccaagcccagcctcagttccatacttcgttcaccaaggacacatctcctaaatctcctcaaatggtgccggccatcaactagagaccagttattcaagtccatgagtacacagggacgttgtaattcaaactacgcagctttagaactctcagcaaactagtttagtaatagcacatttattgtgcatggtgaagaatcctgaaaatatgctgatcacttaaagcaatggttcaggattcaggcttctcccagcttaggacatctgacatattacctgaaaatattcttgtaggttgtctgccttcagcatagttgcaagggaatcacaaagacaggagaactattacatcaacaagatcacaaatgcctaccagagtcatcaatagctgacatctatcttggagccagggaagaaagatgattttttttctttattttgttttccaaaatgctgcctcaattttgattatttttgaacccttcaaattaaacattcttatttatttatatcactgaattatagactatgtttgaaaatgctatttcttttttaaaatttttattaggtattttcctcatttagatttccaatgcgatcccaaaagtgccccatatcctcccccccactctcctacacacccattcccatttcttggcactggcgttcccctgtactggggcatataaagtttgcaagtccaatggggttctctttccagtgatggccgactaggccatcttttgatacatat

SEQ ID NO: 1150 - DNA, 1200 bp, mus musculus
gagtctgtaaacattggtgaagaggattttgtatgtgtgtaagttttaatttctccagagtagatttccagaaatgcaattgtttgattatattatagttttatctttaacattatagattctattgtgaggttttgaagttaacattggcattttaaatgtctggagaattgaatgagtgatcaagttttcctaccttgtttctaacaatacttaaatagttttgtttttaagaaacactgtaggccagcgtgtttgacaatgagaaacttattttacaggagccatttccatgtgcttattttgaaatctctagaaaatgtaccttatcatgtgttttgctaatgcttgttttatgatgagcatttaacagtgttgctgtcaggggctggagaaatggctcaggcctcaagagcacttgctattcttgcacactgtacgaagtgattcccagcacccatacgggctggtacacagctgccgtaactgcagactcttcctttttcttatgtttttcggcattctccataattaccatttctccaaagctatgtatttatttcagaatctcattttaatgcctgacatttctcacaagcactgtcaggttttctaactgggctccacttaatctaaagagccttaaccatccattggacggagcacaaggtccccgatgaaagagccagagaaggtacccagggagctgaaggggtctgaagccccataggaggaacatcaatatgatctaaccagtaaccccagagctccttggaactaaaccaccaatcaaagaaaacacatggtggaacatgtgtctctagctatatatgtagcagaggatggcatacttggtcatgaatgggaggagaggccctaggtcctgtaaaggttctatgccccaatataggggaatgccaggaccaggaatgggagtgggtggattggggggcaggggtaggggagtaaggggtagggaatttttggaggggaaactaggaaaggggataacatttgaaatgtaaataaagaaaatatctaaaaaaaaaaataaaagaaatctgtttggcttttgaagttcaaagaaagaaaagacccttatcttcctatacaaagggaggtggtcacatcacctattctgtgttattactcgccaaggtgtgtaacattactgaagatttctctctccataagtatcat

SEQ ID NO: 1151 - DNA, 1000 bp, mus musculus
gtcctttgagcaggtataaagccatcatggtatgctgggtggaaaaccattctgggcataaagacagtgtgagtccctcatctccccttctggggtcagattaagcagaaggcattagaatcttaagactggagtcttcagccggacactattccctgcctcatctccccccatccctgctgccttctggcattgcattctatagtcacaattgtggggctagctccgtaggtaggaaatcttgctgtgaattctttggctccttagttcacatgcccataacccaggttaaagctggacatggacacacaagtttctaaacttagtgctgggcagagaagaggccaaagggtcactgagatcctgtttcagggagatacatagaatggaagagcaggaccttccctgatggcctcctctggcctccacatgtgcatgcatgtatgtgcacacatgtacttatacacaatcactacacgcaatggaagaaagtatgatggggaaaggaggaagaaacagaaggggagtaagagagaaagggttgtgagacaggcaagagagcaagcagcaacatctccaaaccctttctatcagctccaccaatcaggaaatgccagtacccactctagggagggtcatctccccgttaatccttcttgggaatattgggattgccttcaaagtcctatccagggacacgtctcttaagtccagatcctgcccagtggacaatcaaaattagtcattatagagggaatttttaaataaagcattgagcttttattttactttattatttatgtattttataatagtcttttagactatttctgaggcgcatctattccagagacaagctctcactgtccacaggtgtttccatgcttagcagcaaggagtttgttaatgtctctgtactgacaagtgcattttagataagatacattttgattttagcatccacttcctgttggcctgtgtgtctattgctgctgctgct

SEQ ID NO: 1152 - DNA, 1000 bp, mus musculus
acagaatgcgctgtccgaacgtcctgcaaaccaaaatactaaataaaatgtattcgttctggcctcgtataaaagaaattccacttgtgaagccatgcagaaggcaagagctaggcgagtggttctgtccttggacggcctccccactggactcgtttgcggccatgcaccttgaccttctgcctaactggggtgttgaaggaaaatgagatctttttcacactttagtcaggattaattcaacactgtcaaagcatttgtacagcctcatatttagagacatcaaaaacagtaggtacaacgatggaatcttctttgaattacccagtgatgacaaatagtcatataataaaacaggaggaggcgaatggtaatcccgggtgacaggcagctgtcaatcagagatcccaacactctggtggctccctaactggagctcacgcaggacagattgtcagcttcatttctattcagaggcagccaatcacagggactcatttacatctctcctttttccctacagcatgttaacagcaggcggtccacccataccatctttgaaataggtaggtggctcaaaatgccttcagatttcagtcaagagccggaattaaaaataaactggagcttccgtgtcaccgttttctgctctcagagagtaagcagagcgcgtgcgcatgcgcggctcctgttttaagaggggcctccctgccgaaacctgcctcctttaacccaggagctttctcaagagctgaacatcacttaagctcacgtaggcaagaacaagcaagacattttaagtgttttggactcttctgtaacttcacgtgtgcttacaacattacttaagctcacgtaggcaagaacaagcaggactttaagtgttttggactcttctgtaacttcacgtgtgcttacaacaagctgcacacactggcattaaagcccaccacaaggggaggaacacatgttgctattctgacattaccttaaagtaaaa

SEQ ID NO: 1153 - DNA, 1000 bp, mus musculus
gattgtccaaaagaaaccggagacaaggttgactcatacacacatctgtggctcctcccaggacttcttacctcagcccctaccctaaatctctccctcccacagtgctgggcttctctactcccagcttctgattcccatataattcacccattatggtcatgtgctctcttgggttttggctcctggttagcttactcttccttcttggtctacagctcctccctcgatcctcctgacctctcttctccttctcttcctctcttgccatcccatcactctaatgccttggttcagtccgaacccctacagatacttctggctgcaccctccctcatatctaggatacaacccttttgccaaaccatactttggagaagtcttgtcctcgttgtcattcagagatgtccccaggatctgagggcagtatacctgtagttgagggtcctatatttcctgtttgtgagggactatagttatggtgaactcagtgtagatcccactgatgaaagtgaaaatgattttgaaaatgcgtcaaaggggagatcatctgggtgggacctgtcacagtgcagatagccgggaattaacagcatccttctgctgggggagactcttctgctgactttgaaaacatgagcagccatgtttgagttgcctgtgcaggtgtccaggtgataaaggcagagtggagatgagcctggccattagctccagggagcacagtgaattcagtcataaaaccccaagaaaaatctctgccaagatgcagtgagctaggaatcacttcttcccccgtggagcttccacatgggaaggcagctggctaaagcctggatatcaggctgccagaacacagaagaaaagttagcttgtgccagactgatgacatagagagagtaagtgtatgctgttttaatcctatacatttgtaattgattccacaccaaaaggaaacccttaacagttactaaaccctagtaggtagagtttgtgctgg

SEQ ID NO: 1154 - DNA, 1000 bp, mus musculus
aattcatcaatattcatattatttattctattgcaaacattcagtgaatgtctaggaaattaaaaagtatttgcgaaatatataaactaattagttagaatgaactggctttaataattggagtgtttttccggaagcttcagcaactcacctgaatctgtcttcttcttttgtgaatgatacatttagtgaagacacagtattaaaaaatatcattgtacaaacaacagctttacctccaggcaacacagtacagaagtaatttaattaactttaattaaactttctagttaatatttttcatacagttttatggtctatgactttataactactttcccatagtacttcagtgtttgtaagaattttatgaaaaaaaaatatcccaaatattcagttccacaatttttagtagggtataatggagttagtagatgaaattctgagacatgttttgaatgacattttgaaacaaacatggagaccctgaagagaaagatattgcaccattgagaaacttagttaacccataagatgaaatagaaaagatcattttaggctgatgtacaaattagttttctaaacaattgaccatggtgattgctcagacactgggaagcatgcaagtcttgaagaacactgttcacataagattagagtcctggaggactctgtcaaagaagaaacaaaaaacaaggattatgctcctggttttgtcaaaattgaagatgcaaggacaggaatcggctgaatcatctctcttgactgaattttaagtcctgatggcgagcagctgagtgatccagacttgggggagttgacaccaaatgaggtggagacatctgaaagtattcaggctcccaccaccaagcagtggcatatgtaaattgagttggagtctttgaaacctcatgattaagtactcagacagctcagtagcagatgtttggctctcctatcatccatgttgaaaccctcatgctaattaggaatgtggaca

SEQ ID NO: 1155 - DNA, 1200 bp, mus musculus
cccctcacccttatggtcccttccccccccccaaataaaaaagcaacagcaacaacagaaaaagtccaatttgtgttgtccatatactcactggaatatggtcaattccagttgctagccccttaaagaaaactgagttctccccacccacattcctacaagaagcatatgttgtggaggtagagaactacacttcagcatctttgtcattatttttaagagttctctttgatggctttctgtctggcttttttttttttaattgaaggggaggggagacagggggaggaaggggctaagtgttgtcgcagaaaccttctgtctctctcaacagtgagtgtgcagtcatcagtgtcactgcaaaagtagcatccttgccttttacagtctgcaggaggacgggtcatggacttacacatgatctctggaggcagcacagcatggtccatgcacacacacatgatctccattgttggcatgtgccatgacctcagtataatctccggtgccaggagagatcacagacatcaacagagacctctctggtgtaggtcagggcatagattccataaaagccctgagcagcaacacatgtcaaaatcatccacagcgacataggccacagagaagaatgtagtccccagtggtagctcggcccatggacacatcaaagtggcgtctggtggcagtacagaccacagacatacacgtagccttccgtgaagacaggacatgaacataaatgaacatgatcgcagtctgcagcagggccatagaccacaacatgatcttctgcagcacaggcatcaatgtgttcactggtatgttggcaacacagcccacagacatcaacacggtttcaggcggtgacacagaccaggcgcatccatatgggctttagtgttaactaaattaactaattgaaaactataaattgaaacacacacacacacacacacacacacacacacacgcatgcacacacaccacaaacacacacaccacaaacacaaacacacacagcacacacacaacacacacacacacctcaacacacacatacaacacacatacacataaaccacccccacaccataccacatacacacacaccacacacacataaaccatcccccacacgtacacacacacacaaacacacacacaacacacacacaaaaaccagccccacacatacat

SEQ ID NO: 1156 - DNA, 1200 bp, mus musculus
atgaggtttttatagctaaaatggggctttggaaatacttgctttaaatacatttactagacttactaatactactccagttagcattaacaattgagtttaatgtatctagaattatttggggacagactctaaatggaagaactgtgtatatcagattggactgtatgaatatctatggatggttgccctggttgttaactgatgtaggaagaagtagccagtctctaggccactagtactgaactgtataagaaagctacatgagcacacatctgcttggcagccagcaggcagcattctccatggttcccaccatacttctttggctgtgaaatgagttccttcgccagagataatactgtgtaggaaagtcaacagacctgactcaagttctcttgcacacgctcaactggccaggaagaatgatgctgcaacaggatccttctgcacacgtttattgggagagcatcgattgcataggcaaaagaagaacaaccccgaacaaggaaaatgatgctgcttatatacccctccatgtgacatgtcagctcctgattagctgctcactcatcaccccactactatgccccgggatgggcagtgacttggcacaaatttactcttgcacctgcgcatattacttgtttaccagttaggcacagcggaggctcgtgatggcaattgctcacggctctccacaaagttcctgccttaaattcctgtcttgaattcccttaatgatcaactgtaacctgcaatataagtcaaataaaccattttccccaaagttgtttcttcttctaacatttcacagtcatagacataaagctaacacggttgtatttactgtgcccctttattttgtgtttttattattactcctgctctgactttggcatttccttgtctctgaagcaagcacctctcagaggtctttcttactagtgctcagttgttgtcttactattctgagtaatatctagaatatctataatattatcatgtctaaccttaaaacattaaatattattagtgtattactcttctcaactaacattgtcttagcatacacaatttctctgaactacatggtattgctatgtaagacagccttattttattcctgaaattacacacaaaaattattttataaaactattatgtttgcatgtttgcttacatatttaccaattcatt

SEQ ID NO: 1157 - DNA, 1000 bp, mus musculus
ccagacatctgggcaccttccctcctagaagagaggtgtccacctggtagagctcagactgcctgagcaggtgagggaaccatcttgtgtcccaggtccctcagagaccagtctgaacaggtgagagtgtggaccacataagcatcagagcttctgggacaggcagaagcaacacagcttctgggacagaccccatttcaggctccagacatctgggcaccttccccgccagaggagagatggctgcctgggagggatctgacagccagagcaggtgagagagccatcttgtgtcacaggtccctcagagaccagtctgtgcaggtgagcatgcagaatgcaggggcaacacatcttcttggacaggccctgtttcgggccttcatcttcagccaggaggcatgtctgtgcaccagatctctgtgcactttccctgcgagaggagagcttgcctgcagagagtactctgaccactgagactcaggagagagctggactcccaggactgctgtcagaggctaacagaatcacaggaggaacaagctccaaccagagacaactataacaactaacaccagagattaccaggtggcaaaaggcaaacctaagaatcttactaacagaaaacaaaaccactcaccatcatcagaacccagcactcccgcctcagccagtactgtataccccaacacacccaaagagcaagactaggatttaaaatcatatctcatgatgctggtagaggactttaagaaggactttaataactcacttaaagaagtacaggagaacactgcgaaagaggtagaagtccttaaaggcttacaggaaaacacaaccaaacaggtgatggaattgaacaaaaccatacaagagctaaaaagggaagtagaaacaataaagaaaacccaaagtgagacaactctggagatagaaaccctaggaaagaaatcaggaaccgtagatgtgagcatcagcaacagaatacaagagatggaag

SEQ ID NO: 1158 - DNA, 1000 bp, mus musculus
gtgtggctttgttgaaggaagtgtgtcactgcacaggtcaggctctgaggtctcatatatgctcaagccatgcccagtgggacaatctccttctgttgcctgcagatcaagacggagcacctcctgcatgctgccatgcttcccgccatgatgataatggactgaatctctgaaactgtaagccagccccaattaaatgtttccctctataagagttatggtggctatcacgtctcttcacaacaataaaaccctaacgaaaacagtgttggagataaacataagaaggagttctgtttcttaagttatagggagactagctttgctttacaaagagtcttcattgtgtaagacaatgtatgcgaagcccccgactcccatcagtgtaaagagcaaacattggaagagctgggtggaaagggactgctgcagagagaccttgccatcctgagaggagaaaggcataggtgctgatgcacaggcaggagtatggcagcaccacttagagctctaccatggtccctgagaagcaacgaggccgcaagcatcctcctctcaacctttcagtggaatcgtctcctatacacaacacaattcccactacatttatatcaattgacaaagagtcatttggtaacacagagtacttcctaattccatggattcggaggtgacctgtcgctcgctggaagggggaggggcaatatgtaattgcatccattgccccgaggaaacaacgttagagacaagttagaagaaatatttgtgttatgaaggcatcagcaagaacacagggtgtgtgggggcgaggtcagggatgagtcaggacaggtccagatgatcctgctgaggatgttttagcactgctgtgcatgaggacttcacacattaaaatagtgcgctgaagcaagagaagctggcacattctcacaccatgggatggccctggaggtttcaccaagagttgagacacagctgctgtggctaaaaccagatgtga

SEQ ID NO: 1159 - DNA, 1400 bp, mus musculus
cttccttccttccttttccagtgtgttataggtggaatcactccctccgtttcattttctgtttcttgctggaagtgtagagaaatacagctggatcctgtgcattgatcttctttccagcaaccttgctgggctcatgttctggctcagtagaatttaatgtgttcccagaggctgtggatgaagggtatgtgtccttcccttccatttttaagaaatataactacaataaagagggatcctggttattttagcatgttatttggtgttagcttcctggggacaagatgatggtggcccctgacactgagaacatttgtagcgaccaggacagacattggtctacaacctcagatggctgtaccactctctacaaaacaaagcaacacgtgcaacagctgctatttagtaacaggctccatttggaagcccccctctccacgaacacactcaaactaatcttacccaaactaaggcaagaaagcaaaactcacatccatagacagttccaacattctaaaaagactctaaataggatttcagttgctaaagtaagtggaggattaagaaccatgtttactaaaagaccaagaaagcggagctcttgcgagcagaaacctcacacagagccagctcatccccaggccgtgcggtcccacgccctcctgtctccgtttatgttatcagcggcttctgtgcgtgccttggtttgtcttcactttccaggacacagttaacgacttataatgaaagtgataaaacgatacgtagtgactaagaaagacgcattttcgtagccagactcgaattcttccaccccaaagggagctttacccaacacttgacatcaaatggtactctgggcaaagatggtctcagtgctgccctctggtggtagatgttgggagaaggcataggcagatggcaggaaggtgcttttcagccctatttggcaaagtcccaagatactgaccagagtgtgatgacatgcaacagacagcttttatcatgctgagtgtggagggagcaaaaagtgtcatatagactcacggtttaggagcctgggacagtgtgtggccccgttgatgggagatatgtgcttcaccagtaagattttcatcagaaacagaggttgagattaatatcctatgcagacccgttccaactacccatctcctcaaactctgaattctaaaatccaactttttctcactgagacaactgagggggaaatctagaactagactggcctctgaggaggctaataaccattaactataaatctcattttatttcctggaaggctggctctctgtgtagacagcaccacaggacactttacaatttcttatctgagttgaagaatagaaaattactggcctcttgtgagaacatcaact

SEQ ID NO: 1160 - DNA, 1000 bp, mus musculus
gaatatagtcacacctcggactccataccccacatagactaggaaaaagactgggaaagaaaataaaatcaatcaggcagaacaggctccaaggagtcacgacaatgcatctggcaaggagagaggataaggaaataccaagtgtcaaagagggttatgggaggctgcacgagggagtgaggagcccagagaaacagaggtgtgctggttataggaggggccattgtggtcatgcctgtctgagctgaggacgttcaaaccaggtcctcacagaggagggagactgagcagcggtaagatggaagggtatgacagccagagggaagagcaattggatgggccacagtttcatcagaaacttgataaggaggctactgagtagaccacaagcagtagatgatgctaagcaggtgataaaacagtccattctgcatttgatatgcgatcatcaccatgttgagtgagtccacactcgggagttaagtctcacaggcttctgctgaagccgaagcagtcagaactttaagataaaacagccagccacccattagactggagaaaaccagcgtgagaggacttgtcagcttcatggtgtgaaaggctggttcagcaaacgtctcatgatgcacggaacaaacaaaacgtgaaagtgacccttcctctaaggtcaggtgtgctcgggttaaaggtaccgcacagtcgtggtacaaatggacacttaaatagtggaagataacgttggggagccatagttgttagattcttttgtgtgtgtgtgtgattgtgtatgtgtgcacgcacatgaaagccagaggtcacatgaggcattcgacctgatcactttccacatactgtttgaggcacggtccctcactaaaggcagagcttaccgatcccaccaggctagctagccacagctccacagctgtcttctctaccttctctcgaagtcctggtatgagggggacgtgctgtgccaccttacttttacttaggttct

SEQ ID NO: 1161 - DNA, 1600 bp, mus musculus
tgtctatgctgagtgttctgaccttcagacatctgaaggattagtagcctaacatttcctgaaaaaaagtgagcctgagaccaccaccagtctgtcaccacagggcctggacagggaactaggttgagatgactaccaagacagtgccaggtaggcctggacaggctcccaggacaggaagcaagccaaaggcgggaagaagccaacctgggacagcaggccccaggcaggagtgagcccaagacaaatggccgcacaggtgggccggtagaggagctggcctgagatgaacactaatctgtcgccctccaggcctagagggtggggacagatcatgcccaagatgactcctgccctgtgccatattgcacaagcagggcatagcactcctgagacctctcctgagacgacctcagaccctgagccacccgggcaccactaagaggagcaagcgagtcgtggagaaatgaaagagaaggagaagcagaaggaagtgggcacagtggagagagaggtagtgaggaacagcctgctgtgagtacccagtgctgctaccttggaccatggtggcctgtgctgccaccaggtggtcacatctgggtctgtggcccttcagcagcaggggtctgttactgccaaagggctgtacagaactggtcctacccttcacctgggcattgagaggagctggtcttagaggcacaagagtgggaaagctgattctgcccatagccagccacagcactctggagagtcggccctgcacattgtgggagttgcaggttagctggtcctgaggatgcaagcttgggagaaatggccctaccactagtctccctgtggcttggatgagagagggggcaggggagggggggggtcacccccttctgcggcaggcaggaaagctgaccttgacagaatcatgagagcaggagaagggcctttccctttacctgctgcagtacttggaagagcaggccctgcaccttatctgggcagcacaatggagctggtcatagatatgagggttatgggtgagccaaccaggagggtgtgagcgtgggagagctgacctgcctcttgtctgatatgctgaagtgtccctcaccctcaaccctgccacttagaatggcaggagggagacttggtactggggtcatgagagtagcagggacagtcctgcccccccccccccaactgctgcagcaatgtggaaagcaggccctgcatctcacctaggaggcagtagtggagctgagcctgatacggggcttgcagatgagcaggccccaaggatgtgagcacaagagagttggttctgcctgtggtctgctgggcagtggtgacacagacagtgagagacaccctcctcccctcactcacctttggggcaggcaggtgagctggccccagggcatgcacgagggcgggagagccagtgggctgaccatctctgacactttcaggcctggattcaggcctttgaattggcccaccccgacatctaccccattgctggagtcctacagatccaaaactacaggatcttcatgacaaagggcaacagcgggatgtctgagaggagccccagtgaggatcc

SEQ ID NO: 1162 - DNA, 1000 bp, mus musculus
acatgttcagcaatgccagtgtatgtgaggaatggggaaaggggtatgaaggaaggaagagggagagggagagggagagggacaggggtgctgtttctggagactgtggcacctctaggaggtgaggcttggtgggcagagaatgggtcactgcctgcgtctatctttgattggctgtgctgaagccctgttctccacttcctggtttgcctgcaagtgaaactcctaacatggtgtcactggtacacctgcttgcaatggcagactgacccctctgagaccttctgtaaaaagttaactccattctccttcagatggttccgtagcacactttgacagagattttgtcatcaatacagagctcaccagcaaagttgaggatgttaagaaaacaatgttcaacctgagtaccaaagggcagatagacgctctctgcccaggtagtcaagagtagggttatagtctcatgaaaggaatggggaaagattctgctttcgctagaatttaaggtgggggagacggaggaggtgtcacagtgactctgaggaatggtgctggagaagatgccaaagaagccgactggccttttatgctcagcggacttttgaaatacgagaaaaagcagagtgtagacggagaaggcaatggctttcccacctctgagtgtgggagaactagaagacaggtgaaatagagacccagtgacagctcaaacaccctctggtatccggccaccacaaaagccgcccaacaagcccttgactccgcagctatctgacaaagcaagaccaacaatcggtcatctccgcacaggaccgagcaggcttcccaccaaagcccttccccttaaactagtttcctgcagggtttcaatccacagctaccctcctcattacaaaactccgttccaccctctcaacacggggaaccggggaacgtcttgctggcatggggacctgggacacaaagatggggacttccagggaggaagaaagctgat

SEQ ID NO: 1163 - DNA, 1200 bp, mus musculus
agtttgtttatatagtggagtacactgatggacttttgtatattaatcaaccctgtgtccttgtgatgaagccttgatcatggtgaatgatgttgtgatgttcttgtattttgtttgcaagaattttattgattatattgcatctatattcataagtaaaattggcctgaagttctcttcctttgttgggtctttgtgtggtttaagtatcagagtcaccatgactacatagaacaaattaagtagtgttccttctgtttctattttgtggaatagtttgaggaatatctatattatatcctccttgaaagtctggtagaattcttcagtaaaaccatctggccctagaattgttttggttttgtgaggtttttaacaactgcttttatttccttaggggttctggaattctgtgggacagtggatatggaggaataaagggagtaggagaaaacccacatcccaccagagttccggtgctctgggcaggcagacgcagaggactgctgcacactttccatgcggccctgagtgggtgtctggctgtgggaagctatggatccagcccacagggggtggacaaggggcaggtctaggtctctgggcctcatggaggccagagataacagattctcagtctcaggcatcccagacaccactggacaccgcagaagggctgagaacaaaatgggacccctaggggctgctcggtcagtcaaccccggagccaaagggaggagagggcagggagagagggggcactgggtggttcccacatgggcaagagtccttggtccagtttgtggctggaatgcaggaaggccttccagcaggaggttagacgaagctctttaggggaaaggcaatctcatccttcaagcatggcgggccttgatgagcagagacaggggccttgatgagcagagacaggctatggttttagagctttattgtagaaaggcagagagaaagagagaagatataaagagaggggtcagccatgtccatgtggagagagggcagaagggagagagagaaggagatgagagtaaggatggtgagagatcttcaatttctttcttcaagagcttttattatattttaattttgtgtccttattttcacttaatcccagaaaaaattttaattttcttgatttcttctttgagcattggaaaaaatattatttttcttgatttg

SEQ ID NO: 1164 - DNA, 1200 bp, mus musculus
agtgtaattttgaaaaattattaagtactagtttggtaacatatattttcagggtttcacctcaagtaaagcaactcatccattaaatagaaaagtaaaatattcaagcaaacaaatgaagcttaatatgtaatcaaagcaattcctcaagcatgtggatccaggttggataaaacagctagaaagcaaaacagaaagtaagcaagcagccagcaaatgtgctgggaggcaacattcctccaagtttctgtgtcagttcctgttgaattcctgtcctgactgccttatgctttggactgtgacatggaagtctcaacaaaataaccctttcctctccagactggcttcttttggtgaaagggattttatcacagtaactaaggagcaaactagaaaaacctctctttgtgttggtagctgtgagttccagcaactcacagtctggctttccaagcacaaaacatcatcatagtccaatgtcatgggaaccaatgatgttcatcaacaagctttccaagctgggccttactgatgtgcatgttgaaggagagtcttgtaggccatagcttggagggtcagcagcttgtagtggaagattttatggtgtggggactcttcgatttttagcattttgcagattctttcttcttctgctgtctgggactggacatctctaccttggtgtcattgccaggggctattgcatctattgctcttacctcgtggtgacactctgcaactcacagatgactcttggtgttatgtcattgaaccttggatattagaactctctggtggattttggcttcccttgcacttctgctgatattatgggtagaaactctaaaaattggttttgttttgttttgttttgttttgttttatttttgtttttgttttccaactcaatgctctttacctgaaaccaagaccacatgggggctaattttattcaagcaaaatcttctttagagtttgatgatgcacttgtagaaaagtgtttgtgtgtgtgtgtgagtatacatgtgagtgtatatgtgtctgtgtatgtgtgtgtgtacatatgtgagattgcatgtaacatattgcagaggtttcagcagtcttgcccttcaaaggcaggtcttgcctctgttaaagtttgtttgtatgtggataagtcaagacctaaaaaaccaaatgactttttggtgacagaag

SEQ ID NO: 1165 - DNA, 1200 bp, mus musculus
acaaaagagagaagaggaaagtgcaatataaaatgaaaggcttgcgtctcatgaatgccactgagaaagtagaaattcagttcatgaaataaaagcatagatataaaagcacatatctctcaaatatttcacctagaatatgttagggtcctattgctgtgaagagaccatgaccatagcaactctaaataaggaaagaagataaattgggctgggatatacttcagaggattagtccattatcatcgcggtggtaaacactatgctatgcaggaaggcatggtgcttgagatgtagtttgagttttacttctggagcagtaagagagaatgacactggatgtgggttgaacttctaaacccttaaaaccagctcccagtgacacaattcctccaacaaaatcacacctactccaacagttctgtttcctatttgccctgggggagggggggaggttgccgcagtctctgacctgcagacacaagaatgacacagacaccatgacacagacaccaagaccggttcaagcagcttccgcagcttcctctttacctggggctttctttacttagggcaagggctatatttatacagtagcagcaactgacctcatattgctccacaccacctcatccaatcagaatcacacatgctccaggcacgatctcttatcagtcacagataggatgacagatctggatcacaaggaataatctaacttagcaggcagtttacgcatgcagtttcactgcacatgttcgggcaagggagtaaacatgtggatttcacagggtctggcaatgggccagggcgccatcttggcccatgtggccgtacccacttcccgcaggccattttcgttcaacccatcacacagaatcgaatgagtcaatggcaaaacaattactgatttagtgtcatcaaaaatgcaaatgggtgctactttaaataaaataaccgtgtggaaaataattgtattacagccatgagaatcttccaaataaaatccataatcagatttccttctccatattctccatgctgtctataatcaaaagaaaaatagtaagcttgccggtacatgcagagagccttctcttcattcatgtccaagggttagccaagagtttcgttgaaaagttaaataatgtcagattccctgatatttccattgtgaagaaaaatccaaagacatgtggg

SEQ ID NO: 1166 - DNA, 1000 bp, mus musculus
tctaggatctcctcagccatgactcagcagtgttgtatccaccctgaccagcaggaaagatgcaacaccacgttgtccttcttcaagcaggtttattcaggaacacttagcattgcaatgcaggaacaggaatctcttacaaaaccccagggtgtgccttcctactgactcctcccaatcaccccagtcacataatggcagtccataggttcacagcaagtgacctcaggcaagctgatgaggcatgacatctgtgcagtgcaggcagtggctgggatgtggctaagtctgagataatgaggaagtcaggcacaggtcataagacctggcagccatccagggcaccatcttggggccgtggctacaccagctcctcacacagcaggatctcaaaagtgactcagctgatacctaccttcattacagtttacccttgaaatcatatatttacctatgccctttgtatttcacaaaatgtttaaatgtgaaataagttgaaaataacagcaaacatcttctaatgttcccaaacattttcatctgttttcataacttccatatactattcagaagtagaatttgcacctcaagttgggtcatctggcaagaacatctgagtgattctcagagaaagaagataatgtaattcagagaaaagaatgggggtttggagagatggctcagcagttaaaagcactgcctgctcttccagaggttctgagttcaatccccagcaaccaagtggtggcttacaaccatctgtaatgggatctggtgcctgcttctggtgtgtctgaagacagtgacagtttgctaatatacataaaataaaccatcaaagaaaaatttggaggccagagagatggctcagcagttaagagaactgactgatcttccaaaggtcttgagttcaattcccagcaaccacttggtggcttacaaaccattaacaggatccgatgccctcttctggtatgtctgaagagagcaacagtgtact

SEQ ID NO: 1167 - DNA, 1400 bp, mus musculus
ttattcttaagtgaattaaaataatgtgtgacttgaatttgatggacagacgttgaatgtaataatggttgcattgtctttgaaaggaagtaacttacttctatggaaaattttaaaaagtgcgtcatcttgtgtgcttcatctgttttcataacaataatatagtctttaaggctatcttttaacttttgtgatttgcattttaaggagcatacaggttgaataatacagaggaaaaaatcactgactacatgttgctaacattttattacaaaaggcccatttgtattcaaattccatatgcatgagttaatgtgcccatgcttttgagaaggaagaaatataaacacttctataatctctcatttataccagcagcaggatttctattaaatttttgcagggtagaggctggagagatggtgttttgcttaatgatctgcagaagaactgggtttagtccccaaaacccacattaggctgttcacaactctcagtaactcagctgtaagggatccaataccccagtataggggaatgccagggcaggaagcaggggtgggttggttaatgagcagtggaaggggagagaggataggggattttcagatggggaaactaggaaagaggataacatttgaactctaagtaaagaaaatatctaataaaacaaaacaaaacaaaacaacaaaaataaatttcagaagagacaggtaagttggatcactgcttacgagtttgcactgcccttgctgagaacttgagtgcattactaatcaaggggctcacaaacacctgtaactccttcttaaaggacctgctgcctatggcttctgtgggtttttgcatgcatgtgtctatatgcacagacagacacagaaatgaaatataaactaagtcttacaaacaagaaatactgagagctaccctgaatctcagcacaaaggtagagtggaaaaggaagttgtgactctcttttgagtcccaattttcttctgggcattatactccacataagaggagtattggcctcattaggaaatatgagagacaaacatttgctcttcagcattgacgaatggaggcacataatgcacatgtgtataatatggcaccattttcattgtggctctgcctctcattctactattgccactttacagctagctgatatatggagagctatagcttgcacatcatagcaacaggaaatgtccatgagactttggggcatgaagtaaggacataggggaaagtagaagacttatacacaagctaaaaatagacaaggcataatgagaaatgcagtgattgggaaacagcccattgtcaactaaaatgagagcaaaagatatagctttccttaaagtctgattgctaactacagatttgatcaatct

SEQ ID NO: 1168 - DNA, 1000 bp, mus musculus
atctgcctcttctatcatcgaactgtataatatttagctaagttcctttctttgattttatttcttcacccttaattagaacagattatgaccagacattttataagtttatttctaactttaaaatgtcttgattctgtctttcactggaattttcatggcatgcagcatgctatctcagagggacctccatttgcttgccacccctcttcccacctcatcagacctgagcctcctgatcgatccatgctagcctcccttctcccatccatcttccctgcttggtaagccctctgggacaagcctagccaccctaagcacctgctagcccagggtcccatccattgtcctgttgccactctgtctaccaatattggacccgaggatcctaaaccatacagtcttgtaggtccaaactatacagcctaagccacatcaaaaccattgagtttcaccccttcagcaggaatagcagtggccacctttatataaatgccagggagtgcagctgcaatagcatctcatgcaggaggactgaattgaggactggctgagagaccaaagattacttgtgcagataatgccagccaatcaggaactgctgttaagaagaagagatgctttcttgctaccaatggttcatgagagaagggtgttaaaggagcttgcaacagtgttcagatgagcttgctgcagaattactaacctgctcacagagactgtgtccttgactcttcaccactttaccttcaatccccagaggctggtaaggtcagtcaatgagctgtttagagcacaggtaacacactaccatctgaatccctactttaagaacattcagggatcaaaacaatctagatggataaaggacctcaaaagaacacaaacaacaaaagccaggacaatatgacccctcctccaaagtacagctacctcactacaacaagccctggatatcctaactgaatcaaaacacaagaaaatgaccttaaatccaatc

SEQ ID NO: 1169 - DNA, 1000 bp, mus musculus
aaagtttctcaatgattttgatgattgttatgatagaatttagccaagaaatcaattcattccatctttagccagggaagagaagaaaaaggggaggaaaaggggggtgaagaagaaacatggataagagagaggaaaagagggccatgttggcccagggcagccagaagaaggtcactcaagcaccggctgttaggcattgccactatgatggatcaatgtgtgatggagagatgggaaagatggagtgcactggaggacagaaggaagagaaagcaatgccaaggggtttatacactgtaaagaatggtggaactggtgaagaacagacagatatgggtggggtcctgcccaggctgccatcgatggtcatgtctagatgcataatcatgctgtagttcgagtctgtgccaatgtctgtggcctgatttaccaccaaaggctaagcagatgtccatggtctgtgctgccatgggaaatcatgtactgcctctagggaacatgctaatctgaatagcatgcattgctacctgcaaccaggaggacaaccaggtccatgctgttgctgggggccatctctgggtccatggtccgatggcagtcagagtctgtgttgatgttctaggcttgtgatatcaccaaaggccatgcagatgttcctggcctagactgctgcctgatgcaccccacctcttgcctgggaagcacattaaagctggcttggtggcaaaagcacaagtgaactggccccaaggacatgagagtaagagagctgaccctaacccttgctgattgtagcactgggtgagttagccaggatagtgctggaaagcttgccctgattgtacaggtacaggagagatagcaggcctggcagactaaccaattcagctaccttgcaggccctttgaggcttcagggctttgagttggcccaccccaacatctaccccatctacatacgatctgctggagtgcaagaaagaaccagtcctgcaaac

SEQ ID NO: 1170 - DNA, 1000 bp, mus musculus
ttgaagagacaaccctgaatatttagcattccttgtttccttaagtgcttttacatgagcataaagacctctgctttctacattctataatgtatactttccctcattaattacaaggacactgtttagttgtgcctgttacaaactaggcctatgtggttgtgagtacaagggacattatgtgatatatgaagatctatccctttgggatccaggctctgaatacacaagtaaatggaccatgtgcacatgtatttggtcaagtggacaccagaatataagtgcagggagtcatgaagtaagaagatatccccttgaatctagagtctgtgcttcaatattcagacacacatgtaagtgccctgtgtaaatctcttcagggtattagacatatatgcacagggcatctaattgggttgagacagaacatcagcaactcacatcagcctctccaaaaagggcattgaagggaagaagtcttggaggaatctacttgcaagtgtcagaggatgctgacatggagtagccatggctatgcttctatcagttgccatttcaaactagtttcagaaattcacttgataatctgaggggatctagatcttggagagagtgccctgagtctgtattaaaggtgcatgtgttggagatatgctgaatgtcagcattgccctcaaaagtcaagctgaagcaaacacgaaatgcctctgagcccaggaattagaaaagatattatttggtggatgccatacagtgagaaagtgagcttcctggatacagtccaccattttgcacagctgtgatggatgtgccttggagaggcacagttctggggacttcatctctgtattgcttcttgctgttgctgatccttctcatgcttgtcattgctatattcctcctgtatttagtgttgtgtgaatggccatgagatcatcagtgcctatagtgtggtattcttgtttcttgggagatagctcattctgttgggcattttgat

SEQ ID NO: 1171 - DNA, 1000 bp, mus musculus
agcatactgtttggaagaactacaaagatgactgttgaatgattgcaggcttccctttacttgattatttttatccattggggcaatatggggtagtagaacctgcttattttgggaaggaaccttgaggacatgagacaagcagaatctggcaaggttcaaaactgtcagaaagaagtcatttggagaagtgcaaggtagctcttttagagaaatgaatcagtgtacctgggaatgaagggtgaataacaaattctatacactggtgcagcagaatacatattgcctcaagaggtatcctatgtggctgcagatccatggaattgtgggagatggagcacagagcaagagctgggttgagacatgtctaaactttggggtcaggaggagtaggactggtatacctcctaccccaggcctgcatatcccagcactgtgctcccacatttaggaggtcacatagcccagtagccgggtcaagcttcctttcaccttataagatcatgcccagcagcacctgaaattcctccttatgtgaatgaggcatcactagtgccctggctctggcctatgatgcatgctcaacttgaaatcccctgaaggttacagagcctttgttctcccccattaatgagctgtctcactgaaactgtctctgagagtttattctcattgtgctaacagacacctgagatctcttctgctccagcaggctgatcacaccctgttggacggggaagcagaatctgaacggtagaatcccatatcagggctttgatgaatcattggacaagaatgtctcaactctgagtggactatgtctagtttggagacatggatttacagaactggtaatctgagtagtttggtgttatagacacagcatatcctctgttttcattctcatgggttctaacatacatttatatcacagtaactatgatattccagataggaactttaagcttattaggtcttgatttccttatataattttctg

SEQ ID NO: 1172 - DNA, 1000 bp, mus musculus
agcatatatacagcaacatttaaaaacttaactagtacagggtggcttgtaggtataattaggcactcaaacaaatgcctgccagttgaatatggctccatcttcagctagctatagtcgtctccttatagaatagtcctttagcttcattaactccttgaaatatctcactttattattacaggttgtgttcttcacttggttgtagatatgtagaaagactcattttccatacacaattctgggattgactttttgttttttaatgtattataggttctctctgtgtgtgttttgtacgtgcacatatgtacatttgtatgagcttgaacatatatgtggctctgtgtatgtacatttgaggttatgtacagagtcttccttgattgtcacactccaaattagtcattgaaactgatcctctcaactgatctcagagatggttaatatggctggtctagatagccatctttctcttaagaccacctgtcaaagtcttctgagtaccagaattacagagtggttgccatatccacctgacatttacatgggtgctgcagatctgaattctggtattcatgctcacttgtcaaatgttttaccccctaagccattgcccctgagtttgctttccatcatctgcaagacttgctaaagtttatttctatgataattaattcacaatctatgtatattctgcatgctgctgttcatcagatctccctgaccatttaaatcagtgccacttttcttttcctcaaatatgattttttttaattccatgtgattctttctccttctgcttttcattccattttacagctcatcattccttttggaatacattcttcttaaaggcatgattcatctgtggttatttttgcctcacaagtatgctgtgctttttactattaaatatatattttatattgtagtttccatcaattagatagtctttgtcctttaagtcttttatctgtaatctataatttttaacacg

SEQ ID NO: 1173 - DNA, 1600 bp, mus musculus
agaaagtagccaaggagctaaagggatctgcaaccctataggtggaacaacattatgaactaaccagtaccctggagctcttgactctagctgcatatatatcaaaatatggcctcgtcggccatcactggaaagagaggcccattggacttgcaaactttatatgccccagtacaggggaacaccagggccaaaaagggggagtggggggccggggagtgggggtgggtggatatgggggacttttggtatagcattggaaatgtaaatgagctaaatacctaataaaaaatggaaaaacaaaacaaaaaaaaaaaaacaaaaaaaaaatggcttcaatggtaaaactcagaccaggaatattctattgtcataaaacatcattataaaaccatgctagcacgttatcctggtgactggactctaattcaatacaccagatcttaactgtatgatagccacatgagcaaacccactggaagggacaccacagtccaggacacatgggaaatgagccacgttccagacaaagggaagatagtgtgtgaaagcgctgtctgcgttaagacaaagaccaaaggaatggagcacagactccagtgtgcttatggtagagaataagagatcgcgtctgcccctgtggatgacgggtgtcctccctgaggaggctcggccttcagtctgtccatctgtcacgtgcttttagccattgccctgacccatgccgtgacccatgccggatgcatactctgcaaatccgttcccaatctctgggttgtttcctttactctgagcatgctcccctgcagatgtacttcacaagtaatgcctagtgtgtccgcccttgtcgttgttgcctgcgcgttaggagtccttagagcgttgtttcctgagacaaatggcgccaaagcctccccacatgctctttcagtggttttatcatttcagattttacatttaagtctctaacccattttgagttgattttgtttgtttgttttatgataggagctcatttttctacatttagcaattctgtcttctcagcactatttattaaggagaatgttcctgtctacgtggacactctcggtatctctgtcaaagcccttggttgttagtcactgattacttatttccaggtaatctatattgtcctgtgggtctattaatcatcagagagatgcaattcaaacccaccatgagatatggtataacaccagtaagaatggacaagtgctgttgggaccaagggaaataaggaaccctcacattgtgtcggtgggaacatgttaatgcattgtcatcatagaaaactacatagtggtctctcaaaaataaaaaacagaaataccttgtgatccatcgattacactttatatatccagagtccagagccctcttctggactctataggcacctgcatttgagtgtacacacatgcagacagacattacacgtaattaaaagtaaagtaagtctaaaaaaaagaaagaattctaaagggagaacagaatcaatcaaggtttgaggcccgattaaacaatgctgactagaaggaatactactgcagcctttatattcatgtaacactcaaaa

SEQ ID NO: 1174 - DNA, 1000 bp, mus musculus
cctgcatgggacataatggctctcctagactctatagctaccatacaaaaacacagagataggtgtgggttacctcttttctaattgttggtcagtggggtctcacagacctccacaaacagtacaggtgatggtcactgctcttggttgtcctccaggatccttgatgataaaaacttattgctgaagctgacatgtattgagacaaagaacatggagaaagttagccgataatgacctggaagcttcatccctaaatgggtagctttcatagtgctagaaggtgctgtgctgtgtatagtactgaggtagagaaagaatgaacagtgctaatcagctgcaaatcctgtgaactacaaaaaagtgtatgctagtgcatgcccataatcccaacactcgggaaaggcggacctcactgactttgaagattagcttggtctacataatgacttccaaactagctaggtcgacatagtgaaatccctctttttttgtttgtttgttttttgttttgttttgtttttgtttctctgtgtagccctggctgtcctggaactcactttgtagaccaggctggccccaaactcagaaatctgcctgcctctgcctcccaagtgttggaattaaaggcatgcgccaccactgcccagcgtgagatccttttaaaaacaaacaaaaacataaacagataaacaaaaaacctaatcaaccaaccaactaagcatcaaccaaaaagatctaaaaggttcttaacatgtaccatatgtcttataaacatggcataaaaatgggtcctagaggctggagagatggctcagcagttaaaagcactggctgctcttacaaaggatccaggttcaattcccagcacccatatggaagctaacagctgtctgtaattccagtaccagggatccaacagcttcatctggtctctgagaacatcaagcatgcataggaaacatagccatatatgtaggcaaaataacaatacacataa

SEQ ID NO: 1175 - DNA, 1000 bp, mus musculus
tttatggagctccgaaccagcagcgtctcttccaaaaatcctttgccgtttctcagtcccgcgttggttcgccaattgttgtgtccggccagcagaccacaacctgggttctagcctggaaaggcattttggaaacctggaagagaagaggggctaggtggcgagagaaaagaatgtagctaagacagttactctgatcaaggctcaaattttattgttgcgacactagttatgaaggaagggggaggggtcccgattcccgccgaataatctctggtccagtagaaaggtgcacgtgtgtggctctgcaggttccagcagtgggcgtggcagaacgaatgagcaggaagctccacccctgagcaagcaggtttcaggctgggggaggggagactacaagtacctattaactcagagtgcctggtcaaaattgtagcctccctcagccttgaagcaggctgatccagactttgaccttgctgccactaagaaggagattacctagggtagagccaagtcttcagaaatccctgctgatctcagacgcctgttctcacagctcagataccacagagataactgaagttattgaatcatatcaattccaacggaacagagcacagtttctcattgccttgcttctatttcttgcatctatgaccttgatggctctatttgctcttctccaagactctgcttcctgctgaaaggtgcttgagatattccggagacacaccctgtagatcgcctgcgggctggctccaggaaccaagaatgggctggcgggggatgggcctaccctctttataagaaaggactctcagtaaacttcagaggctttgaacagaaagatttgtcttggcctcgttcttttctcaccgtctgatctctttcagccccagcccgagtttcaggggaacccagttcacgtggccgcaggcggctacaaaaatgacctggtagattacagaactcatttcaaataacagccatttgacag

SEQ ID NO: 1176 - DNA, 1000 bp, mus musculus
taggctgtctggccctcatagcaaaccttattcccaaagtcagaccaaagccacaatatgtacttagaatgcttcctcaatgaagatttaataactgccacctgcgctgttggaggcgaggatgcacacctgctgtagtcaggctgaagggcgttgactgacctgcttgaaaaacaaagtcaagacagtgaaaagcaacagtacaaaagcttctttgggaaagtccaggtactcccttaattgtaaattagcaacgatcaaggtaagacttagagctccaggtatgggggaggtgactttgagaattgcagaaagtctgcagcttttctgggggtggaggctgtgctccaaattaactttgttaggtaattaagaatatttagctatcttccctgggattctctaatactggaattattactagaccagtccaagattgagttagaataactggtcacaatgagggaaagagaagaatcattataattctttcttgtgactaatatttttaagtcagattacacagtctctgatgttctttttaccataaggtttaaaagcttgaagcaaggcagcttcgcttgtccaaactggaaaaatggcaaacaaggatgggtcgaaaacatgtacccaattcaacttcctagtcactacagtcagggcactgagcgaactcacctgtcttgtcacaccaattagctgtcatgcttctgcagcattctgtggagagaacctatgcttctccctttcctaataaggtagctgttcaggatcaagccatatgccaataggtagatccttttaagatactataaggcatttattaagttctttgacatccaaatttcaaaattctaaaataaaaggatgatttaaataatgtgcatgggaatacattaaataatatgcacggggatataatttccctcttctttgtcttttaagaagctagagttttaaagttccacaataccttgtccttgagaattaataatttgtt

SEQ ID NO: 1177 - DNA, 1000 bp, mus musculus
taccctgaacccacatacaaaaatgtatgcagttgtaatcccaatataagggaggcacagcagctagcttgatctttgggattttgccaagtttgctcagtagtgagctccaggttaataagagatttctgtgggagcggtagagagcttttgaggagcaacacttgaggttgacctctggcctcccatgtcaattcaatatatgttggaatcatttgggaaaaaggaaccttaattgagaaaatgcccattgtgggcaagtccatgggaacattttattaattagtgattgatgagggctggtccattacaccaggtttgatgtcactcctgtgtaagtggttctggatggtataagaatgtagtctggctcctgcctcaccaaagaacacattagcattcagaatcgtaagtaagtctgcacctgaagaccaacagcactcccacagcacctgaccaccatcccctatctaccctcttccccttatcaccatatcctggcccacacctgtactaccagaggccatgctgacaagcagaatcccaggtagtgtcccacttgtggactactaacacttccttatgccttccaatccttctcctaaccaccaatcttatccttatcaccatatcctagcagaggtcacctgctccaccagaggcctagaaaaccccagataggctgttcacaggcagactacccccaatatctcagtgcttgtccagtccaccccagtaggacttcctctcttagtcaccatatcttggctggcccctaatttgtgctgaggacccccagctagatcagagaccatataagttgccagattccaagccccaactctgctagaatcccactgctcaagcaaaggccaccatagccatcagaaatccttcctgactttctaatcaatcagagggcagtccaaccagaatgaaaggaaggaaagaaaccaaggagcaaaacatccatccaacaaagacaaactcagaaattggc

SEQ ID NO: 1178 - DNA, 1000 bp, mus musculus
gctggtgagcagagcactggggagggaaaggggatagggggttttgggaggggaaaccaggaaaggggacaacatttgaaatgtaaataaagtaaatatcgaataaaaaatcccctaaaaactatctttaaataccagaggaagaacttaaaaatctgccaaatatatttaaaccacaaaacataattttagaccttgggtgagaacttggtggacagtcccacggtccccagaggactctgcatgctgaaggtgccctagcacacacaggatcttgggatcactggtgagtgaaatacaacatctcttccaaaacaaccagcaggaacagggacactgaaacctgcccgaccagcagctggggttctttcctgtaggcaaaagacctgggccaccttcggcacaaattgcagaaggtcccacagtccccagaggactctccacatcgcaggcaccctagcacacccaggatcttaggatcactgaggagagtcagcctacagagagggctctgaccccgggactcagatgagtgagccatcttgtatcctgggtctctcagagaccagaccacacaggagagcagacaggcctcagaagcaacagagcttcttggacagggtcccttcaggccttcctcttcagccaggaggcagagctgagcaccagacctctgtgtacctttcctgcaagaggaaagcttgcttgcagagaatgctctgaccactgagactcaggaaagagttggacccctaggagtgcttcacagaggctaatagaatcacaggaggaacaagctctagccagagacagctagaacatctaacaccagagattaccagagggcaaaaggcaaacataagaatcttactaacagaaaccaagactactcggcatcatcagaatccaatattcacaccacagcaagttctggataccccaacatacccaaaaagcaagatttggattaaaatcatatctcatgatgctggtagaggat

SEQ ID NO: 1179 - DNA, 1000 bp, mus musculus
gctggactagacctcacatgagcttccattttcctgcctctacttctcaagtgctgctactttaaacctgagccagcctttgaagtttttcctaaaagcacactgcccttgtttgattgccaagcagttgaatagttccagtgagctgcaggaaccactccatgagtgggcctcctaatgaagcttctcctgaaatgatactactctgttaaacacccaaaaatacactgcacagtgaaaaatacattacagtctatctgacaagaaactagttctagaatattcagaaaactcttcatgtgcaatatctaaaaagaaaaacaaacccagtccagcaccacagggaccctgggcaaggaataagcattagatgacccctgctccatgccacacaggcataggccaataaacccataattcctgctggtgacacactgcatatgcaggacctagcactcctgagaccactcttaagacaacccagacacccagaggccccaggaaccactgagatgaacgagcaagtggtggaggaatggaagagaaagagaaacataaggatgtgtgcataatgaagagggagaactggagatctcaaggtagtaaggaacagcctgatgtgagtagctagtgatgccacctactatgacagtggggttctggcctgtgctgccactgagggccatgtctgggtctgtggctctggagtagcagaggtctataaccaccaaagactaggcagaagtccatgatctgagctgctgcttggggcatgttaatgtttgagggctgtgcaaagctggctccgccttcagcctggacatcctaagagggctagctccaaactcatgagatcaaaagtgctagcccttccccttatgtgctgcagcacgtgggagagcaggctaatgagctcagatacctcctaagcccagatccagggctgtgagttgacccaccccagtatctaccacatctatgttatggtggagtatgtgaa

SEQ ID NO: 1180 - DNA, 1000 bp, mus musculus
gactgaaggaagggccatccagagattgccccacctagggactcatcccatctacagattcttggcactattactgatgccaagaagtatttgctgacaggaatctccacccccatagctgtcccctgagaggctctgccagagcctgaccaatacagatgcagatgcatggagccaaataacagacttagcttgaggaccccaatggagaagttagaaaaagtagtgaaggggctgaaggactttgcaaccccacagaaagaacaacaatatcaaccaaccagaccccccccccaaaagctcccagggactaaagaaccaactaaagaatacacctgggggaacccatgactcaagctgaatagcagcggatttctttatatggcctcagtgggagggaagcccattggccctatggaggccaagcataggggaatgctgaggtgtgggcaggtgggggagaacactcatagaggcaggggaggggattgtgagttcatggaggggaaactggaaagggggataatatttgtaatataaataaataaaataaccaataaaaattttaaaacattgagtttgaaaagtaccctgcacaaaacatctaggaaatcgggacactatgaaaagaccagacctaataacagtaagactaggagaagatttccagctcaaaggctcagaaaatatttttaacaaataaaagaaaattctccttacattaagaaggctatgcctatgaaagtacaagaagagccatcttggttcccagatcctgccgagactactctgtgcaggtgagagtgtggactacagaagctaaaagcttctcagacatgcagaagccacagagcttctgaggaagaccccgttttgggcaccagacatctgggcaccttccctgccaaaggagaggtgtctgccctgcctggaagggctttgccacagcatcttggggagccaattttttttcaaggattccgatgagactagtctgcgc

SEQ ID NO: 1181 - DNA, 1200 bp, mus musculus
aaatgttaaaagttattgcatacaactttagtattgttgtgtaactgtttccttcgaaatcaagacattccaccctacaggaaaactccttaagcagaagcttaacttagaatagcttcaaaagtgaccagatctaccaggcccctccctgccaaagtaagcaacagacattgagagtcagaaagactcagaaagagcaggtaaagctgagctgcaaagaagtggatcagctgccaggaggaagcagaaaccagctaagtagcctggaagagaacctggaaaggacatgtcctaacttgttggactgcctgtaggctgtgcagtatgttctatgtttccagccttgggagcactcacatttgctgcggtgggttttgttgatggagctgtctttgagttatttctgcttctgtaagaaatctctcagccatattcctgtaagttacctcaataaaactcgtttgttcaacatgttggactttggtggtattcatgctttgctctgttgtgggatccctattctggggtgtagatgtgtgttgtttttcttcagaatgatgtttttttcattttttaaacacaagtatacatacattatgcatacatagaagataagcacattttttgtgtttttggagacacacacacacacagacacacacacacattcctaaagtccaaaaagtaagattaaaaaataaaggcacttttggtcccaagcacttcagaccagtgacatttagtctgtatttgaaaactgaggaattgaaggaatagacactggggttcctattggaactgcatggccgttgtcctccttgtattgaggtcgctgcagcaggaatgttttagccgtggtgaagggtaatgaatgcatgagcagataacaagcactgagagtcctgatgcacaaggtgctgggcagacttcacaggcacgacccagatggtctctgttaatgttatttccccatgaggacgttgggttccaggaggttgagtaacttgggtgaggtctaacaggagtctcaatctatgctgttttccacaaagttatacttggagcactgagatctactgacaactggaatggaaggaaattattcataatatacatattttagtagatttacaaaacagtagattttatgatattttatatgtatctatgtatgtaatttacccatccccattcatatat

SEQ ID NO: 1182 - DNA, 1000 bp, mus musculus
cagcaccttgaccttagccagcctgcctccaagaactcgagaggcagtttctgttccagtcgctgtgtgcagctgagtgcagagctctggcatggattcattggagacactaccagggcggatgggtgcctgcctcaggcattattgtttctaggccagtggtttaaacatcaaactgcttctgcagacacgggttgtgtttcagatgtaggcagcatgggtgggcgtgtggagtcccgactctttaacagttcccactgctgctgatgcttcagctgccacatgacagcgggagagcgctgggccgggtagtatgttgaagaggttcaggcaagagcttagaatacaggtagggattttttaccacccagccgcagaagtggttcataccccaggagccactgtctgtgaggcagggataatatttactcagtttatctcataggattgataaaagtagatgcatgaagagatccatttgaacctcctttgcttttcatgcaaagcagcctggtggagcagggagtatccatcgttctccgccaaaaagaaagaacataggagaatactgacgtatcctagtgtaaaccacagcctaaaggggtctcctatcgttcttcactgtactgcttcacagggtgccagaactcgggctcctccctctccacacccaggactcccccgtctctctccctacacaccactccaccttctcttgaacgtctgcctgttggcctggcagcctagatcacagtctgtggctccatatttggatccttctctgtcaggaatgtctggatgtcttcgagactgtggggttgaagctaagaaacctgctgtgtttcttctcaagtgtgctcctgctcctgcccctgtgcaggtctcctcaagtgtgctcctgcctctgtgcaggtctcctcaagtgtgctcctgcccctgtgcaggtctcctcaagtgtgctcctgtgcaggtctcctcaagtgtgctcctgcccctgtgc

SEQ ID NO: 1183 - DNA, 1000 bp, mus musculus
aagtgaacaattttctggggaaatgcagattacataacatctctcaaaacaaagaagagaaatgaattgactataacatagtaaaatggaaaaaggggtcaaaatgttgaggagctggggtttagctcagtggcaaagtgcttgcctaatatgtgtaaatccttggcttcaatccccagaactgaaaaaataactagcctttacaagttgcagcaggactaggcagataaagctgcccagctaggggaaagggacccaaaccaggcaacagagtcagagacagtcccagctccacttcttaggggaaccacatgaagaccaagcttcacatctgttacatatgtgtagaaggcctggggtccatctcatgcgtgctttttggttgatggttcagtctctgtgagccccccaagggctcaggttagtttactctgtagatcttcttgtagtgtccttgtcccctccagtccctcaacccattccttcactctttcccaagactctccaagctctatcctttgtgtgagggtctatgcatctatttccatcagcggcaggatgaagcctctcacatgactgtgatgctagggtcctgtctgcaagcatagcagagtattactaatagtgtctggaattggctctctcccatgggatgagtctcaagtttggcagtcattggttgctcattccttcaatctctgttccatctttatcacacatcaaaggttggctttggtcaaaggttgtgtgggtgggtgaccatctgcatttgattcccagcaaagaattgacttcagtgagttgtcctctgaccctatgcaggtgccatgcatggcactggataccctaccccaccatgaatgtacacatatgcaggtaaataataccatgattaaaacataaacttggtaaagaaaagagtaaaaaaagaaagcatagaaaaatttttcacaaatataaaacagaagtgtttaaattaaaatacagcagatattaactc

SEQ ID NO: 1184 - DNA, 1000 bp, mus musculus
cttctttatgtcctctaccatcatcatgagatatgcttttaaatccaggtctaccttttcaggtgtgttaggatgccctggactgggcgaagtgggcttctgggttctgatgatggtgagtggtcctggtttctgttagtaggattcttacgtttacctttcaccatctggcaatctctggagttaattgttatagttgtctttgtttagagattgttcctctgttgattttgttactctctctcagcagacgtgggagactagctctctcctctgagtttcagtggtcagagcagtctctgcaggcaagctctcctctttcagggaaggtgcacagttatctggtgtttggacctcctcctggctgaagatgaaggcccaaaacaggatctttcccaggagctgtgttgctttggccaggaagggggccagttgtctggagccgaagatggcgccgcctcagatgctctctggctctcgcctggcccaggaaggtggccggttgtctggagccgaagatgacgccgcctcaggagctctctggctctcgccaggaaggtggccggttgtctggagccgaagatggcgccgcctcagaagctctctggatctcgcctgtcccagaaacggctggcctctgtattccacaccgtcacccgtgcagcctgccctccgcggagtcccggagccaaggaggctcccgctgccggggcctgaggcagaaacctctcgggccgcgcggacccctgtgctctcaccaggaaggtggccggttgtctcttgttgccctttctaagtagtattgaagcatccacagtttagtctttcttctttttgaacttcatatggtctgtatcatgggtattccaagcttttttcctaatattcacttatccaatgagtgcataccatgtgtattcttttgtgatttggttacctcactctgaatgatattttctagttccatccatttgcctgcaaatttcatgaagtcattgct

SEQ ID NO: 1185 - DNA, 1000 bp, mus musculus
ccttcttaaaatcctctaccagcatcatgagattgagatacgattttaaatctgaatcttgctttttgtgtgttttggggtatccaggacttgctgtggtgggcatactgggttctgatgatgccgagtggtcttggtttctgttagtaagattcttatgtttgccttttcaccctctggtaatctctggtgttagatgttctagctgtctctggctggagcttgttcctcctgtgattctttagcctctgtcagcactcttgggagtcgaactctctccttagtcccagtgatcagagcactctctgcaggcaatctctcctctggcagggaaggtgtccagaagtctggagctctgatccatctcctgagtcctggggtcagagccctccctggaggctgactctcctctggtgaggaaggtgcccaggggtctgggtctcagctctgcctcctgactgaggatgaaggcctgaagggaccctgtccaagaagctctgttgcttctgccacccacgtgctctcctgtgtggactggtctcagtgatcccaagatactgggtgtgctagtgcttgctgagttcgcgcccaagatggctcagggctggtgctgccaggaaagaaccccagccactggttgggtggtttcctttgtccctgttcctgctggcacaagaccctcggggttttttggaacagatgttgcattccactcaccagggatctcaagatcctgggtgtggtagggctcgctgagttcgcacccaagtttgtgttccatttttaagggcttcaacctgtgttctcctgtatttctttaaaggagtttttatgttcttcttaaagtcttctatcatcatcatgagatgtgactttaagtcagaatcttgcttttctggtgtgttggggtatccaaggctcactgtggtgggagaactgggttctgatgatgccaagtagccttggtttctgttgcttattttcttgctcttgcctcttg

SEQ ID NO: 1186 - DNA, 1200 bp, mus musculus
ttgttttttattgaccgtctattgctgggtatgagtcctggccttaagggttgtttttatgcaaagtgagacactgttagagaaaggtaaagctagtttttcatttgccagtgataatcacttggaaatagtttctgggctagggatgggggtgggggggtttgcatccacttccactctttgcactgaaagctcatcaggcccagacctgcgcaaggttctgtgagttcatatttacattggtccttatgtgtttagaaggccttatttccttggcattctccatcccttctgactcttaaaatctttctacatgctcttctccagggtcgcctgagccttaagggagacatcccatttaggactaatgactccaatctttctcacattgtccaatgtgggtgtctgtattgattcccatctaccataggaggaagctttgctgatgacagcttagcagctccctggtctatgagtgtagcagaatgtcgttaggagtcattttgctgccttgtaccttcagtatgtggttttcttctaaacctgttgcctgtctggtgttgagttcatggctacctgagcaatgttggaaattacttcaatctcatggagatggaatgctaatcaaataagatgtgggtcggttactccctcaagttttatgccatcattgctctagaacaccttgtagacaattgtccattgtagaccaaagggtttgcagctaggctggtgtttacctttgttttttggtagcatgcagagtactttccagtaccatggagctcttaacagtggcacagatagtacactgagaaggggatttagtacaaagtaggccttatgggccccatgggttttagctttctggttctggtcaaatgttttcctgactatgccctgtgatcctgcacctcttgttcctgtttccatggattaaccatgatgcactatattcttttaacccaagagccaaagtaaacccttgatctcttcagtgtctgctttgaagccctttatccagtgagcaaggtaaccaccatgtgagctgtgtgtttaagcctggtgtttgatgccttcattggacataagcatgtatcttatgtcaagttcacaaaacctcttgataaaagagaactgggccccttagaaagtggcagtttctaggataataaataaggaagtggtttaaaagggtga

SEQ ID NO: 1187 - DNA, 1000 bp, mus musculus
tgaatcttgcttttcgggtgtgttggggtatcaaagacttgctgtggtgggcatactgggttccaatgatgccgagtggtcttggtctctgttattaagattcttacgtttgcctttcaccatctggtaatctctgctattagatgttctagctgtctctggctggaacttggtcctcctatgatctttagcctctgtcagcactcctgatagtccaactctctcctgagtcctagtggtcagagcactcttttcaggcaagctctcctgtttcagggaagttgcacagaggtctggaactcagatccacctcctggctgaagatgaagaagctctgttgcatctgcagcccatgcactctcctgtgtggactggtctctgagaaacccgacatatatgatggtgttctcacctgagtcccggggtcagaaccctcctggagcctgagtctcctctggcagggaaggtgcccagaggtctaggtctcagctctgcctcctggctgaggatgagggcctgaagtgaccctgtccaagaagctctgttgcttctgttgcctgagtgctctgagagacctggaatgcaagatggcgctctcacctgagtcctggggttagagccctctctggaggccaactttcctcagtgatcctaagattctgggtgtgctagggctcctgtggcatggataatcctctggggactgtgagactgtctgcagagttcgtgctcaaggtggtgcccagctggtgctgaccagaaccaaatattcaagtattaaaagaagaaaagtcaaacgttcttatctcatgagagtaatactaacagaagctgatactctcatcaaacaggaaaagggcaacatgaaaaaaagggaaaggtgctatgagactgggtgggaaagtcgacaagagtcccacggagtttggtgcccagtccattgcagctgctatctgtaatctatatgaatggtgctgaaggcctggaaggctgttaatgt

SEQ ID NO: 1188 - DNA, 1000 bp, mus musculus
cctgtcaccctcagagacttcaccgcttggatcatcaatgccttttttccttttttaaggagtgggttggcatgttagcctggggattggtggtcctcctgggatgtggtttctgcctttgactcgtaggtcgctttaagagagatcatgccatatacaaggctgtggtatatcaggccatgattgccgtgaagatggcacatctcccaatatttggctggcctctgaaaaattaagagtttgccctaggtcaattggcagttgtagtcacacaaatccacagtatctagagacgggcatctttcctgtgcacagatcaacctaagacatggggcctggagacggtagggtaaccctatgatgggtaaggctgtgacactagaggatcaacctaagacaggagccgtggccgaaggacagatttgcccagacctagtccagcatcatattattaaacaaaaaagagggagatgtaggaagccaactctaagatgatgccggtttccattgtgccgttgtcataaacaacaccactgcgcaggcataagcctgagtctggcgccaacccctcccgagcgggtacatgctaattaggtgacagtggttcaacctatcccaggaggacacgaagcctttccctgtgctggggtgcatataagcagacctccctcggtgcccggggtccccgtagcagcattgaggtgttcctgcaataaaggctgttgagaagaatctgaccgtgttgtgtcttccttgctggctgaggtgggtgcaacagaatatagagatgaaaagacctggaactttcaggactgtgcatgaagattttggatgtctttggttagctgtaacatcaggaccatgtcagtagatgaatgcttcatgaataagatgataaatgcattactagagaatgaacaaagggactataaagagaaaatatgggatgatgaaagaaatgagaagatgatatcaaggtggggtaaccaacagggctaat

SEQ ID NO: 1189 - DNA, 1400 bp, mus musculus
gtatttctttaagtgagttattaaagtccttcttgatgtcctctaccatcatcatgagatatgcttttaaatcccggtctagcttttcgggtgtgttggggtgccctggactgggcgaagtgggagttctgggttctgatggtggtgagtggtcttagtttctgttagtaagattcttacgtttacctttcgccgtctggtaatctctggagttagttgttatagttgtctctgtttagagattgttcatctggtgattctgttaccctctatcagcagacctgggagactagatctctcctctgagtttcagtggtcagagcagtctctgcaggcaagctcacctcttacagggaaggtgcacagttatttggcgtttgaaccttctcctggccgaagatgaaggcccaaaacagggcctttcccagaagctgtgttgctttggcctgtcccagaagctgttaatttcagtagtccacactctcacctgtgcagactactttctgcagagtcctggaaccaaaatggctcctgcggatcctgaggctagggcctcccgggctgggcggacacctgacctctggccgggaaggtggccggatgtctgaagcccgataatggcgatgcctcagaagctctgtggctctcgcctatcccagaagctgttagcttctgtagtccacactctcacctgtgcaggctgctttctgccgagtccgggtggctcctgctgatccgagtcaaaatcctagcctcccgggccgggcagacccctgtcctctggctgggaaggtggccggatgtctggagcccgaaaaaggtgctgcctcagaagctctgtggctctcacccatcccagaagctgttagcttctgtggtccacactctcgtctgtgcagacaactttctgcggagtcccagagtcaagatagctctcgcagatcctgaggcaaaaacctcctgagccgggcagacccctgtcctctggccaggaaggtggccgggtgtctggagcctgaaaatggcgctgcctcagaagctctgtggctctcacctttcccagaagctgttagcttctgtagttcacactctcacctgtgcaggctgtaaagcacacacatatataacaaatgttggtgcacttgcatttgagatatcgacgttcagaatttagatatcatcttggtggctttccttcaattcagtgatatttttcatgtcttttgattaatttgggttgtaattctattttattatatatttgaatggctactccacttgcttcattggttcatttgcttggaaaatcacttttcaggcctttactctgaggtaatagctatctttgatgttgtgatgcctttcttttattcagcaaaatgatagatcatgttttcaca

SEQ ID NO: 1190 - DNA, 1000 bp, mus musculus
gtggcattgagctaatcattattttaagaggaaaactctcaaaaggctttgtagaggccatcttcatttcaactacttttttgaaaaaatatatttttaacgatttttatgtaagtacattgtagctgtttcagacacaccagataaaggcatctgatctcattacagataattgtgagttactgtgtggttgctgtgtggttgctggaatttgaactcaggacctccagaggatcagtcagtgctcttaaccactgagccaactctccagctcttgctcaggccctgctcgctctgaccccactcactgtagctgtcttcagataacccaaaagagggcatcagatttcattacggatggttgtgagccatcatgtggttgctgggatttgaactcagttaagagccgtcagtgctcttaactgctgatccatctctccagccctcaactgcttttgattgattattttaaattacacgatcttttcagatggtttttatgacttgttgtgctgagaaatctgaagtgataactggctacaccaagaacttccgctaacacttttgtcatttttacaattgaagcttctagggcaactccggggtatcaaactacctggttcaaatattgaaatctcctaagcctcaggaatcagagacaagggcctatcgtcttttaaaacaccagaaactcaactgttgtaatacactatgtgcccacagatctgtgcctttaaaacagcctgcaaggggcaaacgcttggaacagagagtgcttgagtgaaaggccaactggtccctacctcacacagccctggggcctccagcagggacggtacacatgtagaggcttgtttgcatctgtctttccttttctgtgttttcaagttattggaaacctagatttgctaactgtgtttatagtcttacctttccaagtgtgttgtgtaggccaggcagtgatgctgcatgttcttaatgccagcacttgggaagcaga

SEQ ID NO: 1191 - DNA, 1200 bp, mus musculus
atttctccctgcaaaaggtatttaatctcaagcccaccctgagaagggagtatggtacattatatatccattttctgccatgaacagccaataaactgtttggaactatggactgtctttttttcatcaagaaccacagtggggagccatgaagaaggcctttgccttcagagccataccctactcccaaagaaggcctctctgcactcctagccacaacctccaccaagcctgcctcagccaagagaggaaaattcaccccaagagagaagctggagctcccatcccctccctggccccgggctcgatgtagtctccagcctatgggctcccattcggttctctgctcttccaagactcacagcgatgcctggttgtcctagagtctgaaaagcccacagcctcagccttgtcacaggcccagctttcccaccccaaagcagtacctcgatgcttccctacagtccagcacctgccagcagcatgggataaacacagtcaaactcccttgttcagcttcccccaccacacaagagcctatgggtgggtggcctcatgcttcaactcggggccatgtctatcttctagaggtgatctttttaggctctgtctcccaactattgggcatctcaactaaggtcaaccccatttagacctggaagccactcatatcccaggtctctgggactttctaggtccccaactcggtccctgctgcccccactgctgctgcatattttcactcattctcctggccctctgggcttctctcctgtctcaccccatacctgatcctactcccattttcttttccacctcccctctcccacccaggaccctccgtccctctgcctctcatgattattttgttcccccttctcagtgggattgaagcattcttacttgggcctttcttgtttaactttttttttttaagatttgtttattttatatatgtgagtacactgtagctatcttcaggcacaccagaagagggcatcaaatcctattacagatggttgtgagccaccatgtagttgctgggatgtgaactcacgacctctggaagagcagtcagtgctcttaaccgctgagccatctctccagtccccttgtttaacttcttatggtatgtggggaatattattggtaccctgtacttttttgctaatattcacatcagtaagtacacaccgtgtg

SEQ ID NO: 1192 - DNA, 1400 bp, mus musculus
aagcccagtgtttactcatagacagtatacatgggtcaaaagcccagatattatacacatgatgctctacttagttgtagttctaagttggaaaaaaacagattgcaacaaaacgtttcattttcataaattgttgttttgttggtgctagaaactgaaccttgagcctcacatggcaggcaagtgctctgctagagctgtgtccccatcccatggcactttgttacataagaagagcaaacagacttgtgtgtgggcacagctctgttacaaagaatacttctcgaagtgattgaaaatctgagtaacacgagtcattccgcataaaatccttctgtactgattttaccacacagctctctgcttctgccaccttcaactcttgctatacataaaatataataatcaaacacttgagtgaaaacaagtgatacattatttaacaaaataatgtgtagccagggttttcattgaatcctagaaagtgagcacaagcagaggtcttgttaggacagctggaggggggaagacttaacaagcgagtgtggccatggccctccctttctgcattacttcagcatcaccttgcacaggtgagcagtgagaggccactggatgcctctcagtaggaaaggctccagagaaagcaaagcagctgagtagtgttggggcaaggatacaaattctcagttgaagagaaacaaggttcaaccctgactccagcctctgctggagaaaccagcaatgcaggagttacagacttaggaagctacacatacataaaagggagatctccagtttgttagaaagattcaaaactgacacaattaacacctgtttaccactgatttcattcatttctttatgctgattctcataagtattcaaaaattcttaactgctgtagtagtttcctcttagcagcagagatgtgctgataaaagcggcgcactcctgaccctagtaacaccaaggtcactgggatcaccagcactttataaggctgataaagctgctgtcacgacaatatgttcctatgatgacagacaccgagtcgccacacttttaagaaaaattaaattgaaatcttcatttttggaacataaagctgggggccaaaatctaaaacaaaatttattccaagccagaatgagcaggacacctaaaaaataattagcgggaagagtaacaccttggtgtgtgatgacgacgtcctccacaatagactttaagttctacaactgccactgagagagcactggttaaagttaatccaacgtgtttcttaaagctgttaggaagcttattcataaaactcgtgtaaggtagctgtgttcttcagtagcatttacaacaatctagcacttggtagattggcacactctataaagcagtgtaac

SEQ ID NO: 1193 - DNA, 1200 bp, mus musculus
ggaagaagctctgaagcggtatcttagtggaagaataattgtatgacacacacctgatactaggttctattcccactcctatgtggtagggagaaaccatcccagatcctgaatttgctaataccttcaacttggattttggcctgaaactatgacaaaattaatttcacttggctgtgatattatatatcatactgtggcatccagactactatgccacatatgaaattaaatctccaaccattcatttaagtcataggagctctttcccagacataaaacatgatcaaactggtttccatgtatggaatctatccctttaatcatgaaaatatttacacatcctaggctaataaacaaagtatgaatatggtcttaaaggtgtcctgccttgggcagctatggggataaggggaggctagtcgccattggggcatcccgtctggtagtagccgagtgagagatgggtccgaggcggcgaggggctcagagtggcgagctcagagcaggagagaatggaaggcgtgaggcgcgggtggcggggcttgagtcgggaggggcggggtggggcgtggcacgcatctgatgagtttagcacacatggtgaggactctagcatgtatttgttctttcattaaacaaaaacccgcatcaactaatatgaacaaagtttctaatgacctttaataagaatatttttcaaattttgtgtctacccataaagatgaaaatcatgtaagaaacttcttagcagattatattttagagattattattaggcatgatggtttagataggatttagtagtgtatccagtgaggactcatatgatggagacagaatcctgcatgtgtctgtacagtaggtggcattgccctactaagggatgctgcctaccagatggtgctcagctcactgtgagtgctgcctccaggactcagaacagttattaatgtggtcaagagcaagttgtagggagagtaagtcagctcttgaatccctcatgcttcctgtctggtgatgagctgtctctctttcatctgttcctttgccatcttgcaagaggccctcatcagaggcaagatgatgctgggccattgcatttgaatctccagaattaggagctagagttaatctattcatttgttttattacaataatttttaaaacggactaatatccagggtaaaatgcaaggct

SEQ ID NO: 1194 - DNA, 1400 bp, mus musculus
tatttaaaaagtcatgattggtcaaatatcctttctaatagatgttgatttaaaaagcctacaaccatgccataaatatgtatttttaaaaactaaataatcactactaaagacttctgtttctatgtaaaattcaactttgccaccaaaaatattgtgatgtcagttcctcaccagaacttttgtgagaaactaaagacctcacaaagactgggactatggttccatgggtaaaggaaaacccctgtaaaaagtagaggaagagaagcatgccacagaattctctctgacctccatacatgtgctagagcatatctacatgcatgcacacatcgcagacacacacaaacacaaaaataaataaaatacaaataaaactaacatgtgtatctgccacattcttctgtaagcctttttcatttgaattcaagataacctaaatttagctggaattgtatatgaagcctggcatttggccaatatagttattggccaataacttttcattcttattcatggactaaacctatgttagtgccctgccagtcagtgccagcaccaggtaaccttgggcgcagagtcggaggacacccccaaggtccgctagaggactctctgcacgatcttaggaccacaggtgaatggaacacaactgctgttccaatccaattgcgtgggacctgagacaacattagggaagcaggaaacctggcctgaccagggtcaaaagtcccttctggtctgcaccagcactgggtcacctgggcgcagagtcagaggacacccccaaggtccctagaggacagcttctgagacagaccacttttcgggctccagacatccaggcaccttccctgccagaggagaggtgtctgccctgcccaggaggactttgccggagcaccaggggaaaccatcttggttcctggatccctccaagactagtctgtgcaggcgagagtgtggactacagaagctaacagcttctgtgacaggccaaagcaacacagcttctgggacaggtcctgtttcaggccttcattttcggccaggagggaggaccaaatgccagatatctgtgcaccttccctgtaagaggagagcttgcctgcagagagtgctctgaccactgaaactcagaggagagatctagtctcccaggtctgctgatagaggctaacagaatcactagaggaacaatctctaaccagagataactataacaactaactccagagattaccagatggcgaaaggcaaatgtaagaatcttactaacagaaaccaagaccactcaccaacatcagaacccagcactcccacctcagccagtcctgggcacgccaacacacccgaaaagctagacccggatttaaaagcatatctcatgatgatggtag

SEQ ID NO: 1195 - DNA, 1200 bp, mus musculus
agatgtagcaattttcatagtaaagtctttatgtataataaaatcttatcacctgcaaatgaaggtactttgatttcttactttcattattgttttacatatgttagatcatcctgcatctctgaaactgaagccaacttgatcagcgtggataatctttctgatattttctggaatttcgtttggaaacatgtccttcaacagaggaatggatacagaaattgtggtacatttacacaatggagtactactcagctattaaaaacaatgaattaatgaaattcttaggcaaatgtatggaacagaacatttcatcccgagtgaggtaacccagtcacaaaagaacacacatggtatgcactcactgataagtggatattagcccagaagctcagaatactcaagatacaattcacagaccacatgaagctcaagaagaaggaaagccaaagtttggctgctttggtcctgcttagaagggggaacaaaatactcatgggagcaaatatggagacaaagtgtggagcagagacagaaggaatgaccatccagagactgccacacctggggatccatcccatatacagtcaccaaccccagacactattgtcgacaccaagaagtgcatgctgacaggagcctaatatagctgtctcttgagaggctctgccagagcctgataaatacagaatgatgctcgcaaccaacctttgaagtgagcatagggtccccaatggaggagttaggggaaggactaaaggagctgaagaagtttgcaaccccataggaagaacaaaattatcaaccaaccagacgcccccagagctcccagggactaaaccactaaccaaggactacacatggaggaacccatgggtccagtgcatatgtagcagaggatggccttgctggtcatcaatgggtaaagaggcccttggtctggtgaaggttcgatgccccagtgtagaggaatgcaagggcagggaagcaggagtgggtgggtgggggaagctccctcatagaagcaaggggcgggggatgagataggaggtttccagagaggaaaccaggaaaggggatattatttggaatataaataaagaaaatatccaataaaaaagattttttgcatttatactcataagggatataagtctataattttatttttttgagagggtctttgtgaggttttggagt

SEQ ID NO: 1196 - DNA, 1000 bp, mus musculus
ccatactgaccctgaaagaaagacatacaaacacctgcctctggaatcactgttatttgaatgtgtgctggggatatggaaaagacaagagtacatggtggagaggtggaagagaaaatgaagccaaggtgtttgtatattgtagagaaaggtagaactagagatggtagtgaggaacagggagatatgaggacgccatagtgagttcctaccctgggatgccactaagggccatgtttgcatccatggtcctgttgcagctggggtcgttgctgatgtcttggcccgagttaccatcaaagaccaagtggatgtcccatggtctaggttgccactggaaaacgtgtggatatctgagggtcatgctgcttagggaagacttgctcatcttcgtggcctgccctgtcacatgaggccatagggacatttgggcccagactagttcaatgggctatgtcttggtccttgacttcatggcagctgaggtctgtgttgatgtcccagtctcatgaattaccaaaggccatgcagatatccctagtctggaatgctgcctgagtactatgctgagctggagtgtgtggggtgatcagccccaaaggtgtgactgggggagagctggcccggggccctgcctcttatctgccccacaacagtggcagagatagctagggcagtacctcccagggcacagaagagctgatgggctaactagctcaattacctgcgcagatctagggcagtgagttggcccactccaacatagttctatcccaactataaactgctggggcatgtgaaagggctggttttgcagatccaaagcagcaggatctccatggcatggggctgaaacagaatatccaagccgtgtcccggtgaggatccagtatatatagtatagcagaagccagagaccttgaaacagaccatgacttattgcaaggaacatttccaagtgaaaatatatggacaaaagggtgtaccatgcgacacaaca

SEQ ID NO: 1197 - DNA, 1400 bp, mus musculus
agagttttgaaggaagaaagataagggagaaatgaggcaattaaactaaaatatagaataaagatcatttgtgatgttttaagatatgttagtcttcctcgatttatttcttcctcgatttgaagttcttgttatgcagatctttcacttgcttggtaagagttatgcaaagatattttatattatttgtgactattatgaagggtgttatttctctaatttctttctcaacccatttatcctttgtatagtggaaagctaattagttgtttgagttatttttatatccagtctctttgttgaagttgtttggctcacaggacccaatggggatgacagtagctgaaatgcccaacagtggggagacggaacttgaagagactaccaccagtaggttgatatggcccccagttcaggaatggagccacgcacccatctcaaaatttttaacctagaattgtccgtgtcttaaggaaactcagggacaaaaatggagcagagactgaaggaaaggccatccaagagaacacttcactgtgtgatccattcaatcctcaaacaccaaacccagacactattgctgatgcaaagatatggttgcagataagagcctggtatggctgtcctctgagaggttctgccagcaccagatgaaggcagatacagatactcacagcaaagcattgtactgagcccagggacccctatagaagagttaggggaagggctaaaggaggtgaaggagattgaaatcccataggggtttatatcaactaacctgatacccccctcccagctcccagtgactaaaccaccaaccaaagagtatacatgcatattggtccatggctcctggtacatatgtagcagaggactgccttgtcttccatcagtgggagtggaggagcttggtcctatagagactttatgccccagagaagggggatgttagaggcttgaggaaggaatggatggatgggtgtgggagcaccctcttagaggcaaatagtgggggatacggagtgggagtgtttgtggaggggatactggaaggggggataacatttgaaatgtaaacaaataaaattattaataataaaaatatattttgtattatatccagaaaaattgattacagtgttaggatatctttccaagagttacggtttcatttttaaagcttaagtgaagctgaggaaagctgccttacttagataagtaggccgtcatgatatgggaattggagtttggttttggaaagaatttcttttgaattcacttttgccaaataataactacttaaaagcctaatataactaattaagattttcttggtcaaaatctccatgttacaccatgttatctgaggaagttatcccggaatttcttcctccacttct

SEQ ID NO: 1198 - DNA, 1400 bp, mus musculus
atttgcctcccttatgaaacccattcaagctaaagtaattcttcacaatcattttttttacagatgaaaaaaagtcacagtattgagttgtcccctatcatatgatcatgattcagcaacaacagctggtagcattgcaaacttcctttattttgtcaaatcatactcctaacacaagctaagcaatttaactgataccaagtgcctccaactccatcccattcttcattatgtgtgtttttagtttagatttatttccattgtcattaatcttcttccaaataacttatttatttatccatttagccatcaaacatctgtgaagtggtatgtgtatgttgtggattcaaatgaatgtcagagttctgaaaccaagcatccaaacaaccgacaaaacaatctttcaaccaatcatcaaagcctgaaagcaagcaagcaagcaaccaaccaactaaccaagcaatcaagcaaccaatcttccagccaattactcaaggaagcattcaaccaacaacccaactaaacaatttaccaaccaattgcctaaccaagcagtcactcactcactcactcactgactcactcactcacccaaccaaccaaccaaccaaccaaccaaccaaacaaccaaccaaacaaccaaccaaccagccagtcacccaaccaaccagtcacccaaccaagcaatcaaccaagcaaccaaacaaccagtctttcagtcaatcacccaagcaatcactcagccaactaaccaactaaccaaccatccaaccaatcaaatgactgaccaaccgaccgaccaaccgactgaccaatgaaccaacaaaccaatgagccaactaatcatctaagcaagcaagcaagcaagcaagcaagcaagcaagcaagcaagcaagcatgtaagcaaccaaacaagcaagcacccaaccaaccaagcagtcattttcctgctttctagtgttctattcaactctaaaatgagaattattaaattaataggagaagtgctgtttctcttgttaagaattgtgggaggaagatatgcttcatccatttggggtctgtcgggactggatcctgaggataaaagcattccagttgacatttgaggaatatataaagatttccaagaatctatggaaaatgagcaccttaaaatagagtgaagaaaatgttaaagatttacttaaaaagagttgcttttcacaaatttaaaattccccatttagcttccataccctttaaagttctggcctatctttttgtctgcctatgcttcctttgcttctcaacaaagagcttttgcttcagtaatgcttcttcatgctcctaagcaaagcatgctttaatctgtcatctagcctaacctcttcttcaagtcaagctcatgtctcacactt

SEQ ID NO: 1199 - DNA, 1200 bp, mus musculus
tatatttcagaacacaggtataggagagaaatgtgagaggaatctgcccttgtctttctttgataaagcagaaaaaaatagatttttcagaatcagggtatttagaggttacagacaggtttcagggaaaaaggaaattgtatgttgagggtgaattgagaggctatactttgtctaagtgtttgtagcagcaattgaaaagaatatgtttcagtctgaagagactatgccactgatggactgactgactatgtgagaaaatgacattttcttacagaaactagttaagaatatactaagctatattaaaaacagcagcaaagaagacaaataatcagcactgccagtctaccttggatgcaaactcagcacatccccatggttcccagagaaactctccaatccccaggtgctctagcatgcccaggatcttaggatcagcagtgagtagaacacaacatctgtttgaacactaccaggagtgactggaaccagcaggatccagggacactggaaccccacctgaccagtagctcgagttccttcctgctggcttgagtctagcttgggtacaaacttggcagacattcccatggtccccagaggagatactactcccaggtgctctaacacatcaaggatcttcccaggatcccacgatcccacaatcccacgatcccaggaacccaggagcttggtcacaccagaatgtcagggtctcagaggcagcttgactcccaggaactctgacatacccagaatcttaggaccacaggatcacagaatcacaggatcataaagaaagctggattctgaggagttctgactcaactgggattacaggaagaacaggctccaatccgatatagtgagggcagggagcacttttaatagtcagatggcaggaggcaagcataagaacagaagcaacagaagcaaaggttacttggcatcatcagaactcaattctcccaccatagcaagtcctggaaacaccatcatacctgaaaagcaagatatgtatttaaaatcacttctcttgatgatgaaggaggattttaaggacataaataactcccttaaagaaatacaggagaacacaaataagcaagcagaatccttaaagaggaaatgaaaaaattccttaaagaataacaagaaaaaacaaccaaactggtgaaggatttgagcaaaaccatc

SEQ ID NO: 1200 - DNA, 1000 bp, mus musculus
aattaaaatgtattataagtttttactttaaaatttctatgtattattcatttccctgataactgctgattcagaatcctgttagcaggattgaactttaaatattttaaatatatttacatttacaattataaaagtaagttatactatagaagcatttcttgttgcatattctggtacttttagattgctagtcccaaatacatgtgtggcagattacagagaaatttggaaatgcattcatggattccatgtattcatcccagttttcttagcttctgaaaatgcttcttgctgtcacagtcaaatttccactgacataacaatattttgaatccacgagtaatgtggaaggtggtagaaattctctaccttttgtatcttgtaattggtgaacttctctctctctttttaaataattacctttatttttttttacagtccagtcattatccccttcctggtacaccctcccacagttcttcagttcattccttcttccctctctccaagaagttgttcctccaaccccaccaggcctccccagtccctggggcctcaagtctcttgggggttaggtgcatcttcccccaatgaggttagagcagtcagtcctctgctgtatatttgttgggggcctcagatcagctcatgtatactgcctgtttgttggctcagtgcctcagagatctcaggggtccaagttagttgagactgctggtctttctatgggattgctctcctcctcagcttcttccagccttttcctcattcaataacaggaggcctgacttcagtctatttgttggatataagtacctgtatctgtctcagtcagcagcttgctgggcctctcacagtcaaaaaccctgaccaggaattgttcatgtctgaaagaactgcaaagataaaaaatggaaaagagactgaggaaaaggttgtccagtgacctgcccaatttgggatccgtctcaaagggaagttccaaagcctgacacta

SEQ ID NO: 1201 - DNA, 1000 bp, mus musculus
taattactactatgtaaatttaatttacttattgtcccattttacatctcaatatcagccctttgtcttctcccagaatcccctcacacagattctcctccccatcccctcttcctcttttcctcacacactaaacaccaccttaccccacttcctggacaatcaagtcactgcatttctaggaacatcctctcccactgaaaccagataaggtggcccagttagaagaatgggatctggaggcaggtaggcaacagttacaaggagagtaccagctccacttgtggggcacccagtgaagaccaggctgggcatctgttacatttgtgcagagggcctagaaccagcatatgcttgctatttggttggtattaaatctctgttggccccaagggaggaggctagttgactctctggaggctctgtcctccttctggctttcaatacttctctctattgttccatcagactccccaagcgccatctaatgtttggctgtgggattctttccattggctgctgggtggaggatctcaaaggacagttatcctagggttgtgtctgcaagcataacagagtatcattaatagtgtcagggattagttttttccaatgggatggatctcagttggttggacattcattccctctctgctctatcttcatcactgaacatgttgaagacaggacacatttggagttttgtgagtaggttgctattcttttctctccattgggagttattcttggctacacaaattgcctacttcaggatccatatcacccccagataggagtctcagctataatcacctccatagttccaaaggggcctccctcctctccaagtctctataacatcctccatttaccattcactgccaatctccgttctctctacactgttctctctacatcttgtccctggttctgctctgttccatatcccatcacccacccattttccccatccatctattttgtttctgctttggaaaaa

SEQ ID NO: 1202 - DNA, 1000 bp, mus musculus
gaggttctccctggataccaacctatcctgacttcataagacactgcagtattaggcacatcctaagtcactaaggccagaaaggtcagagaagttaggggagtagtatacacaggcaggcatcagagttagggtgagtccccactccagtttttgggcttccttcataaagaccaagctactgttacatatgtgtgtgtgtgtggaggggtagttccagtcattgtacactttttggttggtggttcagttttagaaacccctaagagtacatgttagttgactctgttggtcttcctgtggaatccctaacattatattcctgagtcttttgctcaattcctctgtgagacttcccaagctggttctaatatttggctgtgggtctctgcatttattttggtaagttgttgggaaaaggttctccgaatacagttatgtcaggctccagtctgagaattacctctactcttctgcattttctccctctgtctttgtctcaactcccctccccaagtcctgagtaatctcgtgtgtgtgtgtgggggggggggggcggggggagatgagggaaggattgagggacctagacagcagagggactttacaggatggccaagggagtgaactaatctgcacccttggggactcccagaatctgaagtagcaaccaaacagcatacagagtacacatatcacttgttccaaaatatttgtagcagatatgcagattggtcttcatgcaggtccatcaataactggagtgggggcttatcctgactctgtcacctgcctgtagatactgctcaataactggagtgagggcttaccctgactgtgttacctgcctatagatacttctcccctaactagtctgtcctgactggcctcagtgggagtggattgacctagatctacagtgactttaggtgccaggaatagttttgcaataaaaactataccaactgtcttgtaaggtattatgtcaaaattattctat

SEQ ID NO: 1203 - DNA, 1400 bp, mus musculus
tttttgttttacataacttgaaagagcaattctcaagttcatatgagaaaacaaaagtcctaggataaccagaataatctgtacaataaaagaaccttaggaggaatcaatatggttgaccccaagccatactacaaagcaatagttaaaaacactacatgttattggtacagaaacagacaggctaatcaattgagttgaagattcagaaataaaactacactactatggatacttaatttttgacaaacactcaaaaccagaaaaaaaaaaacacagaagaaaaggtaacagaaaaaggaaagtatctttaacagatggtactgatctaacttggtttctctatgtagaaggccaatatgtttttattaataactctgcataaaacatatgtccagttggataaagaatctcaacataaaaccttattcacgatctgcaggagacatcttggttcccggtgtggactacagaagctaacagcttctgggacaggtcctgttttgggccttcatcttctgccaggaggcaagtccgaatgccagatatttgtgcatctgccctgaaagaggagagcctgcctgcagagagtggtctgaccactgaaactcaggagaaagcttagtctcccaggtctgctggtagagaataacagaatcacaagaggaacaagctctaaccagagacaactataacaactgactccagagtttaccagatggcaaaaggcagacgtaagaatttcactaacagaaacgaagaccgctcatcatcatcagaacccagcactcccacctcagccaggcctgggcaccccaacacacctgaaaacctagacccagttttaaaggcatatttcatgatgatagtagacaacatcaagaaggactttaataacccacttaaagaaatacaggagaacactgctaaatagttgtaagcccttaaagaaaaacaggtaaacacatccaaacaggagatggaaatgaacaaaaccatactagacctaaaaagggaagtagacacaataaagaaaacccaaagtgaggcaacgctggagatagaaaaccttggaaataaatctggaaccaaagatgtgagcatcagcaacagaatacaagagatggaagagagaatctcaggtgcagaagattccatagagaacatctgcacaacaatcaaagaaaatggaaaatgcaaaaagatcctaactcaaaacatccaggaagtccaggacacaatgagaacaaacttacggataataggagcagatgacaatgaagattttcaacttaaagagccagcaaatatcttcaacaaaattttagaagaaaacatcccaaaagtaaagaaagagatgcccatgaacatacaagaagcacacagaactccaaatagac

SEQ ID NO: 1204 - DNA, 1000 bp, mus musculus
aataatattaaaattcacaaggaacaaatgcaaattgcacaaaggcagaccaaacttctcaatagagacattaaagccagaaaggcctgagcatgtcatacagtcttcgaaaggtcacagatgccagcccagactaatatatccagcaaaatcttcaagtagcagaaaccatgacaaaatcaaaattaaataataccttttcactgatccagccctatgtagattataaaaaggaaaactacaatacaagcagggtaaatacaagcaaaaaaataagtaattccatgccagcaaaacaaaaagaaaagaaacgcacatacacacacacacacacacacacacactctaccaccatcaacatcaaaataataggaattagtattcattgtttattaatagctctcaatatccatggtcacaatttctcaattaaaaagtcacaagctaacagaggggattcgtgaaaaatatccatcattctgctgcatacaagaaatacagatcagcaacaaaactagacattactttacagtaagaagttagaaaatgatttttccatcagggaaatgcaaatcaaaacaaccctgagattccacctcacaccagtcagaatggctaagatcaaaaattcaggtgacaacagatgctggcgtggatgtggagaaagaggaacactcctccattgttggtgggattgcaggcttgtacaaccactctggaaatcagtctggtggttcctcagaaaattggacatagtactaccggaggatccagcaatacctctcctgggcatatatccagaagatgccccaactgataagaaggacacatgctccactatgttcatagcagccttatttataatagccagaagctggaaagaacccagatgcccctcaacagaggaatggatacagaaaatgtggtacatctacacaatggagtactactcagctattaaaaagaatgaatttatgaaattcctagccaaatggatgga

SEQ ID NO: 1205 - DNA, 3200 bp, mus musculus
agcaaaatccattacataaagaaattcaaagaaaaaaagccacatgatcattttattagatgcttaaaaaaacatctgacaaaattcaagatcccttcatgttaaaagttttggaaagatcaggaattcaaggctcatacctaacatagtaaaagcaatatacagaaaaccagtagccaacatcaaactaaatggagaaaaagttgaagcaatccaattgaaaaattgttgatggtgatggaaaggaattatggtttgctcagtttctgtgaaggggtttgcaaccacataggaagaacagcagtacaaaccatccagactccacaaagctccctgggattaaaccaccaaccaaagagtacacatgggaggacccataactccagctgtatacatgacagaggattgccatatcaggcatcactaggagggaaggttcttggtcatgtggaagcttggtgacccagggtaggggaatgctagggcagtgaggtgggaatgggttggtgtttggagaagcaccctaatagaggcacaggaaagggccagagaataggggatttgtggactgtgggatttccatcccacagtcaaagttctcacccataattcgtgctgtctgaaagaactacagggatggaaatggagaggagcctgaggaaaaggtccagcgacaggccgaaattgagatccaggtcaaggggaggtcccaaggcctgactctattactgaggctatggtgcactcataaaaagggacctatcataattgccctctgaaagaccctacaaccatcttaaagagtcagatgcagatatttacacctaaccaatggacagacactgacccttgtggttgaattaggcaaaggctgagagaagctgaggaggaaggcgaccctgtaggagggccagcagtctcaattcacctggaccctcaagatctctcaaacactggaccaccaaacaggcagcacatatcagccgctgttgaatctgtgttcattcagagattatgcacccaacgctcaagagactggaggtcccagggtgtttagaaatcagatggggtgggaagtgtgggttagggacatgactgtggagacagcagggtccagaggaggtatggtatatgtaacagtcagagggtagacaggggaaataaaatctcgtgtgtaaaaaaattaattaattaattaaaataaataaataaccaataaaaatgaaaaatatttttaaaaaaaatttgttcagttttgatgtgtactactaagaatttttcttaaatcttcaagaggctctcttccaagagtaattgagagggttgatgtagtatacatatcttctgttaaaaaaaaaatctttaatgataattcagatttcaggttgcagtagaaggttaaatgctcatagtgaatgtagagaaaaatctctagtcagcatttcccaggtggcttcttttctcataaacttacttcctaatgggaacacaatattactccattacagtaaagaataaacattattggaaaaaccattcagctcttagttggatatttttccacactaaatggaagagattgaaaatatattcactgaatctactgccaagagaattataggagatgatatttgacccagagatggtggtttattttcttttctcactaggacatgcatcatgttttcaagcatgccttcttactattttactttttgttccttacataacaaaatctcttcatatatattgtttgctttcaacttttaaccactaaaggcccaattgttttgctggatataatttgacaaggaaagtatatttaaatatattatgatgatttgagaaaatattttaaagttcatatagtaaactataatacaagaccaagatattaactagcatgtgtgtttgagaatatggggtttattagcaaatatataagtaggcttttgttgaacccacacttccccatccataactggctatctcttgttaccaaaagaggcctccagtggagtaaatagcttgaattcatgtgagttgttgacccaggggttaccatagaaatccccaaatgacccaaaatgttgaaaagtcaatgagttgttccctgaaaactgatagtagggtcccatttccatgaataacatccaacaaaagtcattgaacaaacagaagttgagtggtgcctacatgaagcctccatccctatggcatttgatgagagaaggtactcatcatcattttgtaggctaccaaaagaaatgcagacaccaacccagccacaaaaccttacaatatattctgcctgaaaaatacgatagggcaatggtggtacagagcttatgggagtatacaaaaaaaaatctaatttgacttaaggcacactctataagacagattcctatacctatagtattgctttgttgaccaagacccaaagactaaattgtacataattctatggtaaaagaaacagtactggtatcttaacaaataaaataatactttttttgaaatgtcctaatgatattaagctatgctgatatattcatgcctcattctattatcagaaaggtttcctctggcagaaaatgggaacagatgcagaaacctactgtcagatttttttttattattaatcattttatttgtttcttttctaatgatatcccccttcccagttacctctccacagacctccccatctgttccctactccccccgccctttcctttgcctctgtgaaagtgctccttttcccactcacccccttctgtctcatcactataacattccccaatgctggaccatcaagcttctacaggaccaagggcccatcccattgatgtcagttagggtcaccctctgaaacatatgtacctggagtcatggatacctccatgtatagtctttagttgatggcttagtccctgggagctctgagcacttagttgacatggttcttccttggggttgcaatacctttcatctctttaagtcctttctcttgctcttccataggtgtctcggggctcagtcatggttggctgtgagaatctgcatctttgctggtagaacctcttagggaacagacatgccaggctcctgtcagcaagcacttcttggcatcagcaatagtgtgggagtttgatgtctgcagatgggatatggagaatgagtgtgtaaatgggatt

SEQ ID NO: 1206 - DNA, 1000 bp, mus musculus
ctttcctttcctttcctttcctttcctttcctttcctttccttttcttttctttcctttggttggtggtttagttcctgggagctttgggggtggtggttggttcatattattgttcctcccatggagctgcaagctccttcagctccttcagtcctttctctatctcctccattagggaatttatgcacagtccaatggttagcagatcctctcagaagacagctatgtcagcaagcacttgttggcttccacaatagtgtctgggtgtaggattaagatggcgccagttttcagtgtgcctttgtggtgaacaacaccactgcacaggtgctagccagaatctggtgccaacccctcctgagagggtgcatgcaaattaggtgccagcaagctgaccaatcccagggggccacggagccttctcctgtgctggggtgcatataagcagtcctccctgggttcccagggtctccgtagcagcattgaggcgttcctgcaataaaggctgttaaaaagaatccaaacgtgttgtgtcttccttgctggtcaaggtcaaggtgggcgcaacatctgggtttggtgactatatgtgggatggattcccaggtggggcagtctctggatggtctttgcttccacctctgctccacactttgtctcagtatctcctgccatgggaattttgttcccccttcaaagaaggactggagtatccatactttggtcttccttcttctttttgaaaatagagtataatgttggatgcatagggtggtgagtgtgatctaaccaaaagccaagagacaaaagactgctgttgatgcagtctgtggtgacaaagtctgtggatatcattggtgtctggcataaagcttgagaaaggggttaaagaataaataaatctcacaaagataacgataatgataaagataatcaaactaaatgacatagcctttgtaaatagtgttgccagatttggtagcttattacttaaaact

SEQ ID NO: 1207 - DNA, 1600 bp, mus musculus
tgtttaatcttttccatacaaaccttcccccatattctgcattcttttaaattcatggcttttcttttcagtgttattgtaggtgtgtattaagacagtgtgtttacaagtacatcttttaagctagtatttcattatagtaatttaatatctatatctccctggtgattagtaatactgaacgtttttataaaaaatttggtatatctgtcattttaattgtctgatttttgaattgggttattcatatttgcactgagtgggtttccaggcctagttgtagtaatttaaattttgagtagtttttaggagactctgccataaaaaagggaacaattattaggtcctataaaaataagaaatccacaatatccattaaactaaaccaaataaatattttgtagtaagagttaaaatttcataaatatttaaagtaatttttccatagacagccaaataatctttattaatgtttttcaaaaagcactttaaggatttacatattccagagctttgcattagactgatacagaggaaagaacatagtctttctccatcaataactagatgtaaaaatcaatgctttatcacaaattcttcattttcattaattattttttaaactaatttactttttacactccatattccattccccaccccagcccgatccaccctctgactgctccacatcccacacctcctccccacccgactgtctccatgtggatgtccccatccctcaccccacctgacctctaaactccttggggcctccagtctcttgagggttaggtgcatcatctctgaatgaacacagacctggaagtcctctattttatatgtgttgttggcttcatatcagcttgtgtatgctgtctgttttgtggaccagtcagtgattgagagatcttaggagtccagattaaacaaacaaacaaacaaaactattttcttaggatgattcagatgactttccgtttcttactggcatttattaagaattgttaccgctgggcagtgatggcacacgccattaatcccagcacttgggaggcagaggcaggcagatttctgagttcaaggacggcctggtctacagagtgagttccaggacagccaggactacacagagaaaccctgtcttaaaaaaaaaaaaaagaaaagaaaaacactaccaccaccacaaacaacaacaacaataacaataatagaaagaattgttgagataaaaatgataatatattatcaattttatctctgttttcaaaaactccatttgtattatgaattctttaagcactagattaaaaattaactcatgtattatacatggttcttcaagaagattatggggtaaaagggatacattctatactagattaattttcctttagtaatagaattctgaggctttcatggctttttttttctgatgtctacatttcctggcatcccttccagatagcccatgccttattgatatttattcaataatcaaaaatgagtcagtcctctatcatgatcttaagaaggtaaaccttcctttttatatttcagtctacattctgttgtctaatctatgtacaaaatggtgagg

SEQ ID NO: 1208 - DNA, 1600 bp, mus musculus
acaccagtcagaatggttaagatcaaaaattcaggtgacagcagatgctggcgagaatgtggagaaagaggaacactcctccattgttggtgggattgcaagcttgtacaaccactctggaaatcagtctggaggttcctcagaaaattggacatagtactaccggaggatcccgcaatacctctcctgggcatatatccagaaaatgttccaaccagtatgaaggactcatgctccactatgttcatagcggccatgtttataatagccagaagctggaaagaacccagatgcccctcaacggaggaatggacacagaaaatgtggtacatttacacaatcgagtactactcagctatttaaaagaataaatttatgaaattcctaagcaaatggatggacctggagggcatcattctgagtgagataacccaatcacaaaggaactcacacaatatgtactcactgataagtggatattagcccagaaacttaggatacccaagatataggaaacaatttgctaaatgcatgaagggacactttgccccttcttagaattgggaacaaaatacccatggaaggagctacagagacaaattttggagctgtgacgaaaggatggaccatctgaagactaccatatccagggatccatcccataatcagcttccaaacgctggcaccattgcatacactagcaagattttgctgaaaggacccagatatagctgtctcttgtgagactatgccggggcctagcaaacacagaagtggatgctcacagtcagctattgtatggatcacacggcccccaatccaggagctagagaaagtacccaaggagctaaagggatctgcaatcctataggtggaacaacaatatgaactaaccagttccctccagagctcgtgtctctagctgcatatgaatcagaagatggcctagtcggccatcagtggaaagagaggctcattggtcatgcagactttatatgcctcagtacaggggaacgacagggccaagaagtggaagttggtgggtgagggagtgggtgggggagcgtgtgggggacttttgggatagtattggaaatgtaaatgaaataaatagccaataaaataaatttaaaaaaagaaaatattaagtcagactaaagttatttttatatttatatttacatttatatttatatttattttgagacagtatgtgccctagactgtctcatgaattctagtctacatttaccaacttctactggtgctcattgccaagcggggtcaaaaataatcaatttcaaacaaagattcacaaaaataaataggctcacttgtgtggagagccggtacgtgctgcgcgcaatcgcatgtgtgccgccagtaatctctgaggagagccgtgtgtgccgcgagcaattgccattataagatggtgcgggcctccgctgtgcctaactagtaaacaagccttgtacgcaggtgcaagagtgaattcactcctagtcactcccattctcggggtgtaatagtgaggtgatgggcaagcaacgaaccaggagctgtcacgccatatcaggtgctgaaacgtcacgctgca

SEQ ID NO: 1209 - DNA, 1000 bp, mus musculus
tgcaatttacacagcacataggaactgttaaactgagaaaaggaagacttacacactgcagcttccatctgctcagtccagtagagacattgctctctcattagctctctcatccctggagaatgttgtggtgaacgtggaaagtcatcagtaaaacaattacaatatgatggggactttttaaagaattgttatgtattcacatttgaaaggaagaattgagaattgggcatcttgaattagtttctcatggtctagactgaaatgagattttaaaaaggcaacgaatgacttcagaggtaatttttttcagctttgctaaatgtctaaaggctgtgtgtttaaagatgataaatgtagacatttaaagacctcaaaaagcagaatgtgaaatagaatttatgttcaagagtcaaaatactgtgcttcattaactgacatgtagatggaaaaacagagtagagtcctacagcttaccattggattgactggacctacacaatagaatagactacaagcttggcagctaaatgaaatgattttcaattgcttttatagcgctgaaaacaacagaaaacttggacacacctcatttttatctatgtgaccactgaaaaatatgacatgaaaggctgaagagatagcctagcagttaagaatatttactgctattacagaggacgtgaattcagtttcctgtacccacagtttcttacagctctttggagctccagttcgtacgatttcaacactttattctggcctcatggggcagcacacatatgtgttgcacgtgcactcatgcaggccaaacatccgtacacataaaacgaatggaccaaatggaacacaaacatcactttattagtaaagagtattcaaacggagtgtctggtttggaaactaggcattagagattgcttaagacaggctgttatccccacgactctcatactgtctttacaacagtccattgtcaaaatagtccacacatatggta

SEQ ID NO: 1210 - DNA, 1200 bp, mus musculus
aagttttataaagcattttctgcttagatgttctcttaatttgacgcatgtacatagaaagagaaatgtatcccttttagctttgaaattttacatcagagttatttaaccaattttattttcaatgtcatccaatggaactatgtttacacccttcctagaaagaacaaaaattaaatatagctctttgtacgcattccactccactacagggcaaggctgtttgggaagcaaaatgtggagcttaactgtgcttatccccaatgtcccctccagactggtgctaggcttcaggaagcaccaagacaccactccaggggcaggaaaacacagtctgggatgtgggaaagctgaagctggggacttcagagcctccccgcactcagttgtccatggggtggcacacagaggagtcaggaacaaaatgtctgtggtccccggtcttctgacgaggttgagaccatggactcttggacatccaggccgctgggagtctaggaagagccaagaatggaagaggcctgcgagctgaggaagaggcctgggctgcgggaagggggatctccggcttagctcagcagtgattgtcctcaggttggcagcagttatggctgggagtgcagatgagtattctatgggaggattaggcagtggctccataggtgaaggcctgctccatgtttcccatgttcgtggtagatgaaagagacagtccttggttccaaattctttattagttgtccactgtggaaaatggatgtctaccgtatcaacttctcagggtgacctggagattgattgccttttgcagggagaaatgtctgtgatgggaagcttactggctaagccctcaaggcctcaggcatcattagaatgatgaactctgttctgggcctgtgtgaccacaggtcacatttccttaagtgggaagtgtagcacgtgttctaggccaggaatttgtcaggaaggagtgaggcgcctaccatctcaggtgtgcaccaatgagttctggggtcacaatttgttctgactaccaagcatccagacatgatttactgtcccatgcatagtcaatttaaaaacagttttaatcacagagctattcttgtaaccgatttgtgctgttctaagaaaacccatgagactaatttataagattatccaaaatctccaagggtgattccaagatattcaccatct

SEQ ID NO: 1211 - DNA, 1200 bp, mus musculus
atgcacatctaaattactgtgaacttcatcttcatataaatattattttaatttaccagactatgtacacattgcattagtaggaagaagaaacatttagttttattagcttgttaaaaagaatgtaaagtatgctctagtatatatcttggatgtactgaaagtaggcgcttatccaatctacaagtaccctgtagtgtagtgtctgctacatgcaagacattgttaaaggttatgagagggtcaaaaatgaaaattatacacccagtctcttcttaaggcaggacactgacaacatattcactaaactaaatacttataaaaggatagaatctaaagacaaccagacaccaagagagagccttaaattcaaagtcaatttatgctgaacagtgagcattagttgagcctcagaaatatagtgagatgctcttgcagaagaggaaagacaaaatagtaagtaattaagtcaaaaaggtagaaaagaaaaacggaaaagaaaataataagatagacaggaggtgatggaggaattagtaatgtgtcccatacagggtgctattaacacataacaagaaacaaggagaatatagacttgcaaataaaatgtcagcagatgacccttgttgaattagggaaagactgaaagaagctgaggagtagggtaaacctgtagaaggatcagcagtctcaattaatctggacccctgagatctctcaaacactggaccacccaacaggtggtatacaccaactgatatgaggacaccaacacatttacagcagaggacttccgggtctgtgttccttcagagatgatgaacctaaccctcaaagactggaggccccagggagtttagagatcagacagggtgggggttagggtaatccacctggagacaggggtgtgggaagtaggtatggaatgtggagcagtaggagggtggatgggggtgggattttttgggggaggaataataaattaaaataaaagtcagcagaagatttttgtagatgtctataaggagaataaacaaacgaacaaacaaaactgaaggaacaaaaattttgaaagcaaaggtaagaatgtagaatagttcagagtatgcaagggttgtataaaccgaaatgacatcaggaagcaaagactataaacggagaaaaaaattgccatataattaaagaacaatttccaacctc

SEQ ID NO: 1212 - DNA, 1200 bp, mus musculus
tggacttcaaagcctttttatttgtgaggctgcttttgtattcaggaatggcattgtgctccagacctcatagccattaaatagatcaagcattgttgtgattaagagactagagagtccttcaggagccacctggagcacagccagctgaggtgatctacatgctttcccctgtgcaccattatctggcacaggactctgcttgccttcctgaagaggcttgccaatccaaggaacacccaaattaagttcctctccattaatctattgcatgtcagatccaccagggacagaatcagcagaggtgaactatatggggctacatgtggtccttgagcaccatagtcttagcccatggctttgcccttcttcccgaggagcactatggggcaacaggaatatttagatccacctggttcaaaaaaaaaaaaaaaagcatgctctattgaatagaaagttctattgtcagccccacatctttacatgcctcctcaggttacatcctgactggcatcaggaatatccagccagcaccaggataacctgatggctaaagatcagcataggatcacagtcaacaaaagcaaaggcaatatcataccacccagctaacctactacaggaaagccctgggcatagccaaagcacaagaagatgacaaatccaatcttatacagataatagaaatttttaaaaagaaattattaaatctcttaatgaaatacagtagaatacaatcgaacaggcgaaggaaatgaataaaactgctcaagacctgaaaagagaaatggagaaaacacagtcttggagatggaatctccaagtgaaagacccacaacgtgaggactcccccacgttctgactcaggagaggcgacaccccaaaatcaccaacaagaaacggtcttgttgcaaattgcaagaggatttttattcaagagcactctcgggctcacggtccccatacaccacgcaggggtagaggaccgtggcgccccgagtagctggattagggggtatttaaaggaagaaaccacaacttaaggaggtgggaagggcgttgttggaaaataccaaaaataccagttaagagtcacaaggaagtgcaaagttacaagagtcacaaggaatacctggtaagtgttaactctcaagacagcttctaagagcccctaacaatagcacatttgcattgcaggtt

SEQ ID NO: 1213 - DNA, 1000 bp, mus musculus
ccagaggttttccacagagatttctggccaggcctggtgcgagggttccagcaaagggaagcaattggggccaggagacaaagtctctgacatgcgttccaggttacttggtaactctgagctgctctgcactgagtcgggtccagctgggccaaggagaagctgactatccattgaggagtgtgggggaacctcaggtggtgttccagagagaagatctcttcctaattattaccactcttggaacaaaagactcagacaacggagtagttctcacacacctttaattccctggttaggatttatatacagttttgggtgtgattcagggttcaacagtaggtaactctccttggcttggactgagagcttgggggaaaccttatttgcatgtgggaaggctaggtgctgttcctacatgaccactgatagccacacacctctcctatgggggctgtggaggaggtaacttggacaggaatcaggggttcaggagacatgattgaacaccttcagacccatgtaggtggaaatcaccatccatcaggtccccagggttccagacttttgctcgactggagaccaggctttctgtgcacagcctgccgccccacagattcccagatcctcaatgtctcccaaagggccagaagggaacacttcatgcatgcctttcctagactggtcttttgtggataggaggcagcagatcatctttgtaaacttcagcattcttcttcatgtttccactgatgtttttcctttattattattatctttaatctgttttttacagtccagttgttatccccgtcccggtctgccctctaactgttcctcatcccattcttcctctcctgtctccaagaggatgtttccacccccatatgacaattaaaaataaagtaatccaaaccactcttgataatagtatctgtgattgaattccacaaaggattatagataataatgaattgtgtgttctgatacagtgctcaaa

SEQ ID NO: 1214 - DNA, 1000 bp, mus musculus
gattccccccccccaagatcttttattgttgagaattgtatagttttggctaatctggattggggggcagtgttgctgttgttggttggttagttttccatataaagctgagaattgctcttgccatgtctataaagaattatgttggaattttaatggagactgcattggatctgtagattgcttttggtaacatagccattttactctgctaatcctaccaatcccttcagcttttaaaaatgaggacatcaggctgcagctagacttggtaatttgtaagaatcacccaaatggtactagttttaaaggggtcatagagagtagctgaggcttgacactgtaaggtcaggaaaggccactggtaaaggtgcagcctcagttgcagttgatagtgcaggactgaagggttcatgaatgaagttgaggcttggcaccacatcagagcctatgagaggctattgataaagcctacttgcagtggaagactccagcaaactggagatgccagtactgtgggatgaccaccaagaataggagcagcagtagagaggagtcaaccacagcctagagtgctacagatagcagagctggagaaatgacccaagtgcttgcttgagaggagcccagacgatcccgtgtgggtcccagacattggaacaagaacctataaagttgaaattgtgttggaggccccaaaatgttagagatgttggagctgtgggatgcctgccaaggaaatctgcaaacaaggaaaggaaccagcccaagggaatgaaatttgttgctgctgaatgtcagatctgacaacagcagtcaacaatgacaaaaggagttggagatctgaagagtgctttgacattggacatggagatgtggagtttggagtttgcccagttgatttttggttttgctttcatccagtattttctatgattgtttttgaatggtaatgtatatcctttgatgctggaagtgtgtgatctgcttttttattttg

SEQ ID NO: 1215 - DNA, 1000 bp, mus musculus
atcattgactttgcattttattcaattgtgatgtcttctatgatcacttgcaccaagacctgactctcctggaggcttcctgctaattagatgctccctttaatgactcctgttgcaccccgggcttctctagaagaggaggaggaggaggaggaggaggaggtggcggctccttgtttcttaaaaatctctatatcacttttgatgctgtcagcgtatactgtaaagatttctctctcttcctctgaaaagtatcattaatctattctctgaccacctcagactaggtaatgggatacagaagtaggatgttcttagccacagaatagcaacctcagttaatttgcacagaatatcttattcctaggtctgtcttatgtaactctttctggcgaatgaagactcctcaagcaataacaacttgcatttatacagcctcatgaacatgaactcacataaatcacattcattagtgcctcttcccttctgtggtccctttcccaggtgactagcgtgcctccagctttccttccaccctctgccttgcctctattattggtctaatcttacttgggtctccctggggaagcccacctgcctgatcctcttctcattcttccctgattctcacaccaatttcagtgaggcccaggaccgtctgctgcctgctgtgagattcctccccatctgcccctcaactcacctaagtgtctctctcctactgcagttactctctatagtcttttatggagagaactgaggttgcctgacttagctgtcccaatcttttgtcttttcttcatctggggaaaataatctggttcttcccgctccacctcccatcttttccaaatgtattggtcacctccacaaataaagaaatccatattagcatagtactgtcattaagggtgcaaatgttttagcaacccaagttttaaaaaagttagtagcatctttctgtccctggatattttgactggcaaacagtaaaaacgtt

SEQ ID NO: 1216 - DNA, 1400 bp, mus musculus
catgtgtgaatgaataagcatgttagctgctatggtgccagtagctctactttgctatttatacataaaggcttgaatgctgatattgctataaacagcagctacaaatgaattttgggtacattactggcaagtttctggtatacaagtgaacatgacttacaaatagcaattttacagtttccacatatggaaatttagctatatgtataatatcctgcttctaggtttggaacaagtattcatagcaatgtttcttcacaaagctttaaaaaatgtgtttgcttagctattttcatttctttagcagaaaagttctaactgtatcaagcattatgtatgcactcttttgagaaagagattcatgtataggacaggctagtccagaatgcactataaagcacaggctggccttgaactcctaactatccttagactaagccctctaagtgctgctttataagtgttaagaaataatacacaactaaaattttaatcaagctccatgtggaagtttccagtggtaatttatcagagtggaagcataagtgtgtcttatgagtgatttgaaaaaaaattggctttaacactgtaaggtgggttgtagataccccaaagctaaaccaccatcccatcatgttgcacagatgggcaaaagccacccagatgcccactagcaaaagtgcccacccacagtgggaaccactaaggtgtgcaagaatatggtagacagatgggagagaacgagaagtgaaacagtcttttttgagcaatatgaatagaggtgacactggagaccagagggtactgaggagtagcctattttgtcctgccacctgaggctatggtgaagtcccaacccgtggagctgctgagagctgtacagcagcacaggtctgtgttggtgtccatgactcatattaccactgaaacccatgcagatggccatgatctatgtagatctggggagccaaccccttgacagctgcaggagagcagcagagctgactctgtctcttgactgcagcaccactgagtgagctattgttattagacgcgttctcacgaccggccaggaaagacgcaacaaaccagaatcttctgcggcaaagctttattgcttacatcttcaggagccagagtgcaagagagcaagcaagcaaatggcgaaaccccatccctttttaaggagaattatcctccacctaggacgtattactccctgattggctgcagcccatcggcccagttgtcatcacgggaaaggcagaacacatggtgggaaaactgcccctgcatgtgtgcagactatgtttaccacttagaacacagctgtcagtgccatcttataatggcaaatgtgagggcggctcctcacagatcccccttttcttttaata

SEQ ID NO: 1217 - DNA, 1000 bp, mus musculus
aggcagtctgaatcagtcgtcttgaagaggagtttggaccaggaatggtatgttgaaccagccagccagagttcagaaagagttagaaaaggtgagtgtattcagcagtatgacttcaaggtgtaaaaaatgctttttgatgataatacagaactgagacttttgccaaagtctgagtagttgttaaggttcaagatagagtatcactttcggagcattgttagtccaagtccatatccatcatggctaatatcatagaaattggtgagaaagatgtaggagagggatggctgtttggattagcgcacttcttcccatggcagctgtagatcattgcaattaaaattccaggacatcttatgccctcttccagtctctgcagacaccaggcatacacatgctgcacatacataccagtgggaaaaacacccaaacaatgtaaaatataaatcacttcttagaattgggaacaaaacacccatggaaagagttacagagataaagtttggagctgtgacgaaaggatggaccatctaaagactgctatatccagggatccatcccataatcagcttccaaaagctgacaccattgcatacactagcaagattttgctgaaaggacccagatatagctgtctctcgtgagacaatgccggggcctaggaaacacagaagtggatgctcacagtcagctattggatggatcacagggcccccaatggaggagctagagaaagtactcaaggagctaaagggatctgcaaccctataggtggaacaacaatatgaactaagcagtacccctgagctcttgactctagctgcatatgtatcaaaagatggcctagtcggccatcactggaaagaggcccattggacttgcaaactttatatgccccagtacaggggaacgccagggccaaaaagtgggactgggtgggtaggggagtgaggggggagtgtattggggactttttggatagcattggaaatgtaaa

SEQ ID NO: 1218 - DNA, 1400 bp, mus musculus
tttaaatgtttgaattccagattattttctttcatttttattttaacttattgcttcaaaatgaccctatctattttgcttttacaaacttattagcaaatgttaaaagccactttttttcaatgttggaaaacattaactgggcttgtgtgataactaagcaggtaaaaatacatgtcaccaagcctgatgatatgaagtcatatctaaagatctacattgcagagagagccaacttcattcagcaaattgccttgtacactgtcaaatgtacatgtggccaaacacacacacacaacacacacactacataatttaatcaacaatgaagtataaaaagtttaactgactactcatcacaagtttctagtgggttttatatgataagacatgagcgaccaaagctcagcaagaggtagtgggaggggagttcatcactaggacatgccagagacctgggatttgggaggctccagggaatctgaggtgacttttactgatactgttagcagtggggatatggagcctgaaatagccacctactgtaaccaggcaggagtcctattggaaggaaaaggatagcaactcacccacaaaacaaaccttcaattcaaaatttgtcctgactataaaaagtgcagggacaaagatggagcagacactgagggaatggtcaaccagtaactggtccaacttgagacccaccccatgggcaagaaccaattcttgacactactaatgatatcctctgagaggcttcgcccagcagctgactgaaacagatgcatagatccacagccaagcatcatgtagagtgcagaatgtcctgtggaagagttggggaaggattgagggacccagacaggatagactccacaagaagaccaacagagtcatgtaacctggacccttgggggctcccagtgactgaaccagcaacaaaagcacgtacatgggcaggacctatcccacctccattgcagagttatatagtagatgtgcagcttggtcttcatatgggtccacccccaaaagctggaagagggctgtccttcactgtgttacctccctgtggatcctgttcttctaacagagctgccttgtctgggtgcagtaggggccaagatgtacttaatcccaaggtgacttgatgtgccaggataggtggagtacacatgggtactccattctcagaggagaactggaagagttgagggaataggctgtatgtggagaagactagaggtgagcatggctgagattgggatgtaaagtgaataaataatggggaaaaagaatatacatagatatattaataataaatcaaaaacaacggtgtacatgttcctataaatttaatgttcttactatatataaagtcatgaaaagaaagtttgcat

SEQ ID NO: 1219 - DNA, 1200 bp, mus musculus
aatatatttaataaatgaacacacaaaaatccacaaaaaataataactcgaaatgatcaacatagtatttgaaaaaagaatcattttgtaaattttttattggatattttctttatttacatttcaagtgttattcccttttctggattcccttccagagaccccctatcctattgtacctccccctgcttctatgagtgtactcccccacccacctacccactcttgcctccctgccctagcattcccctacactggggcattgagccttctcaagaccaagggcctctcctcctattgatgtccaataaggccaccatctgctacatatgcaactgaagtcatgggtcactccatgggtactctttggtttgtagtttagtccctgagagctctagggtgggggtgggggtctgattggttgatattgttgttcttccttcctatgggatgcaaacctcttctgctctttcagtcgtttctctagctcttccattggggaccctgtgctcagtccaaaggttggttgtgagcatccacctctgtatttgttatgctctggcagagcttctcaggagacagctataaaaggctcttgtcagcaagctcttcttggcatctgcaatagcatccaggcttgatggctgtatctgggatggatccccaggtggggcagtctctggatggcctttccttcagtccctgttccacactttgtctccatatttcctcccgtgagtattttgttcccccttctaagaaggaccgaagcatccacactttggtcttgcttcgtcttgagctttgtgtgaattgtatatttggtattctgagaaaaagaatcatttttaaacaaatgaaacatatcccaaataagcaaagatctattaatagacctgatcacatcaacaatccaaagaagaagaaaaaatatgatcatattgaaggatgcatgaaacaattgacaaaatatagaatccattttgtaaaaatatacacagcaagggcacagggtaactcagttgttaagaggacttgggctctatcagaggacctggtttcagatctagcaccctcaagtgagttcacagcacttgaagttacactccaaggtttctaacactctcttctctactctgtgggcaatatatacatgcagtgcatatacattcaaacaggtacacacacacatatacataa

SEQ ID NO: 1220 - DNA, 1000 bp, mus musculus
gatccacaatacatgttaatggtcacatattcttctttaatgcccttatatataagcagggcaatgagaaaaaatcatgtcaagggaggcaaggtatacattgtccccaacataagtactaaatcataaataagcatgatggatattccatcataggactatgttaatcactcaacagtgaaaactagaatctcactgtatcagcaaatctgcacacagagggctttgctgctgagcaaggtctcctaattcctcagaatcaaaatgtagtgactttccaattccttatttattgcaacctatccaaagactgaactaaacctcatgaacaaatcatacagacatgaagaacttagaaatctaccccgttggactcagcggaacttaggaaattagtctgaacaggttagagggtgcgccagagaaccggacagcttctgggacgggcagaagcacagagccgctgaggcagcacccttggcgggccgcagacagccggccaccgtccagaccagaggacaggtgtccgcctggcttgggaggcagcctcagcctcaggagcagcggtcccaggactccctggaacttaggaatttagtctgcacaggtgagagtctgcaccacagaagctgacagcttctgggaactgccaaagcaacacaggttctgagagaggccctgttttgggccttcttcttcgaccaggaggaggtccaaaaacaagatatctgcgcaccttccctgtaagagagcttgccagcagagagtgctctgagcactgaaactcagaggagagaatctgtctcccaggtctgctgagagacgcaacagaatcaccagaagaacaatctctaaacagagtcaactataactactaactccagagattaccagatggcgaaaggtaaacgtaggaatcctactaataggaaccaagaccactcaccatcatcagaacccagcactcccacttcgcccagtccagggcaccccaacacac

SEQ ID NO: 1221 - DNA, 1000 bp, mus musculus
tacgagagacatttctcacttaaaccaccataaaggacatcttataaaatgtccagtttacaggggagttctcaactgttatttatcttcagcatctagggcggccttgagtttctgatctcaataccatttactccaaagagagcctttcaaggccgagagtatcttctttaaaacgacgtttgttttacaagtgtaagtgttttgcatatgtagatacataatgttttgccgaagcagacacagataaaaggatgttttgctaaagcaagcacatgaaaagacatgggataaaggattctttgctagggacacacatgtattggtccaccttatgttgagtagttgagctccattggtcaggactctctagagagaaatgcactgaaattttcatgtgctatgctggaggcttcctacatcttccgtggtctctagccgattggcagagtgatgtcagctggtacagactcgtgtgtagttttgctaagacagactcacctgctgaggcaagacgcatggtgaggtaagacccgcagaggacacgtgatacttggagggagtataaataagactcaaaggtgagtgatggagactgggcttgctggcatagctagcttgcaatgcttcttggtcttgcatctttgcttcattgagagaggcacagctgacaagttctggtgtccccggtggtcctaattcctcctttgactcatgacaattaggctgaggcctagctgttcctgctaggtcatgcctccactgctgccatcctgacactactgatctgaacggctggtatatctgtgaagtgtttgcgagtggatcgagctgcctctgctgactcctgtgaactgaattgctgatttcctgacaaaacagatgggatttgctccaaagaacaggtccacttctctgtattttaataacctttatttccccacaacctctggtgggtggtgggctgtgagggaagttaaatcatttaagaaccataatt

SEQ ID NO: 1222 - DNA, 1000 bp, mus musculus
cttgtacaaccactctggaaatcagtctggcggttcctcagaaaattggacatagtactaccggaggatccagcaatacctctcttgggcatatatccagaagatgtcccaactggtaagaaggacacatgctccactatgttcatagcagcctcatttataatagccagaagctggaaagaacccagatgcccctcaacagaggaatggatacacaaaatgtggtacatttacacaatggagtactactcagctattaaaaagaatgaatttatgaaattcctaggcaaatggatggaccttgagggcatcatcctgagtgaggtaacacaatcacaaaggaactcacacaatacgtactcactgataagtggatattagcccagaaacttaggatacccaagatataagatacaatttgctaaacgcatgaaactcaagaagaatgaagactgaagtgtgcacaccatgcccctccttagaattgggaacaaaacacccatggaaggtgttacagagaaaaaggttggagctgtgacaaaaggatggaccatctagagactgccattccagggatccaccccataatcagctttcaaacgctgacaccaatggatacactagcaagattttactgaaaggacccagatgtagatgtctcttgtgatactatgccagggcctagcaaacacagaagttgatgctcacagtcagctagtggatagatcacagggcttccaatggaggagctagagacagtacccaaggagctaaagggatctgcaaccctataggtggaacaacattatgaactaaccagtaccccggagctcttgactctagctgcatatgtatcaaaagatggcctagtcagccatcactggaaagagaggcccattggacttgcaaactttatatgccccagtacaggggaatgccagggccaaaaaaaaaaaaaaaaatgggaatgggtgggtgggagggtatgggggactttggg

SEQ ID NO: 1223 - DNA, 1200 bp, mus musculus
tttctccagttaaagtaactaaggtacaacttattgtttttgtcaacttccttcagatattttgctaactcactgggagagttaaaatcttccacatgaatgaatgaatcagctggaatataattctcatagttttccctagatggacccaggacaacaggtactgaaccagccaaaaatgcattgtagagcttttctgtgatgtaatctttgtgaattgagttttcaaatgaaagataaaatttacaagtagatatggtgggaatcagatttttatcgttcacgtattctccgaatgcttggccataggtgtggatttcaatactcttgctgagctcgttgtaatacttgaccctggcatgctcagggttccagttactcacaacccagcacaccaacttctccttgcttggcacttcaaacacaaagggatttgtgctcaccgtcaagaagccataaggcacttggatatctgaatcacggcgataagttagagtcaggttgaacaagtgttcaatgccactcttttggggggtgtgagtgggtgactctaaattcatccaaatccatttctgaaagggtggcctggcctgctgaggtaagttagtcagatcccagctgatgtctctatggtgaatcaggaccgcatgggatttgttgtacaatgagcggtctgttgtgagatggcacccttggatattgaacattgcttggcaggatgtaaggtcaaaggtctgcccaaatggccatacccaaaccagaatggtagtttcgttaaaataatcagtttttgtggagaagaaatttttcattttcagcacagaacttgcagactccattggactgaagacccagctgttggtgggcttgatataaatgagcagacatgccatgaagcagcccaggatgatgcagacgattagaaatgggcgaagaatgcctttggatgttgatgtcataatttttcctggggaagagagaaaaatagaaggtaagtttagaaacaaaagaggaaattataactacaatgtaagagaaatagtacgactattttaatcatgaaaccaactctaattccctttcagttgtaaaagtttcctttttaagaaacagcgatatgaagttgagtggatggacagaggaatttaggagaagctagagggtggaaaaggatatggtaaaatattctgtttgaaattc

SEQ ID NO: 1224 - DNA, 1000 bp, mus musculus
ctagtcctctcattgctcttcaggaagctctagtgttgtggattgagctcaacacgtgtattatgttacttgagtcccccaaatggcatgagaatccacatgtaagatgctgaggttccctcctcccagttggttttgtttggcaaataaagttgcaggtggcgaatggctggacagagagacagaggtgggactttaagattcacgggaaagggactgagggagaaaggggtaaggggaacgagggaggagaaatagacagaactctgtgctgggagaggagtaaagaccagatcttagaagtgcagaagcgagagcatgccaatcatgtaaggggtggtgaagagaggtcccagagtgttcccgatttggtctagggtagcaaagatggaatatagatttttgtaagtaataactcagaatgttggaggggaggtgttagtgacatgaaggttttagggtgctagccactgaactgtttaaggcatataaaatataaggctgcatgtgtgtgtcgttgatttgggaacacagaacattgggtcagatagcagggaacacaccactgttgccaggttgattggaggagaagtataattggcaaaagcaacactggagatcactgacattgtatagtaatacttgaaaagagttgtaaggagaaaagaaactcattaggaaaaaaaaaaaagaaacaaatatatgtttaatgttatatacttcaaatattgcctttacctagaattgtttaaagtaaaatattaaatggctagagagttttttgatctcttaggctctcaagtaaattattatttttgtgactaaacaaattatgtaactaaactccaagtaaaaagatacaaaacgtaaataattacgtaatatgaaaatgaacattgtagatgccatgcaaaactaacggcttatttaatatgttcaaaagtaagttttgtttagggcagcctgcgccaggaagtcaatctcatctttcccacttctg

SEQ ID NO: 1225 - DNA, 1000 bp, mus musculus
ccgggggggggggtgtcaatttgaattttagacggtcatttgcaatcggctttatcttatcagcagagggcgtggtccagacttccttgtgtagacctgtctggtctaaaatgcagagatctgcctgtctctgtctcctgtgtttctgtgtttgttaagtgttcatgattcgcggaagaatgacatcctggactcaaatagaattttattctgcagaagtccagcatgcaggggtctccgcattaccaagatagacacccaagtgagcttgtgggtctgatttaaagcatattagggaggtccggtgtaggtgacctctatgttaatctgttgggtgcatctttacaaacattctgttacctgggtgtggaggctgggaacttgcaggggcactctgagaactgttaatgagaaagtagctgaggaatgctcgaaattgctttaggccaggtggctggtacattgtattttctctgcgtgaaggcctgagcttgggtttttctctatcagtaattgacttgcctgggcttgcctggacttgcccagtgtttaggcctcctcttcttaactgccaatatgaagtctgtcacggaatcaggctaaccttctcagttttagctcagatgctgtcctggacttggccaagaccaaacacacatgcacatacacacgcacaaacacacgcacgcgcacacacatacaccccattgcttacagggcaaattgcccacagcagtgaacctaaggctgcattgttttgctctccgcctctgtatctgctgcgttcattacccgtgtaaaagggagcctggttaccgcccccccgcccccccagcagctctgcccttggatgaagcacctacttctgtgttctgcttttaaatttagttagggcttctttaaaaagccaccttctatacagtctctctgtaggtgcctgctccttgcctagaaacttcctttctagttgttctgggatgctttagctttgctctgtttt

SEQ ID NO: 1226 - DNA, 1200 bp, mus musculus
caaacagcctatcccatcccaacttgccctgcttctatgagggtgctcccttactcacccacccactcctgcctcaccttcctagaattcctctacagtggggcatcaagccttcaaaggactattgacctcccctcccattgatgccagataaggccccttcagcaacttcagtccttccctggctcctcctatttaggttcctgtgctcagtctaatggttgcctgcaagcatccacatctgtattggtcaggatctggcagaacctctcaggagacagctatattcagctcctttcagcaagtgcttcatggcatcagcaatagtgactggatttggtttctgcatatgagatggatccccaggtggggcagtctctgggtagcctttctttctgtctctgctccactctttgttgtccttgtatttcctttagacaagagcagttctaggttaatatttttgagatgggttgaggcctcattcctcaactgcgggtcatgcctaacctctccatatggtctctacacattcactctcccctttgttggatatttcaactaatgtcatccctgttggattctgggagcctcttgctgtcctgtcatctgggactttcttgtagctacccccagttccccattttccactgctacatacctttcaatttcccgactctctgtatttcttccccacaatcagcaatagtgtctgggtttgttgtcttcctgtgggatagattctcaggtggggccgtctatggatggcctttcccttagtctctgttccactctttgtatattttgtagacaggagcaattctgggttgaaattttgggcatgggtgggtggccccattcctcaacggggggccatgcttaacctctcgatatggttttgacaggttcttcctttctttgtggggtatttcagctaatatcatccctgtggggtcctgaaaggtcttgctttcctggcatctgggactttctggctgctatacagaaataactatcacccattgctaaacacctctgttcaatttcctgaccctctgtaccctccgtacatctcctccatctcttcccatacctgattctgtttctcttttccccctcctcctcctttcttcctcccaagtccctgtgcccatctactttccttgattgtgggaagccgcccccacattcgccgttaca

SEQ ID NO: 1227 - DNA, 1200 bp, mus musculus
taggcatttaatatcttttgagaaaactgcaattgtgtatttttggtaccttttacaatacagctgtcagaaaaactgtaggctacaagtcatggtgaagatttacttgattgtgactgaagagaagcattcagtctgcctcagcactttctccctgcttgcagaacttcccctcctgcccctgttctttccagcagctaacacagggctcctcctcccattcctggcctttcagagaggacttgatctggcactggaatattgctatcccagatttcatggaggcacccctagcaaactcacccctaccccctgcctgggaggaacagatggcagcttgagaatagacaaggaacaacctccctcagcctaggccaaccttccctcccccatccctgtgtcacctaggctgccactgtcactgatagatggctaagcacttcccagtgcagctggtgcctgtccttgggaagagctaagaccaagcatccttgaagaaataagtgtcccacatttgggccatgagaggacagtaatcaagctttcccagacaattgtggctagttgtaaaaacacactagttcctgatagtaccataaagtaacttctcaggtcagaagagtcccctctcccagttgtatgattctgcctcctgcctgaacaaatgatatcttgtttgaaagatgacttcccttgtcaccttcccctgtcatcctaaaatccaaagaatccctgattatgcttgtattaaaaaacactaaacccctggacattgggtcgcattcctgtcctgtgcagtgtgaaggtttgtgaccgagtctgactcgaataaataaaagactctcttctttcactacatcgaatcagtagttctaagaattctcctggggcccatgtgatgacctggacacaacagtggcatcaatagtttaaagaatttatcatgctatccagaaattacattgaactgctaggaaaccgaaaggttctcactcttgatttcaaaagaaagagaaaacaatttgtgtaatatccttgaaattaagaagtcatctacaaaaccacagattttctggtaggccggttaggaccatgtttcttctactcagacactagcagttagcacagatatttgttactttctgaagcatctacagagcaggttggaggtttcccgaaagagaaatattggacatgtcc

SEQ ID NO: 1228 - DNA, 1000 bp, mus musculus
gaaatgggtatccaccattagccattaagatgtctccagttaggatcactatgggaaaagtactcttattaacaaatccctagtctatgttttaaaacgaatcttgtgggacttcatttataaacttaggtatgattgctttttcacctatatgtaatatgtagcatgttgaaacgatttcagttctggatttatcagtagaagctgcaggcaaacactagacatggaatgaccaactgatacacctttacaaggtactatttggaagccattggacttggtttatcagaggggaatccaggatcctttgggaaggcagacatctccatgggtcttgccaagttaaggagccctcaccaagtgggaggttgtttccatgcagcagctcactgttttgtcactgacactcaagtgcttaatgacaccattaaggtcaattataaagaggtccctgagagtcacaccagcaccttctgattactccctgtatttgcaggctatttccttagtttaacacaacagtgtaatgtttttgtgactcaaatggtcatgcttccatggtatgtaaggtgaattaaaatgggaattcactacaactgcaaccacttcccagttcatactgtgaaatccattgactttaccacaaaaacaaccaacttttgtaggacacacatacacaaaatcaaaaggagagaagaaaagcactaagtgtttccccttaaaagtcattaaagtatggctctttggactctccacagactataggatcttaaaagcaggaaaatttgacttggacacaggtagaccactgtatgtttgtcttctcgaaaaaatgggccacatggctaaaaaggcagaaataatctgcgaaactgcattgacatatggagcaaccaggacttggaagaatcttccctcccatcttcagtacatgaaggagctctggtgcacagagctgctgactagcagcacgaattttaattgtaatattcatttcagt

SEQ ID NO: 1229 - DNA, 1200 bp, mus musculus
actctccaaatgttccacatccaataccttctccccaccccccagtctccacatgagtgccccactccctgcccctcaccccaacagacctctaaagtcactgggatctccagtctcttgagggctaggtgcatcttctctgactaaactaagacctggaagtcctctgctttatatgtgtttggggtttcacaccagctggtgtttgctgcctggttggtggtccagtatcttagagatctcagggatccaggttaattgagactgctggtcctcctacaaggtcaccctcctcatcaccttttccaactttcccctaattcaacaatagaggttagcagctctgtccattggttggatgcaaatatctgcacctgactctttctgctgcttgttgggtcttttggagggcagtcatgataggtccctcttgtggagtgctccatagccttagtaatagtgtcaggccttgggagctcctcttgagctggatcccactttggacctgttgctggaccttcttttcctcaggattatctccgtttcaatccctgaagttctttcagacaggaacaattatgggtcagagatgtgactgtaggatggcaacctctcccacacttgatttcctgtctttcagctggaggtaggctctacaagttccctttccccaatgaagggcattttatctagggtcccttactgtcagtcctgagagtctctcacctccattgtctctggtacattctggaaggtctcctcaacctcctaactcccaaagttgcctgtttacattctttctgctggccctcatgtcttcagtcattttcccccacccaataacagaacatgtccccctctttcctgacccatccactttccctcccaggtccctctctcttctgccttgtggttgttttcttctccctcccaagtgagactgaggtatcctcatttatgccctgcagctttttgaccttttttaattctgtggactgtatcttgggtattctgtactcgtgttttttgtttgtttgtttgttttgttgtttttgtttttggataacacacatttacaaatctttgatatttttgaatccttgggaacaatacaattttaagcatgtctttaagggttataatcttggttcatggaaaagacaagactcactctaagtgtagagtgcaccatttcacaag

SEQ ID NO: 1230 - DNA, 1000 bp, mus musculus
ttttatctctgggtcttttattctatttaattaatctgcctgtctgtcatggccattttcactaggttaatcgtgccagtccatgagcactggggatctttccatcttctgacatagtcttcaatgtctttctttggggacttgatgtttttgtcatacagataaaatcattaatcaaatcccagatttctaacagtgggatgtgaaaacagaagagttcacattctatagctaggtagaactttcagtggactaataaggacaccaatctacctactcaaaaaaattttacccaaaatttgtcctgtctaaaagaaatgcagagatagagatggagcagaaactgaaggaatggccaaccaaaaaccaactcaacttaaacccatcccatgggcaagcacaatttcacaacattattactgatactctgttatgcttgcagactggcacctagcataagtgtcctctaaaaggatatacccagcagcagactgaaacagatgcagatatttacagtcaaacattggacagaggtcaaggtctcttatggaatacttggtagtaggatttaagtccctgaaggggatgggaaccccacagtaagaccaacagagtcagctatcctgaacccacgggagcttccagagactaagccagcaaccaaagaacatccacaggctggaatgaggcctctgccacacacttagcaaatgtgcagctcagtctccatggttgccttgactggctcctatggcagagacttgctgtgtccttatcagaggacaagtgggaatatggggagggactctatgaggggcaacaagaagggggagaaggatttgagatataaataaatgaataaataaataaataaataaaacattacaaaatatagtcaatttcatgttatcatgcacataaagcacagagaaggcagtaccctctctatcatctaatatctaatgcagcattgtagacaaggagattaacctcaagaaat

SEQ ID NO: 1231 - DNA, 1000 bp, mus musculus
cttggtgattcttccatctgtagttctggttcacatacctagattttcaatttgcagaacttccccattttttattacctccgtggtttctatttccattttcaagtctttatgagttttatttattagtaaaatgtttatttgtttatttcatggctttctttaaaggatttatgcatttcttccaatttcttgtttctttattcccatcttttattaaaggatttattaatttcctctttaaagaactctatcatgtccataaagttggtttttggtgttagtttcctgtgtttcagctctcctgaaatattcaggtcttgctctattagcatagctgggttcttgtgttaacatgctgccttggctattgttgcttgcatgcttacattaacaaaccagaattagtgattgtgattataggtctgggtatcttattctaagtttgtctttgttggatgtgtatttttccctcttttgtctttttctggtcgttgtggcctgggtttctgatagctggtgtgacctgtggtacaggagaagaagtatctgtctgaattggggttgaacttctggtgactattgtggcctttgattcatcagggttctctgcctcagagtgtggaatgtggtgatgaggagggtagtgggactgaggatataatgtcagaaggatatagtggcattgagagattggaggagttctatgtgcagactacctgtctggaattctggtggtctgtagggcctctggttctgctgtttgtctccgcttgacttgccagttttttttcagactggtgtggactgcaccagatcttctcatagccatgacctgtgcatgagtagtgaatatctgtccaagttgaggggaagagaatggcagtggatacaaccagggaggcaggtaatagattggatatttgtgaacccaactgaaggcataggaatgcaggcaggctaacagcctatctgtttttctggctggccttattttgtg

SEQ ID NO: 1232 - DNA, 1400 bp, mus musculus
acattgtagtccctgtttctctgctcacaatgtcttctaaaagaatattaatgagaggctctctgctcatccctgttccagagacagctgcaccttcttgtgcagtgccagccttgtcctgtagacaaaacagtgaaggttggtatggattgatttggccatattgggtgcttggttaccagggctgccttctgttctgcacttggcaaagtggagattgttgtcatcaacaaccccttcattgacctcaactacatggtctacatgttccagtatgtctccacccatggcaaattcaaaagcccagtcaaggctgagaatgagaagcttgtcatcaatgggaagcccatcaccatcttcgaggaccgagataccactaacatcatggagtaattctggtgctgagtatgttgtagagtctactggtgtcttcaccaccatggagaagactggagcctacttgaaaggtggggccaaaggctcatcatctccccccctgctaccaatgcccccatgtttgtgatggctgtgaaccatgagaaatatgacaactcactcaagactgtcaacaatgcatcctataccaccaactgcttaccaccccaacccccacccccggccctggccaatgtcatccatgacaattttggcatcgtgaaagagctcatgaccatggtccatgcaatcactgcaactcagaaaactggatggcccctctggaaagctatggcgtggctgcttaaagcattatccctgcatccactggtgctgccaagactgtaaacatggtcattctagagctgaacaggaagcacactggcatgtccttccgtgttcctacgctcaatgtatccattgtgaatctgacatgctgcctgaaaaaacctgccaagtatgatggcatgaagaagacagtgaagcagacatccgagggctcactgaagggcatcctgggttacactgaggaccaggttgtctcctgcgacttcaacagcaacttccacttttctaactttggtgctgaggttggcattgctatcaatcataactctgtaaagctcctttcgtggtatgacagtgaatatgggtacagcaatagggtggtgtacctcgtggcctacatggcctccaaggagtaagaaaccatggactacccaccccaccaaggacactaagagcaagagagaagcccttgattgctgagaagtccctgaccctactagtcctccaaaactgagatctcctttacaattcccatcccagaccctcataataacttacagaagttacaggacttacagaaccctccctactctcttgaatactatcaataaagtttgctgcaccccctaaaaaacaatattgatgagaacattcttccactattggctcccaccttc

SEQ ID NO: 1233 - DNA, 1000 bp, mus musculus
gacaccctgccaccttgtcccgattcctccggaatagcgggatctaaggaaaagtttgccccgcacggcgaagcggcgcgcgcgagctctggcagactccagcaggagtttgagctataaataactgcatcactagggggagaggtgcctgcagccagcaggcctctcttgctctcctcctccggtgctacgtggagagggttctgattctcggagcctgagttctttagatgcagacaagatgtttaagaggcaggtggtagggaacgcgcccgacttctcggtggcgacgctcggggcgctccggcgcgcaatcaggcggtggcgttccctgagcgctgctacccggaggtggcccggggcatcacggcacccaaggagcttggccagcagcgccgcgagcaggtgcgcggcctctagggcagctggggtggcgaccaacctcccgggtcccctttcccggttccctagcgcggcaggagtggcccgggaacgctgaggctaattgcggccgctgctctccatcccgacagtacaaccgccgccgcgccctcagaggaggcgcttcccgaaagcccgtctgttcctcgcgactcctgcccaggctgggcgccacccgctccctggagtcccaggtctggaagtgtaatggacgctaggttggcgggcgcagccgtctggctgccccgccccgccccgccccgccctgatgctcgggcagcgctggagcctccaggctcaccgcagagccgcggctctggactcccggtagcggccagctgccctgtgccttctccggggcgcgcagtgaggctgactcggtacggcagtccagagggaagacggtcacggggcgattgcattcagcactccagagcttccgaaagcctcgccagctcggtggccaccttctacttcctcttgatttgccggtttctttgctaagttgccggccagcaggtagccgaggggaaaggcatagcaggagaggataatctca

SEQ ID NO: 1234 - DNA, 1000 bp, mus musculus; identical to SEQ ID NO: 1233

SEQ ID NO: 1235 - DNA, 1400 bp, mus musculus
gatattaataaaaagctaccacaaacagggtttcaactgaaccagcactagctgttatcaagtcagatcaagcttcaggcagggcagttgtgttttgcaattcatgtctgagaaaaaagtttgacatgggtgaagcttatgacctgtgatctctgatgtattccgtgtggttgtgtggtttccttgctctgtgtgagatgtgttgccacagtattcaggaagtgagtctaaggagggacagtctcctggcacatggctacatataagttatacagctcagacaacatctccctttctttctattttagatgtactcttcatagagcaacatctcttccgggactacagatccctctatatagtgctgtcttccagtaaccgtttttctccccgtttttccctaccatgtaaggatacaaaagcaaggataacttcatttcataaccttttctagcactcataataagaatcagagcttcttcttctttcaaatgcaggattttctatagtagatccagttttatacaatttacaagagatgctagtaaataaaaatgatctaactcggagagtatgtcaatggttaccatcagactacatgagcgagagtaatggaatattaggaagtaaaggcagagaggagatatgaattgtagtttggtaaggaaggttgaagcctaggctgtgctatgatacttacatacgtgaccaatggacaactggagatcaagaaagtaagggatcatgaacagtaaagcaccacctccgtggtggttaatgtcagcgtgagccccggagctagtagatgacagccccttcagatagaaagcacaggactaccagctgctatgtaaccgtcaagcccaattcagaggttgtgaacaaaaggctcacagaacagaattacccaactggtaagttctgtgccctgctaaagagactgcaagctgagaaataaccaagctttctatatggagatgaagagctgaaaaattactgactctaagctgggcattggtggtgcacaccttcaatccccgcacccaggagacagaggcaggtggatcgcttgagttcttggccagtgtggtgtacaaagcgagtaccccaggacagccagtgttacacagaaaagccttgtcttgaaaaaccaataaataaacaaatacataatacataataagtaaataaaattactaaatttacagtgatatatttttacagatgtctgatttatttaatgaatcagaatgattttatagttatttattaacagcagacattgatttctaaaattttactctttgaatatcacatatagttatgcatttgtaaaatatattttcatcttaggaaatatgttttagactctaaaaattcctggactgctctccaaatga

SEQ ID NO: 1236 - DNA, 1400 bp, mus musculus; identical to SEQ ID NO: 1235

SEQ ID NO: 1237 - DNA, 1400 bp, mus musculus
ttccagatttctttcctaggttttctatcgccagccttgcctcacttcgggttttctttattgtgtctacttccctttttaggtctagtattggtttgttcatttccatcacctgtttggatgtgttttcctgtttttctataaggacttgtaactctttagtagtgttctcctgtatttctttaagtgagttatcaaagtccttcttgatgtcctctaccatcatcatgggatatgcttttaaatctgggtctagcttttcaggtgtgttgggctgcccaggactgggcgagggggaaatgctgcgttctgatgatggtgagtggtcttggtttctgttagtaagattcttacatttgccttttgccatctgaaaatctctgtagttagttgttatagttttctctggttagagattgttcctctcgtgattctgttatcctttatcagcagacctgggagaccagctctctcctctgagtttcagtggtcagagcactctccgcaggcaagctttcctcttacagggaaagtgcacagatacctggcctttggacctctctcctggcagaagatgaaggccagaaacaggacgtgccagaagctgtgttgcttaggcaggcctgtcatagaggctgtcagcttgtgtagtccacactctcacctacacagactagtctcagagggatctgggaaccaagatggctcccccaggagctcaagcaaagccctcctgggcacacctttcctctggcacggaaggtgctaggatgtctggagcccgaaatggggtctgtctcagaagctgccctctagggaccttgggggtgtctgcagactctgcccccaggtgaccaagtgctggtgccgaccggaagggacttgtgaccctggtcaagccgggtttcctgcttccttaatgctgtctcaggtccctcacgattggattgaaatggaaatcgtgttccactcactggtggtcctaagattgcatggagagtactctaggggggcttggggttatctgccgactccgtgcctaaggtgccctggtgctggcgctgaccggaagggacttgtgaccctggtcagctgggtttcctgcttctctaatgctgtctcagccattccatcactcttaaaagctctcggttgttatatgtgaagttatgtccatttgcttaagaatcagattatgttatatgccccacaaaatgaattgtgtttattaattataattaataattatgagttactattcatttcagttacttgaatatgttcatttaatattccatataatctcaggaggaactatatgtgctgtgaaaagcaattttactgaggatttggcttgatataatatggtataagaatacacttatggttcatgaaaaaat

SEQ ID NO: 1238 - DNA, 1000 bp, mus musculus
gatcaagcggatcatattaatttttgtcacagatataaggtttctctgtgtgaatacttttacctagcattagctccgccttaattctgttcctataatgagatgatataagatccatttatataacagattgtcatttttattgtcatcctgtttctgctccagataaggagcaattttgaattctgaactagtaaccttgggcttcagagttcacttttcaagatgaagcatattacaaggctttaaattttgtttcaaagaattcttctaaaataatagtaagatttttttcctttctagaactccagagaagcccatatatccaacgaacaaatttatcaaacagtcatctcctcaggactataaattactcagatggtcaaatccacttgcctataaacaaccatttactcactaaaattcatgccttgtctccatatatcttccagccctaaaatgctttattaacctcttcaattcaatcctgtattgaaagatttgcagtaaatcaccagcaaaagagattctgagactgtgaaaatagccttaaacataacccaggagacaccaatccagtgtcaacatggtgtcaccctagtgcagtcagtacaaattcaggctttcctttctcaacaggtcatggtgtttttctccctgaccccaaaattggaagagattttactttctatcagttacaagggactgaggtctactgtgagttctcttggagatgatgcccaggatctagccttggcccaagagtattataaagtagtttgtttgctccgtgatgtcctagtcactgttgcaccagagagcatgcattgcaagtccggtcatgatcgcagcttgcagaggtcatagctgtgactctttgatgattatttttctgcagtattatacataacactttccaaccctgtttaaactggatgtaagcaaggtaacaggggtgtaaatttcaagagagcttgacttcttgatattcaatgattca

SEQ ID NO: 1239 - DNA, 1400 bp, mus musculus
ccttgggttttatctccagtgttgcctcactttgtttttctttattgtgtctacttccctttttaggtctagtattgttttgttcatttccatcacctgtttggatgtgttttcctgtttttctttaaggacttgtaacactttagcagtgttctcctgtatttctttaagtgagttattaaagtccttcttgatgtcctctaccatcatcataagatatgcttttaaatctgggtctagctttttgggtgtttttgggtgcacaggacagggtgaggtgggagtgctgcgttctgatgatgatgagtagtcttgttttctgttagtaagattcttaagtttgccttttgccatatggtaatctctggagttagttgttgtagttgtctctggttagagcttgttcctctcgtgattctgttagcctctatcagcagacctgggagactagctttctcctctgagtttcagtggtcagagcactctctgcactcaacctctcctcttacagggaaggtgcacagatatctggtgtttggacctccctcctggcagaagatgaatgcctgaaacaagatctgtcccagaagctgtgttgcttaggcctgtcccagaaactgttagcttctgtagtccacactcttacctgcacagactagtcccagagggatttgggaaccaagattgctcccccaggtgctccagcaaagccatcctggcagggaagatacctctcatctggtagggacggtgccgggatatctggagcccgaaatggggtctgtctcagaagctgtcctctagggaccttgggggtgtccaccaattctgcacccaggtgaccaagtgctggcgctgatcagctgggtttcctccttctctaatgttgtctcaggtcctgtgtgattggattggaacagaagttgtgatccacctactggtggtcctaaagtcgagtggaaagtcctctaggggccttgggtggcgtccctgactctgcgcccaaggtgaccctgtgctggtgctgactggaagggtttttttttttttttttttttttttttttgggtaattgcttacagtttttctccattaaagttagtattggatatgagcttgctttaaattgtctttactatgctgtggcatgtctcctctattattacaatgatcaatttcttttagattttctagttgggtagaatacacatttaaaagtatgtccttagtattctcctgacttttttcatagtgtcccttattatatttccttttgcattttctgttctgttaatttggatattctccgtctatctcttagttaatttggatgaagtttttcaatcttattgactttctcaaagagccaacttttcatttcattgattctttatattgtt

SEQ ID NO: 1240 - DNA, 1400 bp, mus musculus
tgttttccaattgcacttttgaatttttaagctatatatttgtttaccttaagtcctcatcagtagttatctctttactgcattcagtgtcaaatcttgagttgacttcatcatttcattcagacatatatccatcttttcttcaacattattcagacatttattacaatctctaattattcttgagcattttttttatttcttctttaaactccttgaatttcttaataggtttaataattgttttttacattctacatcttcagatttctgaatgtgattgccattggacaacatttctatatggcaggtgggcttaattagtagaatggattgtctttgcacttagtaatgttagtgttttgcattacgacctactcttgtcgacatatcttctccattatgtatgtgctgtggtattattttggggcagtcctttggttgggcttgtgcaggagctgagtgacaagactttaggtttggagtatggagatagcataagtatgctcacttctctgtggacaaaccagggagatttcatacatgagtgtctacagcttagcctagcagtggactgcagatggcacaggtcgccgagagatgcacaagggaaaagcagtgaccctcatgtaaaatattttaaagtacttattttctctaataaaatgttttaaatatttgaaggcttctttaaatgttaatcattgttttatattttccttaagtattgacatataatatttcaaaataatatgtatctgagaacatctattgcatcataactacattataaaaatattgagattagtcgagaggataatgtctctccttcagttacttacacaatgttatttatctctatgtatttatatttttctaactatgccacatgctttgtccacttagtgttaaaacatctggatggaaactaggaagtgtagcagcaagcccagatggttcataagaagaaggccaagcatccagatggagtcagcaaggcagagcatctggatagcaaataccaaatccttcattcagatgtcacagctccacatagactaagtatcaataaagtctttgtgatgaagacagagtattatgatatcagctgaaggtcaaatcaaagagaacaaatatgggcaagaaggcttagagctcacacattcatttttaactctcagcaaaagtaatttgtagttgtttaacatgtaacatacttcaagaaaaatctaagtgaaagagactcagcttattagattcactttttaattgttaccctgtttgctaatcttttgatttgggataatcttcaacacagctcacgtgtataataaatgggctcaattaaaaattgcatttgatacccattaaaagttccttgatctttaatattacaatat

SEQ ID NO: 1241 - DNA, 1400 bp, mus musculus
catttttttgaatgttgtttcaatgttttctatggtatcttctgccctggagtttctcttttctatctcttgtattctgttgttgatgcttgcaactatggttcctgatctctttcctagggtttctaactccagggttgtctccctttgtgatttctttgttgtttctatttccatttttagatattgggtggttttgttcacttcctttgcttgtttgattgtgttttcctgtacttctttaaggggtttttgtgtttgctctttaagggcttctacctgtttacctgtgttctcctgtatttcttagaaggagttatttatgtccttcttaaagtcttctatcattgtcttgagaagtgattttagatctgaatctttcttttccagtgtgatggtgtatccaggacttgctattgtgagagaattgggttctgatgatgccaagtaaccttggtttctattgcttaaattgttaaacttgcctcctgccatctgattatctctagtactacctgcccttgctatatctgactggagcctgtccttcctgtgttcctggttgtgtcagaactcctaagagtccagctgtctcgatgatcctgtgattccaggatcctatggtcctgagatccaggatgtgacagagctcctggaagtcaagctgcctctgggaccctgagatcctggtgtgaccaagaccctgggatcctgggatcccaagatcttgggatgccgggatcctgggcatgttagagtgcctgggagtaacccttcctctaggtgttatgggactggctgaggagtttgtgcccaaagtctgctcaaggcacctgctcagacaagaagcaacctgagccactggtcaaactggatttcaatgtccctgtatcccactggtcccagttactcccagtgttggaacacatgttgtgtcctccttacttctgatcctatgatcctcagaaaacaacaatcttatagtaaactctaaaaatataaaatatcttggagtaactctaaccaagctaattataaaaattgtacagttaaaatatgtaagtattgaagaagatagaagaagattagaaggtctcccaagctcatggatcaggagtaatatagtaaaaatagctatcctactgaaacaatctgtaaattcaatgcaatcccaccaaattccaacacaattgttcacagatcttaaaagaacaagtttctccttcaaatggaaacaaacacacacatacacacacagatggctaaaacactcctgaaaataaaaaactacttgagataaacactgctccaaactcaaactgtacaataaggctatagtaataaaaacagcattgtttgcgcacaaaaacaaacacacaggttactgaaatttaattgaa

SEQ ID NO: 1242 - DNA, 1400 bp, mus musculus
aagacatcaaaatgtgaatatgatggtctccttcaattatgagtaaaaggttgtggcctttaaatttttgctgatattcctacagatataagtcttgtacagtgaccaagtaatgttttataaagtttaataattgtgtttctttaacttagcttttttccagtttcatgattatttcttgttttcttgtaaaatcaagtactgactgtgaattttgaactttttataatagcttgctgctggttgcaggagggacagttctaaaaatctgcgattttggtacagcttgtgacatccaaacacacatgaccaataataaagggagtgctgcttggatggcgcctgaagtatttgaaggtacagtccgagagcatggaatggtcggtaatgtgccccagcgcttgtaaatccaggatgcactctaacactgcacatcgtgtcgcttctgaagagtacagaaaaaggtctccctgagtatatagcctgagagcccaaattttatggcagaatttaaattggcaccttctgtgcagattctcaaacatggatagccgatcctcactattcacaggttgcataattaagaacctgtctgcctgatcacctttgcttgagatgctttcaaaactgttgagaaaaaggaactcatgaacagcagtacacattttgtaaggtaaacaacttatccagagcggtgcgttcccttttcagggatggtcatggtggcttcgctgcttaagtagagctgcctgagtacaggaaggctttgaacatgtgggaagcgtgaaagtacgtgttagagtattctctcaacgtgctctagagtgccgtgaggggggacgagttaaccagtcaagtgttaggtgaagagtccttaaaccacacagagaaccaggtgcagatactgattagctgacaagtgttcctgaacaaaggcacagagcaacttagctctgtattccccctaggaacactgggtcagagactatggaggcttctgtatacacccaaaataaggagaaagctgtgcctttgctctgatctgctatcagttaaaaagagagctaaagcttcaatcagcatgccttaaaaagaccacatgccactgagtacagataaggtacagtaaaggatatgctaacagttgctttcttttactacatggtggctcacaaccatctgtaataggatccatagctcactcagaatttataagattagtctgtatatttaagtttctatatgaaatgtcaaattattttttaagtaagagacactgagataaagaaatgggctttgtgtgaatgccataatatgcaaagtgcattcaagaatcaggcttggcttgcttgctttcttccttttttaatgtatgtgagtacactgtagctgtctttgga

SEQ ID NO: 1243 - DNA, 1000 bp, mus musculus
ctttgttagtgaagttgggaagagctgaactgtacaatgtcttagaaattgaatggatagagaaagagtggtgtgtatggatggaaattcctggcaaagaagttaagccaagattccaaggccaagatcttgagttctgtgttgactgcttgcaacaccttagtaggtcaaggatgctcaaggcaaaaggtgctaagagctcacaggacaagttccctaaactgcaaccttgtggtatctcaacaggaagagctctgggggagtgatgggcctgtgatcgggagggggcctctgcaacaccattcacacggttcctggtgcacactgttcccattgtggtaaactagatggtacagataccatgcatttctcttctaagtctaaatcatgaatttcctcctgaagttaaaaaggtgcactgactcatccagagaggatataaagcagaaagaaaatgttagctgtaattaagtttaaaaagttgcctcagtatcttcacacctttgctgcttcaagcgtttctgaattctggggagcctgtgccagctccgcgccgtgccgctcttctgagcacagccctcctggaagctccatctcggtgctatttccgtttcttatctggagatacctcagcttaccaggcacacttcttcctgccttatttgattgcatcgtacctgtattttaccgcacacgttcaccacatccaatttagtagacttgtgtggactttctgtcaagaagagaagaaattgctgatccatgtaagccaatcggaatggtatcctgttgttagactccaagggcatgaaagctcatctcagcttagctgtcaagactcagatagttttaaacaaattattcagcagggagccctggtcacaagccacaggatggatggacaaggcttgagaggcacagtatgtgagacccttgtcattcctgtccagtcgcagacccacttgtgtgatggctgccttagagtggggatgttagtcag

SEQ ID NO: 1244 - DNA, 1000 bp, mus musculus
tgagaacgcgtgtaagaaggatccccgaaaataaacacagtgaaagaagaactaagaccatggctgagattatccatccccagggtaatgaggaggccaatagaggacactatctctcttagagtttcattgctgtgaagggacactatgaccaaggcaactcttataaagcaaaacatttataaactggagctggcttacagtttcagaggttcagtccattatcatcatggcaggaaacatggcagcattcaggcatatacagtgtcagaggagagtttcacatcttgatctgaaggcagccagaagactgtcctttgcagggaaccatgaggagactatcatcctcactgggcagagcctgagcatagaagaagacctgaaaggctaccgccacacacagtgacacacttcctccaacaaggccccacctcttaatagagccattccccatagactaagcattcaaacatctgagtctaatggggaccaaacctattcaaaccaccacaccgtccaagtcaggaccgtagggctgaagaggagcaagcatggttttcttgctaagctgacaacatgttcagcagagccagagctatggggcagtgtggttaaacagtgccacgtgacagaataagaggaagggggtgaggaccacagtggagacaacactaaggcaggtggagcgtggtgtttggggcagaagaaaccagagtgtgacaaactctgtatacccttatgagcagagtgaccttacttggcaaaccattggaagtgttgaaagtttaggactaaggtgttgggatgctataactaatcttaggagagctaaccaggaagggctggagtggtggctcagtgggtaaagtgtctgctagagtgaagacttgagttcacagtataagtcaaagctgggtgtgatctgtaacctcagcgctgttaggaagcggagacaaatgggtgccagagcttaccagccagcaagtctaggccaaagcag

SEQ ID NO: 1245 - DNA, 1600 bp, mus musculus
aactcagtggggaaacccccactcagctcccgattcggcgtgcacccaagaatcacgaatagaacacaacaccttgatgtaacaacaagaggttttttaatggcggagctccgggtcgaaacgtatctcacataacaggagacagtggattcgaccacgaggcttggaagctaggggtttttatagaaaaggagtggggctgggggaggaattggcgcggtttcacatgattggtccatttaaacatcagcagcctgtaacatttaacttaggtcagaggggtgggagctagggaggcgatgggcttgcccgggcatgtcctggtctgttctgctatgttctcagccccaggtttcaaagctcagaaacaactctttgggctatttaacatacattacatgaattacagttttatttcctttcactacgtcagaaaatccagagtagaagttgatccatccactttagaccaaccaaaaacaaaaaagaaaaacaaaacaataacaacaaccttccacagatgtgtcctccatttctggattgtagacaagattccagttgtagtcaggttgataaccaagaagagtcatcaaactctgtaagattaaaaggcaaactgcattcttccaacatacagtggcacagaatatatattaccattgcaaaagagaggaaatgggacatagtaaacatatattgaatcaaagctaagaatgaaagccagcaaggcaaacttcaaatccttcaaatctaatagtttggatggctctgccctcgcagttttgctgggtacaagctattcctctccttcaggctgatcccagtccccgtgtggagcttctcttggcagatatgccatagctctggcacctctaaaatggggtctccaatgaactctaggcttcatttttaaagctccacacaatagcctcttggggactccatacagggagtgccctgtcaaatttttggcctcagtggctctccttaaccatgaagaaagaattcccagccctttactgggcttccttcatgactccaaagccagaaccacatggacaacatgtcaagttcagctgcttgcttaggtggagcctgacccttgggatcacagttgcagcagctgccattggttgtgcttctgagaaggagacaattctttaggtcttttcttttcacaagtttataggcttagctgggttggggcttgctcttagggtctacctccttttactccaaatcagacctctccttgatctatttagctctttcagcaaaagccttgactgcaactttaaatcccctgctgctgttttcctctcaactgtacttgttttttaaatgccgcagttgttcttttcattgtagatctgaaaaaagaaatttataataaccacacaactgagtcaatgttagactgtcttaaaatcttctctgtcaaaaaaaaagttcattaatttttcaatttagcctttggaaaattcgtagaacaagggcagaagacagtcacattcttgtacaaataatgatctctagcctagttgctaatgttgctcctcgaaatgtcttgagttagtattccacagtccatgtttctctc

SEQ ID NO: 1246 - DNA, 1400 bp, mus musculus
ttcagaactgcataacggggaagaaggggttaataaagtgttcccataaaacagactgttgagaaggatctggcgtggattcagaactcttcagctggggaacggtactgatgaagagaaagaagaaagatgaagactgaataaactgctgttagaaggactggtggtcacgtcgttcttgctggtcgagagcgggcgtgacaattaaaggtgcgggacaaggcaggaagagcttccatttcgccagcgccacctgaggatttcctggagccgccacccccacctcccgcgatggaagacgatcaggagctggagaggaaagccatagaggaattgctaaaggaggcaaagcgtgggaaaaccagagcggagacaatggggccgatgggctggatgaagtgtcctcttgctggtacaaataaaagattcctaattaacacaattaagaacacactgccctcccataaagagcaagaccatgaacaaaaagagggcagtaaggagcctggcaaaagccaagaccagaaggaagcaagtgggaagaagtaccgaagtcactcgtacaagcgcagccttcactcgtcccggggctccgcaggctgctctcctccacggaagcggacctcccggacctcccgggacaagtgcgacccacggcccagcaggcgatgagacagccgcagggctagcccagcccagcactgcacctgccactgggcgcagcaaagaagacagggaggtggccggctggcacctgagagtgactttctcagtgggtcctttgttttaaggaggctgttggtactgtgtggttgttcttgttgctgttgttgttgttgttaacgggagaagaaaactttactaaaacaaatcttaactaccttatcctgaaggtgtcgcggtgagagcaagctgactcggcatggcccccgcatatccgtggtgtctttatcctaccttacttggaagttcgtttcaaaacaggcagttttagaatttgagattttgagaaagtttaaaaactcctagttttttgatgtactgctcttttgtggtcatttcccagaatttctcaaaaaaatcaataaaatacttagaaacgcaaaaaaaaaaaaaaaaaaaaaaaaagaaaaaagggggaattgtggggagcgggtgtggcggcagtcctaaaggcgccagggactgcagctaagtcatatgacttgcacctgacttcctcatataagacacaaacatcttgagtgctgcgcaggtgtaccaggatacaggtgaatccaatttggtggagatttgcccctgctgccctgattagctgaagcctcgtgactggcgaggtggcgtggcctgctgtgtgtggatgggaactgagagtataaaagagtgagaggcccagggtt

SEQ ID NO: 1247 - DNA, 1600 bp, mus musculus
gaaatcagtcttgaggttcctcagaaaattgaacatagaactatctgaagatccagcaataccacccctgggcatatacccagaatatgctctaacatgtaataaggacacatgctccactatgttcatagaagccttatttataatagccagaagctagaaagaacctagatgtccctcaacagaggaatggatacagaaaatgtgatacatttacacaatggaatactacttagctattaaaaataatgacttcatgaaatttgcaggcaaatggatggaacttgaaaatatcttcctgagtgaggtaactcactcacaaaagagcacacatggtatgtattcactgataagtgggtattagcccaaattttggaatacccaagattcaatttacagaccatatgaagcctaagaagaaggaagaccaaaatgtgtatgcttcagtgtttcttagaagggtgaacaaaatcacaggagggaatatggagacaaagtgtggagcagagactgaaggaaaggccatccagagacttctccacttggggatccatcccatatacagccaccaaacccatatgctattatggatgcagggaagtacttgctgatggaagcctgatatggctgtctcttgagaggctctgccagagcctgacaaatacagaggtgaatgcttacagccaacctttgaactgctgggtccccaatggatgagttggataagagattgaaggagctgagggaatttgcagccccatggggggagcaacagtgtcaacaggccagatccccaagggatcctggaggttggatcaccaaccaaagaatacacatggaggtacccatggtgctggccacatatgtggcagaggatggccttgttggacatcagtgggaggagaggcccttgggcctaagggtgttcaatgccccagtgtaggggaatgccagggtgggaagacaatgggagtgggtgggtgggtgtgggagcaccttcatagaggcaggggggcggggaatgtgataggtggcttctgaatggtagacctggaaaggggaaaacatttaaaatgtaaataaagaaaatttcaaaaaaaaaaaaaaaaaaaaaaaagaaggtagactggtgaagactgtcttcaggctgctaggaggagggtctcaaatcccacccctacttcttcttctaataaggccacatctactccaaagccatacctcccaatagagtcactccctgggccaatcatattgaaaccaccacaacattaaaaaaggacctttaagtacaatatcatttatttcacatttattgacatacttgtacttacttaatgactccattttcttctccaaggaaataaccaggcttgtggatttgtaggagttcaagagcccagggctcagggcagtgtaattgatagttgtttattctgattcttctcttaatgatgcttctacattgcaagagttcttcctattctgtgcagcattcatagattccttgggtcttgctgtccttcactctcattctctatgcctttcagtaacaatgtgaataacctgccttcagagtttctgagcggtagtggtggtg

SEQ ID NO: 1248 - DNA, 1000 bp, mus musculus
tatttgattttcatttccctgaagagccactgatttccaggtcactactattctgcgacttagttcttgatctgaaatgacttaaaattcacttggcttgcccagactagatttagtcttttctgtcgttgaaatgtgaattcacattcaggtgaggtttgcacagtgaaactcacagtctgaggaggtggggcagagtgctttgagcaacagcgtgcctctagtctgaaataggaagtgtagagaaggcaaaatactgttatttttcataatgctcttttttttcttctaggcaaacaaaattagactttgtgccagggagaggcaatgtgtagcttagggaaaattatgaagcagaaggaaatggagtgaacaaaagataaatattcaaaatataatcacgccctggaagtctcagatgtactaaatcctttatgaattgtgcttcttttcatgaaatactagatataatcatgggcaagtatctgtgtataggcttcattagcatactcttcttgttaagtgtagcaaagcttagctacagtgtcgcaggaggaaaagaaaatggacccagagagaaaagagagatggcagtttagatttgtttggggaaaagtacatgtccctggaaactgtacagactttaattttaatgaaataacacaattcaatgtatatatttttacataacatcaataaaatactatagttctggaccatttgggatctctaacacgacagcaacagataattgtctttgtaaggagtatcaacaagcaagaattctctttcttttcttcttttctattctttctattctttctattttttctttctttctttctctctctctctctctctctctctctctctctctctctctctccctccctccctccctccctcccttccttccttccttccttcttaccttctcttctttcctttttagactttaatatcggaaaacttgaaacatacacattactgacttaaactt

SEQ ID NO: 1249 - DNA, 1000 bp, mus musculus; identical to SEQ ID NO: 1248

SEQ ID NO: 1250 - DNA, 1200 bp, mus musculus
cccagtagaaactctacaagggacagagcagtgagccatgctaacagacaggcataggtgcctgacaccatggagtctctagctccataatcctgtgactatcagtcatgtctccaaactcatgctattgctgccagactacacccccacagtatctggatatagccaggtaagttcctccccacagttacctgactgtaggtagcctagtccactataaaagtggctgcttcactccccctgtctcttaagctcctatactaatgctctcttgctttgctcttacctcttgccccactttctacccccctctctccatgtggccatggctggcctatccttttctacaaccccccccccccccgcctttctacaataaatctctaaaacccatagactgtctctactcatcaagacccgccatgcttgaacgatgaaataggccttcccctaaagagcagtatctaatctccagagggaaggcttcccagattttccaggtgccaggccagaccaagggctctcggccaagtaggaacctaggaactgtttgcgccctctctttccctgccttccaacccagggctgaccgagctgcccccggaaccctcactttgttctcagctcttccatgacctacagtgatgtctgggatgtccaagactgagaacctgtagtctctggcttctgtgaggtccagagaccccggactgctccctctctaccctctgcagactggggttctgtggcttctcacagccagacacccacttgggtcacataaagaatgcacaggggtccctgcgtctgcccacccagagcaccggaactctggagggatgcgggcactttctcccatcgcctttatttcccagcaactcactgcctgacaattgaggttgaaatgtccaaggaaatatgaaatatttttaccagttgaaggttaaaagatgacaatttgtacaaggtcaagacaggtgaatgccagcatgggtggagatggggccttgtgtactgaggagacactggcagttgataaatgctggaaaagagagtatggtatgtgaccactggtaaataggggctggacccacacccatctgaatattagcagcactgaatagaggaagtgtgaggggtggatatgatttagatatattacatacatgtatgcaattttcatacaatatagacataatg

SEQ ID NO: 1251 - DNA, 1200 bp, mus musculus; identical to SEQ ID NO: 1250

SEQ ID NO: 1252 - DNA, 1000 bp, mus musculus
agcctgatgtttttagtctttttcatatttagacttttctattaccaattcctgaagctgccttctttacttttcaaacacaactaatctataagtaaagtcaatagatacatttttttacttttactatgcctttttttctttcatgaatttgttcttcagtaaaagatgcatctctctctggcctggtgacccagtggaggaggctgctcccctttttcagaggaaaaagggaggtaggaatgaggtgaggatctgcatgggaggtgttggtaagggaaagtgtgctgatagtgggatgtaaactgaatacattaattaattaatcaattaattaattaaaacccaaaaataaacaaacaaaaagtggcatctttctctttatttcccctgtccttacaaattgtctatttttaaaaaagcctttagtatattaattgcagtttaaaaaggaagattctggtatgaaaatttcaatttgttgtcatatctgaatctagtcctgcagttttcagtttctttaatgttttccatattaatcagctatgtaagtaggaataatagatgctaccatattagctttattaaagcgaatgttaaggtagggaaaagagaattacaagtgtatggtatgattttataatctcagtgtcttagtgatcttgttaccgggagctgtgggctccacagtacttcacagtcccctctttagtggtgcaaatggctagggcgccttgatttgctcatttattttcttaatgcacaaagctagaggcaggtagaggtggggtattgctttcccttgaacagtctgacaaatcctcagtaagttaagctctgatgaaaggttttctcttctaagtgtagatcctgttagtaaggacagaatgctctgctctatttaaaaatggctaatctttcccaattcctgccttaaaaagaaaatgaatccccactgaacatcaatgagcaaacctagtaaggattaagtagataaaat

SEQ ID NO: 1253 - DNA, 1000 bp, mus musculus; identical to SEQ ID NO: 1252

SEQ ID NO: 1254 - DNA, 1000 bp, mus musculus
actaatttgttatacatttctcttctatgaagaaaaacttttagttcgtctaagacacataaaaatttttttggcatttatacatttaaaaaatattttctcatacagtacattgtaagtacatcctctcctctctccactattcccaggtctcccatcccactttccttttccccagatgcactgttcctccatttccttcttataaagcaggtatcccagggatatcaactgaacagggcataacaattatgctataagacaaggcacaaaccctcatgttaaggttggacagggcaacccagtaagaggaaaatggtctgaagtgcaagcaaaatagtcagagacatcctccatacccattcttaagagtcctacaaaaactccaagtgaaacaaccacagcatttgtgcagagcgccaactgcaaacctatgcaggctctgtggttccatcttcagttactttgaatccctcgtatatacctcgtatagctctgtgttcagtattctagcatgccatacagctaggcatgatggcacatgcatataatttcattaattgggaggtgacatatgtgcagattcaaggccaccctgagatatagaggactccaccttgaaataataaaaagtgctataagagacataagtatttaaatataattatgtaaacacatatacatacatgcaaacacacacacacatgtacacacaaaccaatatcagaaacatcacattagtagtaatgactccaactctaccagctgtaggcagagtcaaagatgactgtgcacattcattcctcatgttaaaaagacactcctgtggatgcactgctgagatcaggctttgtcagctctacattacaactactatggacaatattgctttttcaactgagcgttgccacaggacactatttctcaagtagtttctgaccccattgtgaagataacagtaaccctgttagacatgtgaattgctctgtttatatggaaa

SEQ ID NO: 1255 - DNA, 1000 bp, mus musculus; identical to SEQ ID NO: 1254

SEQ ID NO: 1256 - DNA, 1000 bp, mus musculus
acagaatgaaaaataattgatgtaagagcatcagagaaggctccccagcctgtacctgggatccttctgggaaggtgtctgtgagagctgccctgctttatcaaacagcatgatggaagggcaagtgggcacatgccagtcatggaaatcaatgtgggatcccaagaactagcctgctcatgcccacacacagaaagagagctctctctacatagcaaagcttcagtcctgaaaagacaagcccagttctgataaaaatccatcaagagggccatgacctaatcagctacctgaaggacccactctttactattgttcctgtatctcttaaatttcaatttgaattttggagaaaatactcaaatcatagagggtagaaaacgtacactttgctactgacagatacaattagtaagctgggtgggatatatttctttttttttttagtcagatattttctttatttatatttcaaacgttattccctttcctagtttcccctccaaaaatccccaatcccttctcccctgcccctgctcaccaacccacccactcccacttcctggccctggcattcccctatactggggacattcacaagacaagggcctctcctcccattgatgactgactaggccatcctctgctacagatacagctagagccatgagtcccaccatgtgttttctttgtttggtggtttagttccagggagctctggagatactggttagttcatatttttgtttctcctatggggctgcaaaccccttcagctccttggatattttctctgtccaatggatgaccttcagcatccacttctgtatttgccaggcactggcagcagttcctctcaggagacagttatatcaggctcgtgtcagaaacctcttgttggcatctacaatagtttctgggtttggtggttgtttatgggatggatcctcaagtgggcagtctctggatggccatttgttcagtgtctgcttcacatttt

SEQ ID NO: 1257 - DNA, 1200 bp, mus musculus
taataatatatgccagagaaattttttcgatgtaaggttatttaattgacattgtttaaattaaaggaaaaaaatctatctatccaaagagatttaaaagcatataaatgaattataatgtattgactttctaagaaatcaaattcagtaaacagttagaaagaacactattttaaagaacaggtaaaatattaaaacacagagaaaatatttgatgattttcttatcaacttaaatgtgtgatgataaaaaagtattatcttctaaagcagtgcttatctttagaagtttgtcctgaagtatttatagatgaaatgatatgatgcctgggatttgctccaaagaaaatcagaggatgaagggaaatggacgtgtgcagagatgacacagtttaaccagcagttgattgttcaactttgtagttgtatgcagaaagaacttcattatgttatttttattgtatttttttgttttacccttgtgcatgtgcaatggatttatttaaaattataggagaacaaatatattacagaatcataagggatatctgaagcaaaattaataagcttccctggaagcataaacatatattttaatcagtactatggaagattaattcatgatattttcactggagacaaactaaaaaggaaaaaacaaataaaaataagttaatgccttaacaaattattgccttagagtaattgtttttaatgactctgaatgtgatctgaaattaggttaatttgagttggacttggctggcttcgcatcaggctccagatctactggcttgtatgctgtcatgtggcatacgaatgaactggttaaaatcagaaacacctcagcgtaagcatttcatgttgtcattggctttataactcctattcatcatctactgtccaaaccagccatacagcagatcaatggcaactatggacctatattctacaatctagtgggaagagcaacaaattcaggtaaaaagatgaatagatgaaagggaaccatgaagagttagcatggatatctagatagttgctcatttttaatgtttggaagcagtgctaactagaacagactggctagcacatctcaaataattaatatttatttcattacaggagaaaatgagacaatcaatttttctacatcgtgagatggtaccttgaacataccaatcatccaaccaaccatcca

SEQ ID NO: 1258 - DNA, 1400 bp, mus musculus
ttagattttctatatccaggaatccctcagtttgtgtgtgtgtgtgtgtgtgtgtgtgtgtgtgtgtgtgtgtgtgtgtttctcttttttacttctatttccacttttaggtctggcacagctttatttcttttacctgtttattggtattttcctatatttctttaagagatttatttgtttcctctttaaatacctctacctctttggttgtatttccctatatttctttatgaaatttattcatttcctctttaaagtcctctatcatctttacaagattggatttaaggtcactttcttgggttttgcttgtgttaggatactcagggcttgctgttgaagggtagctatgctctaaaggtgttatattgccctggtattttgattgtgttctttcaagggcctttagctgtttggatggcttgggtccgtggttgttcctattgtagtaggttattgggagtggagttaaccacaatggaacttgtttgagaggcctctgaaaggtaaccttgtgctgtatggtttcagatctgcatgtttatgtggttcaggatctacaggtagtatagttcagcagccccaggtcctatgaaggtaagcagagttgtggctggggagagtgttgatctgcacgtgctagcaggatgcttatgtgttgtgtctggccagctgactacatgtttgggttctaggctggaaaggcattttggaaacctggaggagaagaagggctgggtgatgagagaaaatgatgtagctaagtcaaagcattctgatcaaagctcaattttactattcctcatgcagttatgaagcagggagaaggggcccgattcccaccaaataatcttggagtccagtagcagggtgaccatgtgatggcttcggaacaggaaagtggcaggctccagcagtgggcgtggcagaacgattgagtgcaagctccatccaggtgtaaacagtggaaccattaaggctggggaaggggaggctacacttatgcagactggggtttccacaggactcagtaagcagggaagatgggttggtaaactgaagattaactgctgcactaacaaattttaacctttgatcacaccttaaaaagttgatatgaggttgaatgagaagatttattttgaaaggaaatactttcaaaataaatctttggtaattaatcaaaacaacaaggggagtgctagacatataatatgtgctcagtaaatgcattatttcaagaagaatacttacgttcaacagatcttccaccatttctagtatacataatatctgagatggaattaacaggaaatatgtattgggaaactggcaacttttaatgtgaccatattaggagatgatttatatattttttcattatttaatattttttc

SEQ ID NO: 1259 - DNA, 1200 bp, mus musculus
ataaataagtttaacaaaatttttaaaagaaatcctttggtttttttgcaggaacaatgttgtaatccataaattaatgtaaaatgatgccattgtatacaggtataatctctttattgttgaagtatatcacttaataaattccatggctatccaccactaagttctgggttcctgaatgaaacacacacacacagcctttatattttgatatgccttaatcagtgcaatagctgggccacttactaacctccatctggctaatccacctcctacccataatctggagtgattacttactaaatcctatagtccctcttgcctgccctggaaccagttgagcagccctcttggactctcccttggctcctaaatggcagctatgctctctgtctcacaccctctcactcctctcattcctctcctccaccattcctagcctagacagaaatcttcttcctctttcctctctgtcccttgactaaaaatcctaaaatgcttctgtctgtcctccccagccattggcagccaggaccttttttaccaattgagcaagttcccagaaactacataagtgcagttgttctgcaaatagtcttggtgatacaaattaatctaagaatacaagcagacagcatccaacctttggactgagcacatggtcccgaatggagacattagagaaaggactattggacctgaaggggtttgtaaaacataggaagaacaacagtatcaaccaagcagacccctcagagcttccagggactaaaccaccaaccaaagagtacacatggagggaccaatggctttagccgaatatgcaaaggatgggccttgttgggcaccaatgggaggagaggcccttggtcctgggaagactcaatgccctagtgtaggagtatgtcaaggcagagaggtaggagtgggtaggtgggtgggtgagcaccctcatagaagcagggggaaggacgatgggatggaggattccaggggtcaggggaaacctggaaaggggacaataattgaaatgcaaataaagaaaatatccaataaaaaggggtggggggagaatacaagcagccacacctctatttcctatagtatctcagagttaaaagtttgggaggggtaactgagaagggggatatcatttgaaatataaatgagtaaaatgattaataagaaaaaaagttctgc

SEQ ID NO: 1260 - DNA, 1200 bp, mus musculus
taaaatattaacttctgtatttaactgtaaataataactgaagaatacatttgtttctgctgctttcagtaattaccataatattaaagaagtaatctctaatgctagtgagggaatggacttttcattgagggtaagagcgagcagacaaagaaaacagcctccttcattcttgtccatatataagcagccaccagaatgtgctgtccaaattaaaagtgagttttcccacctcaaaagacatagattaaagttatatctccatgcctcaaagatctagacttcaaataatgtaattatgacacaattctgctgcttccttgaagacaccacagcctgaggcatcccaggagatccactgcacatagggcaactgaatccacagcctgaagatattccagaagatcccctacacacatggcaactggccaactgatcaccagcttctctgctcccataaaaacaccacagcttgaaggcatcccaggtgttccttggcacacaaggcaactgggcaatcaatgccacagtctgaagaactcccaagggcttcacagaattcataactgacccaagagactgaaagcctccctgaagatctgctgcacacagagaaacagaaactacaatcagtaggaccccatagagaacagtttcccacaggacaacagcaggactactcctctgaagacccaacagtctgaaggcctcccaggagatctgtgcagagctccaagtacatatcatacagcagaggacttccaggtctgtgttcagtcagagaagctgcacctatccctcaagagactggaggccccagagagtgggggtggatgagtgtgagtgttgccggcgtggggatagggaatggggaaatcctagtggagactggagggaggaagtatgtgttgtggaaaattcagagggtggactgggaaggggataaaatctggagtataaagaaaagactaaataaaaaatttaaaaatgtaatcgtttctaagaggggcattaatttcagaatattaattattttgtttaacataacaaatggccacccaataataacaagattgtttccaaaggggaaaaaagtaaaaaataaaacccctctaaattgtagcatgcatatcctttacattagagttaatacccacatagaagtgagtatataacaagtttttctttctgggtctggat

SEQ ID NO: 1261 - DNA, 1000 bp, mus musculus
gagatgttaaacatacaactcaaaatgaaattaaatctcattacctctaactatgtggcaccatatttgtcttcatctgatgtagaaggtgaattctctgagggattgctgaataagacactgatctatgagttcacagaaatatcattaagtgtcatattggatggttaatccatgtcaggaaatttcataaggtagaggaggttgagacatgaagacttggtggacacacacctgagacttaggtggtgcccagcttcctgccagattcctggcctgtagcctgtgccacacttctcacacagagaaaccatgtgtcctgtggtcatctaggcctgaaacagaattccccatgctaatggggcacctagaggcatggaggcttagccactaaactctacttcccagatattcatccctgacaaaagtatttaatctcagttctaccctgagaaatgggtaaggtacattatgcatccattttctgccatgaacaaccaataaacaatttagaaccattaaatgtttctttttatctagatctgccatggggagtcaaggagaagacattctcccagccacagcctccaccatgcctacacacaccaagctaagaattatcatctctaagacaagccaaacctcccattttctacccaaccttctgtcccgggctagaggttgtccccagactgtaggaccccgactccattttctgtgactctcagtagtgcctggatatccaagagtctgagaacatcatgttttgatttcatcacaggttcagagactcccaaacccatttctgctatcacacacctcagactgctctttcctatctcttgattggtgtcttgtgcttccctacagcctggcacatgctgcaacacaagcatgggataagtgcagtcaaactgcccacctccccaagagtccttgctcagtggcagagctgataaggacccacagagttatttcattgttacttttaaatttcatc

SEQ ID NO: 1262 - DNA, 1000 bp, mus musculus
tctggtaatctctggatttagttgttataattgtctctggttagagattgtttctctcgtgattctgttatcttctatcagcagacctgtgagactagctctctcctctgagtttcagtgatcagagcactctccgcaggcaagcactcctcttacagggaaggtgcacagatacctggcatttggacctccctcctggcagaagatgaaggcccgaaacaggacctgtcccagaagctgtgtagcttcagcctgtcacagaagctgttaccttctgtattccacactctcacctgcacagactagtcttggaggaatctgggaaccaagatggctccccagatgctctggcaaagccctccagggcagagtggacacctctcctctggcagggaaaggtgcccagatgtctggagcccgaaatggggtatgtctcagaagctgtcctctagggaccttgggggtgtcacctgactctgtgcccaggtgaccaagtggtggagctgaccagaagggacttttgaccctggtcaggcagggtttcctacttctctaatgctgtctcagttcctgcatgattgcattggaacagaagttgtgttccactcattggtggtcctaagattgtgtggagaatcctctaggggaccttggggatgtccactgactctgtgcccatggtgaccccatgctggtgcagaccggaagggacaagtgaccctggtcaggcagggtttcctgcttccctaatgctgtctcagatcccgtgcaattggtttggaacagaagttgtgttccactcactggtggtcataatatcgcatggagagtcctctaagggtgtttggggtgtccacagactctgtgcccaaggtgacctggtgctggcgcggccactttactctcttaatacacagagaggaaaacagaaaaaaaaaaaaacaaatcaactaatacaatgtcatatatctacacctacagtcacaatcttctcacaccc

SEQ ID NO: 1263 - DNA, 1000 bp, mus musculus
taaagcagaattgatccatcacacttaaaaatcaaattgccagttcttttaggcttagttgagatgttccttcctgagaatcttcaccacttatatatccagtactaactccagtacttaggcgttatactgaccactctactcaagctgttcttagcttttcttctccaggactcactaatgcgtgttttttttgctctgttgttgattcttcttggctcttcatcctgggttttcacagtatgcacaatttacacttataattctattctcagatattattgtttcctctgtagataaccatgagtaaaggtgggtaccattaaccattactaacattcttttctagagctctatttgtgacgctgtgaaagctaagtagactttgaatgctttgggcaatcttcacttttgggaaatgtgcttcttatttggggagatagcctgcttttcctggatgttaactgtaatagatatttatctttttagagtatgcagtgggtatttctagtatttcattgaaattaaaccttggccagaatataaaatacactcagtgaatctgataatatgccaaaatatgtaattaacaggcttattaataactcagcaagctttgtttctgtcccaggtcctaggaaaattcctcagtgtttcagtcagcagatgggaagacctgttcacttgaaagatgtctttgttagggttgtgttgctgtaaagtgcaactaggatcatggccagtcttagaaagtaaattctttaattggatctggcttacactttcagaggtttagtttttttatcatcatgaagggaatcatgtcagcactcagggagacatagtgctggagaaggaagaagttaggtgttctatatcttgacctacaggcatcaaaggtaactgtgaatcaaactgggcatggtttgagcataggagatacctaagcccacctccacagcgacacactatgtgcaacaaggccatgcctatttcaata

SEQ ID NO: 1264 - DNA, 1200 bp, mus musculus
caacatttgatgattgcttcctcagttttgtgtcagagctgtgagtttcccctcagtggatagaaagaatataaattttacatcaagtaaaaatgattaacttttacaccttttgtaaatatgtgcttttaacaattagtttctaaagatttattttcagatcctactaaactcatagttttgattcctcattaaaaggactcataataatcagtaagtagctataatgaggttagtttgttattttatgaaatcacttgtatgtattcctcacagattccaacaggtcaatggtaatcctcatccaatgttgaggttcatggagaatgaaggaacagcagtcctcctcacagaggtgctctccaatctccacttcccttctcctctgagagggtgcctccccatattaccccaccctggtgcatcaagtctctcagcataggtgcatcctttgtcactgaggtcagacaaggcagccttgttggtgaaccgataccagagtcaggctacagcattagtgagagcccctgcttcaggtgttgaggggctcacatggaaactcagcttcatgtctcctttatatgtgcccggggtctctttcaagcccgtgtgtgttctttgttctgtgtagctcagattctaagagctcccagaggtccaggttagttgactctgttggtctttctgtggaattaccatccatttcagggtcttcaatgcttcccccaactctaccttaaaaacccctggcatccatccgatgtttggctgtagttatctgtgtctgtttcagtaagctgccgagtagagcttttcagaggatagttttgctaggctcctgtctgcaagcataacagagtatcattaataatgtcagtgattggtttcaagttgaactgtttattgattggtcatttcttcagtctctactccatctttgtttctgcatttcttttagacagcacaaaaattgctttgaatattttgtgggtgggttggagtccttatctctccattgggttcttgagtggctacaggaaatggctcttcagttttcatgttaccaatgcttggcatcttggctaagcacaaaacaaacaaacaacaaccagatacactaaatcgcatagaagagaaagtaagatatagccttaaattcattgattcaagatagtattccctataattgttgacatggaa

SEQ ID NO: 1265 - DNA, 1200 bp, mus musculus
ctgatttgaatataaatcataggacctggtaggaggaagtacttcctcaaaggtctacctttgaaagggttatcatgttactgaatatgtctggtaactttttgcttctaattatcatgaagtgagaagattttatattccacactctttgattgtgactcctatcttaagcaattacattgcagtggaacactgtgaaaaaataaaaaaaaaattaaaaaaaaaaagaaattcattagagaactctgttccactttatacttttttaaaaatttttattagatattttcttcatttacatttcaaatgctattccaaaagtcccctataccctccccctgccctgctccctaaccactcactcccacttctttgccctggcattcccctgtactggggtatataaagtttgcaagaccaaggggcctctcttcccaatgatggccaactaggccattcttctgctacatatgcagctagagacaagagctctggggatactggttagttcatattgttgttccacctatagggttgcagaccccttcacctccttgggtactttctctagctcctccattgggggccctgtgttccatactatagaattctgtgagcatccacttctgtatttgccaggaactggcatagattaacaagagacagctatatcagggtcctttcagcaaaatcttgctggcatatgcaatggtgtctgcatttggtggctgattatgggatggacccccaggtgggaccgtctctggatggtccatctttcgtcttagctccaagctttgtctctgtaactccttcaatgggtattttgttccctattctagggaggaatgaagtatccacgcattgatcttccttcttcatgattttcttgtgttttgcaaatggcatcttggatgttctagatactttgttttatattgttgagattctctaattttttctttatgtttatgtatttagtgacttcttattaaacagtatattattacattttacacttaacttgaaattctgtatattttctatgagtaattattgtagtattaaaccaacattacagtaatgcatttaatcttaacttattccacttatatgctagaagtttccatttagtaatgtatataattgtggttctattattattttagaataatgcacatcagtgaagaattaatccat

SEQ ID NO: 1266 - DNA, 1000 bp, mus musculus
ccaaggagctaaagggatctgcaaccctataggtggaacaacattatgaactaaccagtaccccggagctcttgactctagctgcataggtatcaaaagatggcctaatcggccatcactggaaagagaggcccattggacacgcaaactttgtatgccccagtacaggggaacgccagggccaaaaagggggagtgggtgggtaggggagtgggagtggttggctatgggggacttttggtatagcattggaaacgcaaatgagctaaatacctaataaaaaatggaaaaaaaaagacatacattactttaaatttaatatgcttttagctcaatgcctgggctcttcttagccttcctcagctagcttgcccttcatttcattcctagctcaacacctctaaatctgccctcaactttagttgcctggttaccttctcctgctcagcaagctaaatctgccctaagtatagttgtgtttctaatcctctgcctgctatcccaggtccaggtggggaagtagctaatgaccactccactctagaactcacatggctaatgggccccctctccatccaaagcatggcaaatcttctttgctcctcctatgccttctagcctttctaagggaacatggaagttccacctcttctgcccagtcagtggctgcaaacttctttattaatagatcaagaaccaactggtgaacatgaccttaagcatttacatgcttattcccaatcagaacatcagaaccacaccctaaaaatttcctatccccttaagtgctgcaatccttcctatacttccataagagtctccaagctccattcagtgtttgactgtttacattagtctgagtcagcttctggatagagcctctcaaaagaaagccatgctagatgcctgtctacaagcatgaaagagaatgtcattaatagtgccagggatttgtccttgtatcctatatcttatgctaataatgagttataagtgagta

SEQ ID NO: 1267 - DNA, 1000 bp, mus musculus
ataaagttctagaatgcatatcaaaacaggatatgaactgggcggtggtggcacacgcctttaatcccagcaattgggaggcaaaggcaggcagatttctgagttcaagaacagcctggtctacagagtgagtttcaggatagccagggctacacaaagaaaccctgtctcaaaaagcaaaaacaaaaaacaacaaaaacaaaaaacaaaaacaaaaaaacaaaacaaaacaaaaacaagcaaaaccagatatgaactcttctactgtgtccaaaaaaatatacctttaaaatcaagaataattcttgctcttcctgtaagcggccagagttactagttgctgtgttcacaggtcacctgccaagatggttcgctactctcttgacccagaaaaccccacaaaatcatgcaaatcaagagggtcaaaccttcgtgttcactttaagaacaccagggaaactgaccaggccatcaagggtatgcatccacaaagctaccaagtatctgaaggatgtcactttaaagaagcaatgtgtgccattctggcggtataatggtggagttggtaggtgcgcccaggccaaacagtggggctggacacagggtcagtggccaaaaaagagtgctgaatttttgctgcacatgcttaaaaatgcaaagagtaacgctgaacttaagggtttagacgtaaattctctagccattgaacacatccacattgaacaaggcacctaagatgcgctgatgaacctacagagctcatggccggattaacccatacatgagctgaataaaagatagaaaaacattccaaccaagttgacatgagaagcaagctgctatagccattttaatatctgacaagataaacttcaaatcaaaactagtcagaagatatagggaaggacactacatactcatcaaagaaaaaatatctatcaagaggacagtgcaattcttaacatatatacaccaaaacaagggtacccaaattcatact

SEQ ID NO: 1268 - DNA, 1400 bp, mus musculus
aatcaaatgacaggcatctttttttgaggacacttggctatttgtagattttagtagagaatactgtggctcttgcatttcctgcctccttctcagacaatcttattccttatgtttttattccaggatacacacacacacaccttttattcttttggttcataaaatctcatcaattttaaaatagtctattgtgactgaattttttgtctattatctaatgaaaagttgttcacatgcgtttttttaatgcttaatctttttttttttttttacaatctagtctttactctttatccccctcccagtcttctctctgcctgttcctcatcctatacctgttcccctcaaaccagtctccaagaaaaatgactcaattttctttagggttagttgcatcttctctctctgagtccagaccaggctgtcctttgtgtatatgtgctggagacctcatatcacttggtgtatgctgcctggttggtggttcagtgtttaagaggtctccgggcccaggataattgagactgctggtcttcctatggggtcttcctcctcattagctgccaccaactttcccctaattcaatcacaggggcccccagcttctgtccattggttgggtataaatatctgcctctgactctttcagctgcttgttaagcctctcagagggcagtcatgctatgctcctgtttgtaagctcattacagcatcaataatagtgccaggcctttggggtctcctcttgagctggatctcaatttggacatgtcactggactcctttccctcagactttttttttttccatttttgtccctgcagttctttgagacagagacaattatgggtcagagtttctttactgtgggatggcaatcccattcttccacttgatgtcctgtttttctactggaggtagactctacaagttccctctccccactgtagagcatttcatctgaggtgccttcctttgagacttgaattcttgaatttggtttagaaagcttgccttgctgaaatactgaattgctgaattgtttactgtttcatacccattgaatgttgatgaatggccatgtttcttacaacattcttttatcaataacaaaattgccctattaataatttgttaaatactatctttacaagtactttaacacttttaacactatatttaattcaaatatagctctcagttcatcaagttaaacaatattagtgtccataaatactttcaatttcaaagaatctatttagtttcttaaatgtggaccatattgtagagatcgaaaaatagaagacttgagctgaatgagttaaacttagaattgcagaatcatgtcacaatttgacattgaagactccaagataggcagtggctggatgtttgaa

SEQ ID NO: 1269 - DNA, 1000 bp, mus musculus
attggtgagaagtgatttagaggaagggatttacttcagcttacaatttcagggaactgtctgtcaggacagggaagacatgtcagggttcaacaccacagaagggtgtgggtaggagtcctgtatcagagtaccaagaaaagacaaggaggaattatgatgcttaaatggatttttcctttctccattcatatattcaggtttactaggcatggactgctgccacccacattctgggcaggtcatttcacctcagctaaccatctccagcaaaccagagatagacagacacctagaggtgcacctcatcagtgactgaaggcatccctcgattccatcaagcagcagattggccattattggaaagagaggcctcttggtcttgcaaactttatatgccccaacacaggggaatgccagggccatgaactgggagtgggtgggcaggggagcagggtggaggtgggggggttaaaggggacttttaggatagcatttgaaatttaaatgaagaaaatatctgataaaaattgaaaaaaaataaatgtactgagcaataagaaaatactattatcagaaactaaaaccaaatttgtcttacttcaaaggacacatttatcacactatatgtgtgcagtaaacagtaattaagaaactgagaaatacagtatttatgttgcagcttgatgattaaatcaaatgcctttgattatgatggacattacaccagttttatccatgaacaagataaataaattgaaaaagtacagaaaaaatttcacatgaaacattaatatactgtaagatatcaaattttatagaaagaactaataatttagtgtaaaaaatacagtagtgctgatttttcaaagtctgtttggtttcacaccaaacattgttcacacatatcattttttattttagatttaatctctggattacagctattcacacacataaatgacaaaaatgtagctcagactatgaactcaagagacaa

SEQ ID NO: 1270 - DNA, 1000 bp, mus musculus
gataccaactttctatccaggttgtaattctgaaattgatgcaataacttcaccaagaaacagattcaagtgttaagcatgatgaagctctttatggctttgatgtatctagaagtttctgttcccgttgtaggacttattagagaggcacaataatctcagtcaagaatgagagaccaagtgactatgacatggaaagcttgcagactttaaggtttgtttctcgttccctaacatcccaggggcccaaagagatgtgactcctttttcttactctttgaacactatctttattatttactgtggtaaatctcattatactgctcagtggacatgctaccaatacacattctcctatggtttgtgttctatgatttctctggaaaatagtctaagcacttctttgatcaacatgtgttctctgtgtctaaagcatcacaaactttttcacagtttcaactgctagacatttatcttatagacattgagatacatttttatgtctatgaacataaagaaaaagcttcatcattaactacagattatctacatgtctgtgataatttgaataggtttgagtctaaaagaatcatgtgtttgatgtttggccccttggaagaggcactacaaggagatattgtcttactggagaaggtgtggctttggttgaggaagtgtgtcactgtgaaggctaggctttgtggtcttaaatgctcaagctatacccagtgtgaaaacaaacaaacaaaaaacaaacaacaacaacaacaaaaacaaaaccagtctcctcttggctgtgcgtgattcaagatgtagaactctaggctcctccagcaccatgtcttcctataaattgctgtgcttctcatgatgataaggggctaaacctctgaaactttaatccagctctaattaaatgttagcatggatagagttggcttgttcagtgtctcttcacagccatggcaatactaactaagccaatgtctttcttgtaatg

SEQ ID NO: 1271 - DNA, 1400 bp, mus musculus
aatttatgtggaacctaaattgtttctgagatatgccgttttatatgtattattatttcatttgtgatacattaaatggtccaccacgggtattttcgataagagcacgtgacctggtcttcctacgaaatgctctctgtatataattatttggtttaattactgcttgttgttttacaagtcctccatatttaaatttatatcctggcaattgatgttctgtacaaaattaagagatacatctttccttattttttttttcatgtcttagtgttccaatgattttttttcttttttttttttttttggtgtttattttatttatttacatttcaaatgtgattcccctttccagtttccccttcacaacctccctatcccccttttcctcccctgcctctatgagggtgctccctcacccgcccacccattcctgcctcagcgccctagtgttcccctatcctgggtcatcaagcctccacaggaccaaggggctttcctcccagtgatgccagataaggaaatcctatgctacatatacagctggagccatggtccacctttaccccctatgtactctttggttggtggtttagtccctggagctttgaagggtcaggttggttgatattattgttcttcctatggggttgcaagccccttctgctcctacagtccttaccctaacttctccactggggaccccatgatcagttcaatggttggctatgagcacctccctctgtatatgtctggctctggcagagcctctcaggggacagctataccaggctcctgtcagcaatcattcttggcatcagcaatagtgtctgggtttggtgtttgcagatgagatggatccctaggtgggacagtgtctggatgacctttccttcagtttcttttccccaatttgtccctgcatttccatttgacaggaagaattctgaatacaaaaaccacccatggtgatttaaaattttttaaaagtactctatattatctcttttgctctctctcttcttcacttttctctctgtgtgtttgtatgtttttaataaacttgcttagccataacatcttgccttcacaggtccccaggtcacttcagttcagctgatagctcgtcacatgtttcattcatcaactccatgattgtttttaaagagcacctgattattcatgattttctttactgtttgactatcttaactttaataaggcttttgtcatacaagagtttaatttacttaaaatatattttgcctctggtttgggggttttatatatttctatagaaacataacttctgcatatgtttaccatatctaaggccctttgataaaatatagattacacttgtttttaatcataattcatgaatctatggttccactatg

SEQ ID NO: 1272 - DNA, 1000 bp, mus musculus
tgttggtaagattcttacatttgccttttgccatctggtaatctctggtgttagttgttatagttgtttctggctggagccagtttctcctgtgatcctgtcagctgtcctgggaatccagttctcttttgagtctcagtggtcagagctctctcttctggcaagctctcctcttgcagggaaggtatacagaggtctggagttcagacctgcctcctggctgcagatgaaggcccgaaacagggcttgtcccagaagatatgtggcctctgcagtctttgcactcacctgcatagactggtctcctaggggaccaagacacaagatggctccctcacctgctcagaaggtcagagccctcccatgtggtcacctttcctttggaggggatggtgcccggatgtctggagcctgaatcgaagtctgtcccagatgctgtgtggcttctgcctatcccagaaactgtgtagtttctgcagtctgcttgctcaccctcagcagtctgcaagctgacctgtgcagactggtctcagtgggacctcagagacaagattgctccctcacttgttctgggggtcagagccctcccaggtgactacctctcctctgttggggaaggtgcccagatgtctggggactgaaatgggggtctgtcccagaagttgtgttgcttctgcagtctgcttactcaccctctgtagtccacaagctgatctgcacagactggtctcagaggaacccaggagacaagatgactccctcacctgctctgggggtcagagccctcctgggcggccacctctcttctggtggggaaggtgcctggatgtctggagcccaaaagaggacctgtcccagaagctgtgttgcttctgcagtccactcactcaccctcagcaggctgtgagctgacctgctcagactagtcccagctcttgtgctttttctttggctcttcttgattgatcattttggtatgatatagattgtttttaatttg

SEQ ID NO: 1273 - DNA, 1400 bp, mus musculus
tatctcttcaatatagtatttgaagttatagctagagcaccaagataactaaaggatatcaaggatataaaattggaagggaaaaagtctaagtgtggatagtcacatatgatatgatagtatacataagtgaccccaaacactctaccaaagaactcctacatctgataaacaccttcagcaaaatagctggacacaaaattaacttaaaatttcagtagtctgaccttatacagaaaacaaacagggtgaaaaagaaatcaattaaacaatacatttcacaatagccacaaatgacataaattatcatggtttaaactctaaccaatcaaatgaatgaactgtataccaaatgtttcaagactttgaaaaaggaaattgaagaagatatcagaaaatggaaaggtctccaatgctcatgaattaatagaattagcatagtaaaaatggccttcttaccagccatctatagatttaatgcaatccccattaacatttaaacccaattctttgcagaatgtgaaataaccagtggactgggcataaagtcccccatggaggagttagaaaaaggactgaagaagccaaaggggtttgcaaccccataggaagaacaacaatatcaaccaaccagatccttcagagctcccaggaacgaaaccaccaaccaaagaatacacatggagcaaccatggctccaaccgcatatgtatcagaagatggccttgttgggcatcaatgggagaagaggcccttggtcctgtgaaggctcgatgcctcagtgtaagggaatgccaggacatgaaggtgtgagtgggtggatgggtgagaggaggtgggaaggggtttccagaggggaaaccgggaacgcagataacatttgaaacttaaataaatacaatatgcaatttaaaaatactcaccttcatatgaaaaaaatgaaaaaacccaggatagctaaaacaaacctgtccaatattagaacttctagaagtataaccatacctatttccaactgtactacagatctgtagtaataaaaagtgcatagttttagcataaaaatagacaagattattaattgaataaatccaaaaccctatatgcaactccacaaatccttgagcaccttattttttataaagaagctagaaattacaatgggaaaataaaagcaggttcaacaaactttcctgatttacctgaatgtctacatgtagaagaatggaaataaatcgatttttttacaccctgcaactcaagtctaagtgagttaaaaatctcaatataaaacaaaatatactgaaactgataaaagagaaagtgtggaacaatcgtgaatgcattgacacaggagacaacttcatgaacagaacaacaatagtacaggttctaagatc

SEQ ID NO: 1274 - DNA, 1400 bp, mus musculus
aggcagaaagaatttcaaagtcagctgataaggaggaattctgtaaaattccaggatttgatatggctgctgcactcttgatctcacaactgctagggatactggcattagatatgtgcaagattaatccagacaaaattctggctcacatgtgggaggggctcttttagaaatgcatgatcatggatagtttgcctaggtcccagtggttgatcctaggtctgaattatatgattgccaatccttagattcaatgggtcattaaaaatcaaaataatacccctgaaaaaaatgaatttatcataaagttgggtggggaccttggaaaatgtatttgtagactgaagtggaaatttaatggttctttggaaagttggttggatggtgtttcattggggcaaacacatgaagaaacgtttttgttaaagtggacagaggtgtgaatgtctaaggcacaggagagacgatgttctgctaaaaacaagcacatgaaaggacatgtgataaaggattctctgctaatgacatgcatgtattggtctgatttacactgcatagtcgagttgcatttgtaggcatgccacacagagaaaagcaccaaagtggtacactgcagtttgttgctgcttccaaggactcaggctaattgggtgcatgtgttgaggcaagagccgtgctgaggcaatgcacagggaggacaagtgatgtgtggaggtataaataggactccacagagtgacagagacagagcttgacttgctgatgcagctagctctgcaatgtgtgtgggtcttgcattcactgacgtcgcctgctaatttgtgaactgaactgctgattttcagacaacacatagggagttgctctaaagaacctttctaaacaggtccatttctccccacccccaggtcctttcttttccactacctcctgtgggtggtaggttacatggaagattaaactgtttaagaattatcattaaaaataggatttaaaaaattaaattataagagacttataggagggtagtagaaagtgaatatgatcatattttattggatatatgtattaaactgtgaagcctgaagaaaaattaatattaatatgacaaaaagttgatacatttaataaccgatattcagatcgtgcatttaattggtatgttatcataatttcatctatgtagctattgttaggttttaacattcttatttgtgatatatatatgcttataatttagttatatgtacatttggtaatctatattaatatatgttgcaagttcttcttgatatacagagtaaatctaacaaatttgtctcttaaatttaaagataacaatgcacaagtcttactgaagaatattttgtatttttaaaaatgagtcagttttatttcaa

SEQ ID NO: 1275 - DNA, 1000 bp, mus musculus
aaaagaaacgtccttgtcgtttacagtcagttgcagcatggatcatggacttccccatggtttctggttatagcacagaccacagaaatttgtatggcacacaaaagcaacacaggctatggatgccaacatgtcccctagcaacagcatcatggccttaggcagcagcaaagatcaaggacatccacatggccttgggtagtacagagactgtggacataagcatggcttcgagtagcagcacagaccactgacatccacaaagccttaggtggtagcatggccgccaaaattggcatggtcttcagctacaacacagactgcagacaaccacaagaactcaggtatcaatacagcctagggcagcagttgtaaccacaaacatttgtccctgggtggtagcatggaccatggataccaataatgtctccaggggcagcacagactcctgggggagatttcaaggaagcccaatccagaagatgagccttttgccagggacatgtttgctttcagaggtagaagttgcaggaaccccaggctgctgcatatcaccctctacaacaggttaccccctacctcacctgcagccttctcccacacttataaccacagttgctgttctgcctctctcccctgcccacatgcagctagttcttcccttttcccacctctccaccatatatttgttcatccaaatgacactgaaaattgtagtgcatcacacagtacacacacacacacacacacacacacacacacacacatatacacactaccatcactgagacttccttcggatatcctgctgttgctcagaatcagagtgatcttgtaggtaggcagggcaagatccctgttacatagccccagtctgctgtgcacctctgtgctcattcagcatgattgtgcttgcagtctgctggctgtgttgctgcctaagctctgttcttctcagcagggctagtaggtttcttgcagtggctgcctactcagggct

SEQ ID NO: 1276 - DNA, 1000 bp, mus musculus
aaccactgaagaacagaaggggtgagagatctgattccgcagcctgctgccttccccactctctcccaaggaccctcttaccagtcataggctccacataggctgggcagggcttatccggccggggcaacagtgaggccagctcttggaggcggttatagaaggagtaggcaggacggactggagctggagggaaaacctgtggaagacaggacagtgactttgagagggagggacagcccagagatgggaggatggggcaggtgtgagtgggggcactaaccataaaggactccctgcccccctgcaccttacctctgtgtagcgcagcactgggtgagccccctgaacggcagacacagtaagtgggagaccctccagcccccagagcaggcggctgaggtcatcatagcaacgcacagccaacgccaaggcctcctcacccgtgctggagatctgatgaagagaagacactcaggaggaagtctgggtcttaagaaaccccagcaccaccttggatgctgccatgattcaggctatggcaggaccggggcgccccctgctggacactaggagatgcaacctggctagggtagaaagggttctccatccagtcttgccatagcactaactaccccgcaatcactggcttagaccccaggctcttacctctttggggttttggatcaatgcatcaaggaagccacccacatactggatacaggtgtctgggatgtcagcatggctgaagaacacagatacaatgagggtgtcaggggctatgcctaccgaaaatggctgccctgaccacagcagcctcctggtgtgaagacgctgatactcacagtgctaagaggtgggtgaccacctgatgaggaataagacgcttctcaaacaaagattctgcctcccagaccacagcttcccggatggctccgtcctggaaacgcctgagctctgagcgggtcccccagaactgacggaaatcagcagcctggag

SEQ ID NO: 1277 - DNA, 1000 bp, mus musculus
tgcctctgacccttgttggatacacagggcagttggcccaccccaaagcctcttctggaaccaacccagcccctgagctcacattcctgctccagaccttcgggcgatctcattcctgccaaaccgggagcctgtgctgccctggaaggcacatcaggctgaagtaggtgtggccagggctggaaaggaatgtgtaaacatgcctttcttggacacaggagcaacagttgactactgctatagcttggatctgaaaggttcccccaaaggcctgtgggtaaaaggcttgtccccagcaaggggcatattaaaaggtaatgaacgctttacaaagtggggtccaatgggaagctttggcagtgcagaatctgggagtgagggccttgcacttgtgagagtctccctcggagtagctttgttccattgggtcctggtgcttaaggacgtagtgggaccccacccacacccctcttttgcttcttggctatcacagaggatgaatgagcttgtatgagcacccctcccagccagtctgtgcagccatgtcacagacagggaccaaagcaagaagtcacattaacatgaaatccctgacgatcactgcacacgaactttccctcttttgccttattttgtattttatattctgtctgcatggatgcctgtgtagcacttatgtgcctgatccctgaggaagtcagaagaggaaactggagtagagacagttgtgaggtgtcatgtgggtgtctgaaattgacctcaagtcctctgcaaaagcagtccagtaagtgcccttacctgctgagctggcactctggtctcacctttcctcctcttaagttaattgtatcaggtgtattgttacagtaacagaaatctcagtgacagaaatgccattctgtacagggtctcgtctcaaaaaaagtccttcaaatgatttttacttttttatgtcctcgtagcctgtgatgggttgggtctgaccaattcttgagatgta

SEQ ID NO: 1278 - DNA, 1200 bp, mus musculus
tttttaatgttttggacaagaagaatctgcctataaaaataattagtattattaaaacagaaataagttactttggtacaacaagaaaaatgttttatgtacatctcaagaattggtcagacccaacccatcacaggctacgaggacataaaaaagtaaaaatcatttgaaggactttttttgagacgagaccctgtacagaatggcatttctgtcactgagatttctgttactgtaacaatacacctgatacaattaacttaagaggaggaaaggtgagaccagagtgccagctcagcaggtaagggcacttactggactgcttttgcagaggacttgaggtcaatttcagacacccacatgacacctcacaactgtctctactccagtttcctcttctgacttcctcagggatcaggcacataagtgctacacaggcatccatgcagacagaatataaaatacaaaataaggcaaaagagggaaagttcgtgtgcagtgatcgtcagggatttcatgttaatgtgacttcttgctttggtccctgtctgtgacatggctgcacagactggctgggaggggtgctcatacaagctcattcatcctctgtgatagccaagaagcaaaagaggggtgtgggtggggtcccactacgtccttaagcaccaggacccaatggaacaaagctactccgagggagactctcacaagtgcaaggccctcactcccagattctgcactgccaaagcttcccattggaccccactttgtaaagcgttcattaccttttaatatgccccttgctggggacaagccttttacccacaggcctttgggggaacctttcagatccaagctatagcagtagtcaactgttgctcctgtgtccaagaaaggcatgtttacacattcctttccagccctggccacacctacttcagcctgatgtgccttccagggcagcacaggctcccggtttggcaggaatgagatcgcccgaaggtctggagcaggaatgtgagctcaggggctgggttggttccagaagaggctttggggtgggccaactgccctgtgtatccaacaagggtcagaggcagtttgatcctcttacattctcaacagattgttgagccttccaaaaacagaatgtccccaggacggtgcagctgctcccaaagtagaagtctatgttccctt

SEQ ID NO: 1279 - DNA, 2000 bp, mus musculus
ccccgagaggaggtaagtgctgctcttccgactccattctttagtgtaggccatgggattactcttctcatctgggagaaaaatcagcagagggagccaagacagatgctgctggaagcgggcatctctgtgtgaggacggcctggggctgagcatggctactggaacagcatggagtcagaaactaatgacttccagcacagcgagccaggaaggcagggaccctgcctctggctatcacttccttctccaaggccacttaggtccatttctctgccagtggagtagaggtgcaatagtgaaatagtagaggtgaaaatagactataaactggttattggatgctgctgcaggtattatcagtttttatgttgttgatactgtggttggataagaagatattcttacttgttggatgtgtacacagaaagaagtgtttcagaatagaagaattatgataccttctggcagctaagcaagtatgtaaatgtacttaatctgtgtattgtctatatacacagagaaagccactgaccaaatattagcagttgttggccctaggaggatatgtggtattctgatgtctctatgtttgatttaaacaaaaaagtgaaagggctgagccttgtggcatagcataggcctggatctcacctacttgggaggctgaggtaggaccacaagttcaaggtcagcccgtgtaacttaatgaagatcctaccacaaaaataaaaagtaaaaagaagcattggtagaatgctttcccagtataaatgaagacctaggttcaatccctgacatctcccaaaaatagaaacaaaatgaaaggaaagggagactgatgcagcaggcggaggccctgtctgttggagatggctttagtgtcccctccccagggggattgaggtgacctggctggctcacctgtctatggcccttggtgtatggaggagcaggcacgggaactgtgagggcagcagggcagtgccattagtgctctgttggtttttaaggtgccgttcaatggacgtggatctcaaccaggcacacatggaggataccccgaaaaagaaaggaaccaatgtgtttgggagccttgagagaggactggataaggttctcactgcgctcacaaggaacaagaagaagggctctgccagagatggaccaagaaagcgaaaggtaggtgggccagagtctgttacagatttcagaagctgactcttaataagtgtatctagcaccgcccttctctgtttggttggctaacccaggcagtcttcttccctcagcctgccaaatgctggggtcacaggcatgtgctgccatgtgtcgtgcttgtctgtctggggtgtttccatcccacctcccatgttcctgtgtgtgcacacatgcatgtgtgtacatgtgtgtacatgttactgttgatccaggggctaacacagggtgtcaggtttgcggatctgaggccctcagccccttgagatcgtccttggtgggggtaagaaggtgcagagtcaatgacagactccagaagtcaggtcagaggcaggagcagactcgtttattgcaggatggagagtgcctttatacctttcacctgtgtcctattggtccatgacatctcgttccctgtagctggcaccatctgattagttgttccagtcatgggctctgtttccaggagtcaggcagatttcacggttgccagatgtagaggtagctgttgtgcgtgcgtgggccactatgggccactatgggccactatgggataggctgactggttcctcctacacatgtcaaatgctttgacctacttagctgtcttgccagtagatgtttttgctttttaaaaacaactatatcaagtaacgttactgttctttttttttttttttttatctttttttttttccattttttattaggtatttaactcatttacatttccaatgctataccaaaagtcccccatatccacccacccccactcccctgcc

SEQ ID NO: 1280 - DNA, 1200 bp, mus musculus
tttgcctgtatgtatgcctgtatgtgaggatgtcagatcttggagttacagatagttttgagccaccatgtgagtgctgggaattgaaccctgggtcctctggaagagtaatcagtgctcttaaccacggagccatctttccagcccccaatatattttaactttagttctaaggttggtgcattttatttatttactttaaactttttattgattcttcgcaagtacatgaactccagtcccgctcatctccctcttcccacatatctgcccttcactcttgcagttaaccaccccacataaaacacacacacacacacacacacacacatacacactcactcaccaccaccatcatcaacaataccaaaaaacaaggcatagaaaacatctcactgtggaactgtagtatgtcacagtgtgtcctacagtatagtcctctgtccacacatctccacttgcaaatgtccattgttatgagtcattggtctggtttggtagtttctgtaataccatcaatattggatcctcattgggactcctcctggttatcttattgttctgtgtcatggagatcctgcagctttggatcaataggactggccctttcacttatcccaaccatgtgcagatgataaaaattttagggtggcccatttcagagccctgatctgggcctgggcaatagctaagaaggttggcccaatgactttcctttatcactctaccagggcaagttctccagcactgctccaggtaggccacccaatgctgccatcagcaagaagcagggtcagttctcttgctctcatgtccttggggccaactcactcccactcaagcttccagagccagctccactgtgctacccagtcaagctgtggggcccattctcccaagggctacagcctgtgaaccggactctcaccctctgggacaactcacctgtgccctctccaccagggccagctctactgtgatgcccaggcaaggtacagggcccactctcctaagtgttgtggtactcccagaacctttgtgaatttgggttgtaagtaaagctatatttcctgtagatacctctttgcttccacagtaaagttctttagccagcttggttcagatgttactaaaagattccacaaatggcaagataataaggcttgtgaatacccattgcttttgtgcctccagtttaga

SEQ ID NO: 1281 - DNA, 1600 bp, mus musculus
aagaaagacaaacccttacccaattgatctgaaaggtggcgagagaatatcctaattagcaaaatcagaaatgagaagggcaatatcaccacagacacagaggaaatccagagagtcataagacatactttataaaaacagtactccaccaaattggaaattctaaaagaaatggataattttctcaatcagtgccacttttagaagttaaattcagaccagacaaacaatttaaatagacctataatgcctagtgaaatagaactaatcattaaaagtctcccaatcaaaaaaatccagggccagatggtttaagtgcggaattctactagactttcaaagaagagctaataccaaaactcatcaaattattccacaaaataaaaacatttaattttatgaggtaatagttagcctgatactcaaatcacataaagacccaaccaaaaaaaaaaaaaaaaaaagagagagagagagagaattgcatacatactcaataaaatacttgcaaactgaatctaagaacacatcaaaaagatcactcaccataatcaaatagacttcatcctagaagataaactgtgggaaaccagaccttcaatggctccctcccggaaaaccaaacggtcctttgttgagagtcagagccaccccctccatgcaaggctgaccctgagagctggccaacacttatcttgaatgagtacctggggctgttagccaacattcagaaacagatctacaggatgaccttcgccctgcatcttcccgtacaggatgccacaaagcctgctatcagcatactccccaagatgtccttcttctatccgcctcagatgtccttcgctctgaagtccttgttctcccttctcagcccctccttattccttttctttactgtgtgtatataactaggctttcagcctcattaaaatcagaccttgacaactctttgcttggtcttgcttccctttctcctcccatttctctttcaggcctcggtcctcctcaacccacggaataactaagtcctgttggacgggacagtttaagtgcagaattctactagactttcaaagaagagctaataccaaaactcatcaaattattccacaaaataaaaacatttaattttatgaggccatagttagcctgatactcaaatcacataaagacccaacccaaaaaaaaaaaaaaaaaagagagagagagagagaattgcatacatactcaataaaatacttgcaaactgaatctaagaacacatcaaaaagatcacttatcataatcaaatagacttcatcttagaagataaagagatggttcaacataagaaaatcaataaatgtgatctaccatataaatcaactgaaaccatacacacacacacacacacacacacacacacacacacacagataatcttgctagatagtgaaaaggcctttgacaaatccaacaccccttcatgttaaaagtcctggagaaattagtggagagggacatacctaaacataatttaggaaaattacagcaagcttaaagtcaatatcaactaaagtggagagaactcaaagcaattccacaaaaatcaggaaca

SEQ ID NO: 1282 - DNA, 1400 bp, mus musculus
gagtaattctaaccaaacaagtgtaagacctgtctgaaaataacttcaagactctcaagaaagaaagtgaagatctcagaaaatgtaaagatctcccatgctcatggattggcagaattaatatagtaaaaatggccatcctaccaaaggcaatctacagattcactgcaatccccatcaaaactccaacacaattcttcaaagacaaggaaagagccattctcaaattcatctggcaagacaaaaaacccagagtagttaaaacaattcttaacagtaaaagaacagctgggggaatcaccatccctgacctcaagctttacaatagagcatttaaagaaaaaatacagaatacccaagggccagcagaaaggatggaaacaggcaatctcaggaggtaggacgttgggggggcggggaccctccagaatgcaccagagacctggtagtaagagtctctcaggaatcaaagggagggactttagatgaagtgaccgatagtaggaagaggcaacttatagaacccacctccagctgggcagtggtggcacacacctttaatcccagcacttgggaggcagaggcaggtggatttctgaggccagcctggtctacagagtgatttccagaattgccagggctatactgtttgggggggggggggggagacgaccgacccaacccccagcaggaagactggacatcaagtgagggttgaggttgccatcccacagtcacaactctgacccataattaattctgtctgaaagaattacagggataaaaatggagatgagcctgaggaaaagaaggtccagtagcaggcccaaagagggatccagctcaagaggaggctgtggagcactcacaaaaagggacctagtgtgactgccctctgaaagactcaacaagcagctgaaagagtcagaggcagatagttgtagctgacctctgtggttgaattagggaaaggctggaagaagctgagtaggaaggtgaccctgtaggaggaccagcagtctcaattaatctagacaccccgagatatctcaaacactggatcaccaaacaggcagcatacaccagctgatatgagggccccccaacatacatacagcagaggacttccaggtctatgttcattgagagatgatgcacttaaccctcaagagcctggaggcaccaagtttagaggtcaggtggtatggggacatccaacatggaactggggttggggggggtatgggatgtggagcagtaggaaggtggacggggtggggggtggacgggttaaatatggagtgtaaaaattaattaattaattaaaaaaaagagagagaaagaaatgttcaccatccttagtcatcagggaaatgcaaatcaaaacgaccctgagattc

SEQ ID NO: 1283 - DNA, 1000 bp, mus musculus
gctgtgctatgcactcaagaatacaatgacacagtatacagggcattggtcttgaaggaggtagcagtttatctggaagaacaggcagtatgctgacaaccataaattgatagttaaaaacaatgtagattactgtgacacatatttatatatgggaaatacatgttcgcttggatttacatttattgaatacaaaaagggaaataatttgattataattcagttttttgttttaggatttctgaggtatcattgtatggaatattttgatctttacaaaggtgatacatttgatgttttggaatataaacaaatagtccgaaacgattaaggggggaaatatatttgggacagaagagtttctggcccattcctacaacagatatagcttagggaaattagtcttaacttttttatctctttatctttaaaataatgaaaacaacactatatgcctgtgttagattgatttctttcagatcatagttaatgttattttcattatcagcatctttcaccttgtactaaaactccagtgctggccaaggaagaaatgatagcatatctgagggaatctgggacttgaaaagtgcctgctgcttcctcaactcttctctcttcctcaagaaaatatgcctagaatgggagatgaagcataggaaacttccagccacagtcaaagctacatgaatgagcctggttcaggcaaaggaaagtgtctaataacctgcctcttgatctcagattcatgaagaacctcctgctgaattcaggtgaactgtttactttgtatatcaaaacatgagtgaacattcatgattcttacagtatactcctgggtcgtttattgctttgttatggagtggtagccaactaataaaatatttcatgtttctgtagagatcattataatgtgttttgaaaactggtaaaatacttcataaatagagctttacaagtctataagatcaatgagttatggcaggtaagaatacaagat

SEQ ID NO: 1284 - DNA, 1400 bp, mus musculus
aagagtaataaaaatctaccaaataataattgtatctttatattacggtttattcagtgtttgaaaacagagcagtagcaaataatatataaatcaccatgaacctcaatgatgacacaaagcaatatatagtttgtaatgattattcatatgaacttgaaaatacaatgacatagttttgtacctttgacaaatggttctatgtgtaacttgaagtaatatctaacatcagacttaatggtaaataaccatttcattcccattaaagtcagatcaagaaaacattgttctgtcaccattgaggttcatagtgatttatatacactttgctattgctatgttttcaaatacagtagaaaaccagggcatcaagtggagggatgaggttgccatcccacagtcaaaaactctgacccaggattgtccctgtctaaaagaactgcagggacaaaaatggagaagagactgagggaacagaggtttagtgacaggcccaaattaggattgggctcaaggggagatgccaagacctgacaccactactaatgctatggtgtgcttacaaacaggagcctaccatgcagaccctccaagaggcctaacaagcagctgactgagacagaggcagatacttacaccaaccagtggacagaagttaggacccctgtggttgaattcaggaaaggctggaagaaactgaggaggagcacgatcctgtaggaagaccagcaatcttaattaacctggacccccgagatctctgtctgataccgagccactaacgaggcagcatacactagctgatatgaggccccaacacgtatacagcagaggacttcctggtctgtcctcagtgaaagaagatgaacctaaccctcaagagacttgaggcttcagggcatagggaggcctggtgtagtggggggtttagacttcctcttggagaccagggaggaagaatgggataaggaactgtcaaagggtggaccaggatgggtataaagaatggactataaaaaaatactaaataataataaacaaaaaacaaagtataatcttgctagtgtatgcaatggtgtcagcgtttggatgctgattatggggtggatccctggatatggcagtctctacatggtccatcctttcatctcagctccaaactttgtctctgtaactccttccaagggtgttttgttcccacttctaaggagggccatagtatccacacttcagtcttcatttttcttgagtttcatgtgtttagaaaattgtatcttatatcttgggtatcctaggttttgggctaatatccacttatcagtgagtacatattgtgtgagttcctttgtgaatgtgttacctcactcaggatgatgccctccaggtccatccatttggaa

SEQ ID NO: 1285 - DNA, 1000 bp, mus musculus
tcacaagatgttttatgcaagtgcctttaccgggttgtattgtatctagtaaggactgtgttaagactggagaagagggcttgggtattgactcagtagctgaagatcctgttgtgtacacatgaagaactgagatcagattccaagcaatcatgtaaaatacctgggactggaagcaagcacctttaatcccagtgctgctggggtacatgctggcttcatgggtacatgaaggtttgttggggtacatgctggccagtctaaataactgctgagccttaagttcaccaagaaaccctgtctcaaaaataaaatctagatgtccttcaacagaggaatggatacagaaaatgtggtatttttacacaatagactactactcagctattaaaaacaataaattcatgaaattcttaggcaaatggatagagctagaaaataccatcctgggtgaggtaacccagtcacaaaaaagcacacatggtatgcactcactgataaatggatattagcccaaatgcttggaatacctagatacaattcacagaccacatgaagatcaagaagaaggaataccaaagtgtggatgcctcagtccttcttagaagggggaacaaaatacagaacaaaatagagacaaaatgtggagcagagacatagggaaaggccatccagagactgccccatctggggatccatctcatatacagtcaccaaacacagacactattgtagatgccaagaagtgcatgctgacagcagccagatatagttgtctcctgagaggctctgccagagcctgacaagtacaaaggcagatgctcccagccaaccatttgactgagtatggggtcctcaatggaggagttagagaaaggactgaaggagccgaaggggtttgcaaccccacaggaagaaaaataatatcaactaaccagacccccagagcttccaggaactaaatcaccaacaaaggagtacacatggaggcacacatata

SEQ ID NO: 1286 - DNA, 1400 bp, mus musculus
gtttagtcattttagcgctattgcataggtcacaaaagacaatcacttaagcaagttacaatggatctatgcttaaaagcaactgctttgtattttctctttaaaatactagtgattcaaacatgccatttcttgtctgagggcagtgaacctaaaactgttgattggcacaagtaaggatgagataaaaggtgaagtaagataatttatagggagagattgtgtttctttccaattaaaaaggaactaaataggagtgcaatacaatatttgtgtttttctatctcttttacattttaaaattagtataaaattatgtgtggctattaatagagtaagagattttgttatgcacattatcaaaactcatttcagtgatttgattgtcccttttactctgattcttcctgtaggatgatagtccttagctatttgtattagttcagacagatgtgtgaagtgagaagtgccatgtggagaaaaggacgactgactgactctagctgtccatgggcaggtgctgtcctccaaaatgcacacagaagccagtactgtggcatcataggtttgtaaacttaaagggctctttaatttaaaacaaatgtactcatttgttttatattttgaaaatatcatataatttcatacttatttctttcctgtctttgctcccctcctgtatacccattcttactctttttttatacatggctctgtttcttaataattcgtgttacatatatgtgcatacacacacacatacctacatgtatgtatatgttcctgtgtgtatagcatgtgcacatgcgctaatgcacatgttcctaaagaagatagtattccctagagaagaacacacatcaattcattatctaataccaaattaacatgcctgaaaatatacacataaatgaaatattacaaagacgagcagattgtattcatgtgcttaggaaagtgcttttactgcaagctcccctacagtgagacggagggcacatgaataccagtcttcccaattggtgaaagagtttaaaaagctcttgtagctaatgggatgtttgtaaccagacaccttcgtaggatagctgcagtttctatttccaaatatataaaatggagaaaatgctatcaaaatgataattttgacatatatacaactgaatgatataggaaataagagataatttatgtacaaaattttggtattttgtgaaatgctacataaacatcaaatttgaaaggatagagaattatgctagtggttgctaacatgtcttagatcatttttcccccaaaacatgatattatgtggctaaacaatgtatttagcaggtattaatattatcaattttactggacaaacagtgaaaacaaagtttcttaaaagttagatgata

SEQ ID NO: 1287 - DNA, 1600 bp, mus musculus
ggttccccactcctacatccccacccccatcccagactctcctcctctgagagtgtagagcaccaagaactgactatccccacaccctggcacatcaagtctcttcagggctagacactctctctccactgaggccagtcaaaacagcctacttaggggaacatattccaaggatgggcaaaagcttttctgacagtcccactctacttgttcagtggtttaacgtgaagaccagtctacacatcagctacttatatgtgagggagtggtctgggtccagtctatatatgctctttggttagcgattcagtatctgagaatctcccaaggtccaggagagttgactctgtttgttttcttatgtagttcctatccctgggggcccttaataattccctaacttttccataagagtcaccgagctccacccaatgtttagctgtgggtctgcttctgttcaagtcagctgctgggtaaagcctcccataggacagtctacaaccataacatattatctatcatttataatgataatatcattcatatcaggaattgttgcttgcccatggaatgggtctcaagttgggccagtaattgattggccatttcctcagtgtctgctctatctttgttcctgaattttaagtagacagaacaaatcttgggttgaaagttttctgaatggattggtatcttgatcccccacctgaatgtcctgcctaccggatgtgacctcttcagtttctgcattcccactgctatgagtttcagcttaagtcactcccatagagtcctgggaacctgcccaatcccatgtctccaacatgtcctagagatgcaccccctcctccaactcctgctagcggcatatctccatccactctcttggcgctcttgttctctcccctgtctctccccacaccagttccaaaaccttccttattctgtttttctttccttcctccattcatttcccttcttccagctttttcctatgactattttattcttccttctaagtgatactcaagtaccatcacttgggctttccttcttgtttagattctttgggtctatggagtgtagcttatgtattttctactttatatctaatatccacttataagtaaagacatattatgcatgtccttttggttctgggctatctccctcaggatgatattttctagttccaccagttttcctgcaaaattcatgatatccttgtttttgtttttgttgtttgtttttgtcttgttttgttacttatttatttacaatccaagtgctgtcccccttgaagtgccctctcccagagttcctcccccttctccatctctttctttctccttcatctctgggagatcatccttgcccatattaccccctgcagccctgttgcatcaaacctctgtaagataaggatcaccctctcccactgaggccagtcctttgctgcatatgtttcagagtcctcagaccagcccatgtatgctctatggctggtggctcagtttcagagctctgaggggtccaggctagttgacatttgttggttttcctgtgtggttccaacctccttgagtgccctcaattagtc

SEQ ID NO: 1288 - DNA, 1400 bp, mus musculus
tgaaaagtctttctagataggaactatttttgattcttctcaaaaagtaaataaataaataaataaataaataaataaacaaataaataaaaactaatggagagataagatctcttcctcagagacaacacttttcaaaagacacatatgtataagaatttcatacatccttttttttggttctcatactctcccactactcactcctctacctcacatcctctccctctgcttctgttttatcctttatgcatacatcccttctttttcttcacatttgtttttctttctcttcctcagtattttgttttcttcactatactttcacagaatcattttttaattgcattgtgagatagtaagcttacataggaattttaatgtttgctttctttgatttagtctttgctttcatggcctgatttcccctattatttccaggcttctccctcataagtttgtaggcctcagcatctgcctcactactttcactttatccctaatgcattgctcctccctcaaaaacttgtccacatctctctgcaaaggcctcatcctaattttctggcttccatttgtgctccaaattgaattcccaaagcacaagattcggagtgaggatccacacatgacaggcagcatacctgcttatcttggcccaatttcactcactcagtataatttgttttacatcatgattgtctgtctataagtaaaattccaccctgtatttgtgctttgtttttttttaatcccttcatattttgatggacatctacttgattacgtttcttagctattcttaatagagcaacagtgaacatcaatgtgcaaatgtctctggggtaggataaaaggtctgctggaattatgcccaggagtgatatggatgaaccatggagcagttctaaactccaagacaaatttcaaaagtggcttcactaatataaattcccaccaatagtatataaatgatcccctttcaccttgtccaagatagtaactgttgttatttgtgctccttgtgatggccgttttgattaggataagacatactctaagtaattctcatgtccacttccctcatcatagatgatgctgaatacttttgttaacctactagctagcaagctaatttcaaaataaaacttggaaaaagattaaagggaccaaacagaagtaccatgcagaattgaacattgatccttctagaacatgtaggttactaaatgaaaatcagaatgcaaatcatgggatatgtttctatgaattattggcaagaaaagctgtaggattctccaaaacagtctattgccattgtctttagttaccatcataactacatagtaagaccctcttgctaaagaaaatgtaccctttggctgaaggacatgaagaag

SEQ ID NO: 1289 - DNA, 1200 bp, mus musculus
gtggtcttgttttctgttagtaagattcttacatttgccttttgccatctggtaacctctggcgttagatgttctagctgtctctggctggagcttgttcgtcctgtgattctttagcctttgtcagcattcctggaagtccaactctcacctgggtcccagttgtcagagcactttctgcaggcaagctctcttcttgcagggaaggtgcacagaagtcaagagctcagatccacctcctgaatcctgtggtcagagccctccctaaaggctgactctcttctggcagggaaggtacccaagggtctgggtctcagctctgcctgcaggctgaggatgaaggtctgaagggaccctttccaagaaacagttgcttctgctgtctacgtgctctcctgtgtagactggtctcagtgatcccaagatccttggtgtgctagggctcctgcagtgtggagtgtcctctgggaccttgggaacctttgcagatttcgagcccaagatggtgctgggctggagccaacaggaatgaagcccagccactggtcagtgggtttcctttgtccctgtttctgctcacacaagaccctccgggatttttttgaaacagatgttgcattccactcaccagtgatcccaagttcctgggtgtactagggcctgctgagtttgtgcccaagatggtgcgaggctggcgccaaggaaggaaccacagtcactggtcagggatgtttcctttgtccctattcctgctagcacaagaccttctgggttttttggaacagatgttacgttccactcaccagtgatctcaagatcctggttgtgctagggtgtctgcagtatggagagtcctctgggtaccttgggaccctcggcctagtttgtgcccaagatggcacagggctccacacagactttatttgaaactataagaagaaataagtggcctcgcagaataatagtcatagatccacaatgactgaaagcccaggactgggccttttaactctctgctattatacatttcagtgaacctgaaggcaaaaaaaaattatgaagaataattcttataataatgatacctgagttttagcttttacactatgaacagagtcaatatttgcttgggcagacagtgaagacatgtttgagatgagagcaatctaaagttctgttttactcctgataacttagagg

SEQ ID NO: 1290 - DNA, 1000 bp, mus musculus
tatcctccatcctagcctaggattaaggccctagttttctttaaattaactttacatcctgatcataggcccaccccttcctctcttccaattccacccttacaaatccctcttccattatccccttcccttctcctcagagaacaacttcaattacccacttcccttctcatgaagaacaagttgcacatctactacaaatgtggagggggtggtctagattcagctcctacacgatccctggttggtggcgcaggctctgggaaccctcatggtcccaggttagttgactctgtggctcttcttttggtgtcttcttgtgatgttcacttctaccctacactcttccacaagacttcccagattctgcctgatatttggctgtgggatctctgcatctgcccccatttgttgctggatgaagccactcagggaacaattgtgctaggttcttgtctgcaaggatagcagaatctcattaatagtgtcagaagttggctctctcacatgggatgggtctcaagttgaggcagtcattggttggccattccctctgattctgctctctctataggcaaaacacaatttggattgagggttttgtgggtggattgatatcctcttccttcctctggacctcctgctgggttaaagtaggtgaccagttcaggctctatattcccctctggtaggaatctaagctagaatcacccccatagactccctgtatcctctcctgtcacgggccttcgcctactccatcagctagtcaccagagatactccctgccaatttccagtcccactccaagccctctttcatcctcctgtagatcccctacagacattattaccacccagatgcctctcctcacctcctctcttacccagttccctttctctattcacctccaagatggcattgtatacccatcagaatgactaagatcaaatattcaaggaatagcacatattgaagaggatgtagaaaagggaaaaca

SEQ ID NO: 1291 - DNA, 1000 bp, mus musculus
aagaagtgggtacatagattaagtaaatgaacaaataaaaataaacacatagattgtctctaatggcttctgtaagggttgcttctcagtgtgatgttcctaatttcactttgtgcttcatccaaaaaacacatcagtagccatccctaccaagcacattgacactgtcaatgtcagtgtctatttggacttgtaccaaaatgacacatttaaaattaaaaagggtaatagtctttctagttactatatcttagtatcagtttttattgtttgctttttcatatttattttaacatacaatttataaaagaacagacatctgtggttttatatactactatacagttatgaaatgttgcaggcaaatgcctagtaggtattgtggtagaaaagaactagtaatcatcatcttagatgaaaatgattagcggagcgtggtggtgcacgcctttttttttaatttaatatattttttccattttttattaggtatttagctcatttacatttccaatgctataccaaaagtcccccataccccccacccctactcccctacccacccactcccactttttggccctggcgttcccctgtactggggcatataaagtttgcgtgtccaatgggcctctctttccagtgatggccgactaggccatcttttgatgcatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtgtacgcaatggtgtcagcgtttggatgctgattatggggtggatccctggatatggcagtctctacatggtccatcctttcatctcagctccaaac

SEQ ID NO: 1292 - DNA, 1000 bp, mus musculus
ggactcttcttggatatcctgttgttgccttgtatcatggagatcctgaagatttggaattatggggccagcccctacataccttcaagcagctcatcaacggggtagatgttggggtgggccaattcaaagccctggatctgagcctggtctgtccagccagcaggtctcctgctcccatacccaccctcagggctggctcatccatgttcattccattagaaccagctctactatgctgctgagggggaggtgcagggaagtatgcagagtagtacagctgtcagctttcctgctgtcatgcttcccagggccagctctcccagcatgcccaggagatgggtagggacagttctgcacaacttgcaggtatcagcatgtccctgggtggcagcctagacgagcacatctgcctggcctttgatggttacagaccaccccccccacccccccaccccccctccacccccccccccccccgcttcagggccaaggaccctgatgtgacccctggtggcatcacaggccaggactccaccctggtcccagatggcattgctggttcctcacctcaggctgctcctcactaccctctgttgtgtccacatcctttttccacttccatttctccaccacttacttctcttagtgctgcccagggtctccgagtatctggggtcctctcaggagtggtcttagtagtgctatgctccacttgtgctttatggctctgagcaaaggtattctcaggcatggtcttgccgcctccccccacccagggcttcgagatgctatactggtggtcgtcttgtgctagctcccagtctaggcccaatggcacaggactggtggtcatcttgggctcactctggtggtggtcttcttgtctctgggtcactccctctgtatttgcatagcactggactggaggtcatctcaggcttgctgtttttcagggagtgttagcctgctaatcattcagatgttcgtcttaaaatag

SEQ ID NO: 1293 - DNA, 1000 bp, mus musculus
cccttgttcactctaaataaagagaacaagctgtttcactggatatcaatcatttaagagagttgtttcaatgaatactgtctaaaatagctataaagctaaaacccttacagaagactccaggcacttccagccagactcagatcctgctgacccccatctaatgtgcagtggcaggcacctggacacccctataagaaccatatttccccacttttcaaatggttattttatttatttacatttcaaatgttgtccttccaagtcttccctctgcaccctccccattccatcccaccacccctttgcctctaagagggtgcttccttacccacccacatactccagcctcaccactctagcattcccctgctggggcaacaagtctccacaggactccccctcccattgatgccagataaggcaatcctctgctttatatgtagctggagacatggacccatctatgcatactctttggttggtggtttactacctgggagttctggggatccgattagttgatattgttgttcttcccactgggttgcaatccccttcagctccctcaagtcctcccactaaggcttacatttgggtttctgggctcagtctgatgcttgactatgagtatctgcatctgtcttagtcagatgctggtggagtctctcccttccccattttaactggatttttccccctgatatccagtttcttcagttttttattttatatttttggatgatagtctatcagatgtggtgttcataattctgttttccattctgtaggctgctgttttgtccaattgattgtgtcctttgccatacagaagctttttcagtttcatgagatcccatttactaattgttggttttaatgcctgcactattggtgttctgttcagaaagtcatctgctgtgccaatatggtcaaggttattcctcactttctcttttatcaggttgagtgcatttgattttacgtttaagtctttgat

SEQ ID NO: 1294 - DNA, 1000 bp, mus musculus
atctgcgtccaaaggaaggacagaggaaaaccaggttcagacctcagtcagacaggtgaggaatgctccccaaccaagcatgtgagtgctcctcccccaaccacaagacaaatgtgtctgaactgcctttgcaacagactctctgcttgatgctacaggtttgaagatgaaccagaccctatccagggagaagaaaacagaccatgctaataagacctacagagttctgtctggaataagtggagagaatagccccaccctgaaggggactgacctgttgaatttggggctgtgtgccaggaagggatgcagagtctggcatcactgggatggaacactctctggatagcaacaaaaagaaattgctcaaaagaaagcccagtggatccctggagagtccagcacactgtgcaaaaggcttagtgggcggggatcctaaatggaatgcaagcttctggtagcaaaggcaatggctagcagctggagaactccgagcaaacctgcagaagggaggcagaaatagagcagaggacagggttgctgggccctgggcgtggccttccacgatctctgcctcatcttatttggcacactctctacctgcttcaggaaagtacagttcacagacctgggttccccctggtgctggaaaagagctctccagtgctgagcattttaggcaaggctccccaccaagcccctaacctgtataggtgagttcatgtcttcctctaaaagaaccgaggaggggtcacactctttcttccgcttctcccagaaaccttccatctacagctttaggttgccaggggacctgctgaccttggtggtgactacactcttctgcctctgggagatgaactgactcagcaaacccttgaggccaagatgaggagttcaaatgtcagcattgctcggcagagctgagaaacatcaatgttgtctctataaagctggaggtaccagggttagcaaagcaggaacatgtgacagttttcag

SEQ ID NO: 1295 - DNA, 1200 bp, mus musculus
gagatcttccctgggttcattgccaagcactgggaaagggaagaaaacactccagcattgcatgaccctaacaagatgtgtatttttcagtctttactagagtattctgttgttcccatatttatgtgtaatcttttaaacagaaatgtcaccactaccttatatgtaatttccccatgtatttctgtgttataaacatttctgtagattagtaataatggctgttttaagttgttgtctgttaatgtcttggcatgcttttgttttaatgaggttatataagcttgtgccctaaacacctttattaatatgaggtttcctgtgatgatttgaaagaggaaacattctattaatggtggcccgtctcaagtaaaagcatgtgtgtatgcttactttaagttgtgtttggcaagcgttcccttcccaccgaatgaagtacatgcttgtaagcttcgccatctgcctgcggtagatgtgcagggtgcaggatctcgtgtgcttgcgtttgcttctggtagttctccatgcgtatgtgtatgtgtgtatttctcttcggaaggggagggtaatgtcttctgttggaatgcgcactccaccctctctgataaactggtaagattggcatctgtacgcacagcagtcatcttcatagcgcacagcacttagctcccataatgaatgcgcggggtggagtgtatcgcagccattctcacctctcatttgtgtgtttgatgtggcatttatattacgtaggagtaattttttttctgattttttttttcttgtgtcaccagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactaggtaattgtttttctcattattagctgttgcatagtactgcagaaggctgttctggttttagccaaaatatgcgtacaattggagataacgtgtaaaatgtttgactacccatggccaaaataactgtttcagattacatataactatatacataaaagtatgtatggcatatatctgaaactctttcttgttgcttcttttttttttctttgattaaagacttgtttccccactgg

SEQ ID NO: 1296 - DNA, 1200 bp, mus musculus; identical to SEQ ID NO: 1295

SEQ ID NO: 1297 - DNA, 1000 bp, mus musculus
tcagtgtcctcctccttcattcttggccctcctgccttgaagcagtttctcgctgaatcaagctcatcgtttcaggtgggctggttggccagccagcttctgcctctcagtggtagggtcacagacacagatagcattttgtgtaggtgctggagactcagactcagttcttcacccttgcaaagcaagcactcttatgtagacccatgccacgagcagggaggttgagtctccgaagttaagaatattccagagacctgcatgggagaagccattttctaggcatctgagctcaagggtagtacaaagaaagcacttttcatttttgtcatcaaaacaagcaaaacaggggctggagagatggctcatcggttaagagcactggctacttgctcttccagaggtcctgaattcaattcctagcaaccacatggtggctcacaaccatctgtaagagatcagatgccctcttctagtgtgtctgaagacaacagtaaccttatataaatgaaataaataaatcttttttaaaaaaccaagcaaaacagaatgacgtttactgttagctcaagtaaatacgagtacagtgcgggaatatgccttggtcatgtgagaagagccaaaagcattccttccaggcctttgcctgtcctacagagactatgtggccatgccaggccattcccttcaggtccttgctttcacgtcatcatagtttatgcattgtgctttaggccaccttgtgggaagaacactctgccctagccatagtttaccgtgaagttcacagccttcttgcacaggctcccacatcttacccacagtccgcagctcccacctgctttttctttaaatctattttgtcaaccttgtcttttaattagaaagattagggtattaacatatatcataattattgataaggttaaatttaagtcttttacttgattattgagctttctttttttttttttctcctccttgctccgttcttattatg

SEQ ID NO: 1298 - DNA, 1400 bp, mus musculus
cttcgcctgggttccaatgccctgtagatgactatataaaagtcaactaagaagttacctattcagtactaattagcattataaagtcagagcctacagctcagggctaatctgctagtagtttactaggacagaaaggacagtcttatccagatatggtttaccataagaaaagttaagaaatcccactgagacaggttttttcattaggccctaaaattcaggcagaactatagagcagaaataaattttatgcctcagcccagccctttcttttttatattaacaacagggaggagatgtagcctcccctccccagcctgaacctgtttgctcaggtttcagtattagagagcattggggcagaacttctcgccctatcgtcctgccactcccactgccgctgcctggcaactagctgttctggacctatcacgtgtgtacctgcaactttacttcaagatgatttggcgagatttggttcccttcccctgcttcataactgagtgtcagaaatagtaaaattgaaacttgaacagagccttgtcttggttctgtctttctctcgtgccgcctagtccccccacccctttctcttccaggtttccaagatgcctttccagactaaaacccagacatgtgagctgctggccggacacaacaccaagtagctttggtttctgttttaagttgttgcacttgccattagccatctggttatctctggtgttggctgttcttgctgtctttgactgttgcttgtccctcctgcaagtctgtgtgttagtactcctgggaaaccagttctctccaggaggaatttgggtatagaaaactgtgacacagtttcagcttgtgggtgcagacagaaaccagaaggatcctgtcctccaccgttccatggttcctgtgtcctgttggctctgggtgggtccttcttggaccaggaatttgagcaaaactgttggtcttacctgtgttcacaggtgtgtcagtattcctgggagaccaggtttctcctggcaggatttgggtatggagtgcggtggcacagggtgagctctggagtcttcttttgtttgggatgggagacttttaatgactgcttctatttcctagggcctatagggttatttaaatactttacctaatcttgatttaactttgataagtgatatctatctagaaagtcatccatttcagttagacttttcaattttatggagtacaggctttgtaggtctggccgaatgattctttgaatttcttcagtgtatgttgttttgtctccctttttatttctgactttgttaatgtggatactgtctctttgcctcttaggtggttaggctaagaatttgtttattttcgttgaatttttcaaagaaccagcttttgtt

SEQ ID NO: 1299 - DNA, 1800 bp, mus musculus
gtagctcacaggaatccataactgtagtatcaggggttctgacaccctaggtgtgcactgcaagcatgtgatgcacagacacatgtgcaagcaaaacactcacaaacatgaaataatatattaaaatatgaaagcattaaccagaccaccaggaagtaggcagagggctatctagggcatggagagtgtccacacatgcaaaggccatgacaaataggagcacaagtagttcagagagccaaaggaaaccttgcaggagcacagcaagcatagaagttatgaagtgagtcaaggctagaaagggggttgtttcagtttgcagggtgtgactttacgaaatcatgcagtatgggtgactttaacagcaagaattgaactctctcatttctggcagctagaactctgagagcaaggtgttcaatggggctagacccctatctccaaacttaggttcttctactgaagttattttatatagtctgagctctttctccataggaagctgttcttggtccttttgtgttagacagttgttctcagcttatatggcatcacatatttttcctattttagttcctactaaatgccttcattactttttacccaatccaaatcaaatgtaaatgcctctgtggtattttgttaggtggggttttttagcggaataaaacctacagcatgtatgtgatttgtttgttagaatggcttacagactgtgtagttcagctaatctactaacagaaattccagggattctttaattgttcattcctcaaggttggatgtcttagctttttttcagccacctccatgaacagccagggccacgcagacaggcagacagacagacaggcctgtgtagccaggcctagagcacaaggagccacctccatgagctgccaaggccacagagacagccagctagccagccagacatttagatcttaaataaagacagttaaagctcctaaaatgctttgctggctgtttgtgtgtgtgtgtgtgtgtgtgtgtgtgtgtgtgtgtgtgtgtctgtctatgtgcagaggcagaggcagaggcatagagatgtctgagttctagcacagcctgggtcacacagtgagctccaggacagacagacagacagacagacagacagcacagtgtagccaggcttggagttcaaggagccacagtcatgtacaaccagggccataaagacagacagccagacagccagacagccagacagccagacagccagtctcttgtagccaggcctggaacataaggagccatctccatgcacagccagggctacacagacagacagatagacactgagatctgaaataaatacatttaaagctcccaagatgcttttctgtctctgtgtttgtatgtgtgtgtgtgtgtgtgtgtgtgtgtgtgtgtgtgtgtgtgtttgtgtgtgtgtgtgtttgtgtctgtgtgcagaggcagaggcagaggcagaggcagaggcagaggcagaggcagaggcagaggcagaggcagaggcagaggcagaggcagaggcagaggcagaggcagaggcagaggcagagaggcagaggcagaggcagaggcagaggcagaggcagaggcagaggcagaggcagaggcagaggcagaggcagaggcagaggcagggcgatttcttagttcagagccagcatggtgcacacagtgagggtcacaggaagtgtttatggggggaggggtttcatggctctagtgtgttgtgtgaaacagctacacgaatcttataaatttataccaattaaagaatttttattt

SEQ ID NO: 1300 - DNA, 1800 bp, mus musculus; identical to SEQ ID NO: 1299

SEQ ID NO: 1301 - DNA, 1000 bp, mus musculus
tgaaaaatctatctgaaatggatgactttctagatagattccacttatcaaagttaaatcaagatcaggtaaagtatttaaataaccctataatccctaaggaaatagaagcagtcattaaaagtctcccatcccaaacaaaagaaggctccagagctcaccctgtgccaccgctctccatacccaaattctgctacgagagagctagtctcccaggagtgctgtcacacctgtgaacactggtaaggaccaccagttttgatcaaattcctggcccaagaaggacccacccagaaccatcaggacagaggaaccaaggaatggtggaggacagggtccttctggtttctgtcagcacccctaatctgaccctgtgccacagttctccatacccaaattcttcctggagagaactggtctcccaggagtactgacacacagacttgcagttgggacaggcaacagtcaaagacagcaagtccagctaacaccacagattaccagatgtctattgggcctccctgctttataagcacagtctcttagtagactcgtgggccttgatcagagaaaaatttatcttgcctcgttcttttcctgctgtctagtctttttcagcccccagcctgcctttcaggagtacctggttcatgtaagccacgggcggcttagtgttacagctataggcaagttcaagaatcttaaaacagaaaccaaacatcagaacccagctctcccaccacagcaagttctagatacaccaacacaacaaaaaagtaagattaggattcaaataggatttagactatggtctactgtgcttcactaagctcaactcttttatttgcattctggggatcaaactcaggacctcacactgcacagcaagctcttgaccagttgagttgttgtcccagcccttgaccctttttgatacagcagttagtctagctgaatactttaatgtttgaaattgggacatttccttcctccgtaaaag

SEQ ID NO: 1302 - DNA, 1000 bp, mus musculus
tcaaattatacatacaaatgtaatatacatacaaatgtaatatgtatacatagagcacaaacctaacaggcacaaacagaggatgcccctgcagtggggctgtaggagacagcgcaacactcagcttggccagtagagggcaaccgtgcctttgctacacttgcagtgtgagtgctcaaccaatttcttaagcttcatcatagtccaggtgtctactgtggttaagttctttctctttcagacatagatgagcttcacagagctatgcatgcgtagatacaaaggccatggtgtggttgttgtgtctgtcccattatctccagagtttctgtccttatcttttcagttgtatttgacaggcactgttcatgtctttatatatctaattactgcctagtggatggattaaactgcatgaaactaagctgagtaccacaaccaggtagcatggaatgtcagacacattggaacttctctgcaatatagagcttatttagtctttttgttatttacaaacaaatgtctaacactagatttatagtgtatttgaatattggatttggttgattctttttaaatatccatttcaagcaggtccatttcctatagtcatcccaaaactatttaaattttctttgcatctaaataaaatcaaagtgatcatctctccagaaaaccaattgtcaagcttacaaagaaattaattctgaattgctatttatcaaattaattacaagggacaaagtcagtgattgacttatcatccacatagaagcatataataagtccattttaagcatttattttgctgtgtttttaaacaataatttgtgtgtttgtgtgttcatgtgtgtgtatgtgtgtttgcaggtgcatgcagaggcctgacagggcccttggctgacagctgatagctgcttgacatagctgctggaaacttccgttcatctacctaaaactgggtcataccttgttttgccagcctatataaaagacatgg

SEQ ID NO: 1303 - DNA, 1000 bp, mus musculus
tcatttttgcatatgcatatacatttatatgagttagatttattttttaaattattttgtttatttatattctaaatgttgacccttcctcaagagctctcctcccagagttctttacccctcctacctccttttcccctctgagagggtgctccctgttaaggacatcccctttctctggggcataaagtctttacagggttaggtgcatcttttcccatggacgccagacaaggcagtcttctgctacatatgtgccaggggtcatgggccagctcctgcatggcctttggttggtgtcttagtctctgatccccatgcataataacaacacaacatctcaaaagagcactgtgctcccaagaagcacctctggttcccttgtgttcgttagatcacgttgtatacaacacatggtaaacataaactaaatttagttaatgcaacaggattgtttcttactcacactaagtaaccattgccatccctcagagatcttttattctgcatccttggggccaaaggctaaaaaagaagcaacgatcaaacactagtaaccactatggtacagacaaacaaaactctgaaggttcttcactgggcagataaattctcctcctcctcttcctcctcttcctcctcctcctcttcttcttcttcattggtcagaattgatcccatagccctgtgcaaagacagtttatatcatatatctggaagagattttaagtttggatatagcactaagggctaacccaaacatccaccagatatccatcgataaccaccttcaagtttaaaagaaaaatatttaatgttttttaatgtataagagacagacagaattcagtactgtgacaagagatcttagccactcagaaagggaaaagtaattattgaactaagaggtaacaaataaaatgcccaccatattctgcagacataaactaaagaatagaaaaatcattaaaattaatatgaaagtatacacgattgtcta

SEQ ID NO: 1304 - DNA, 1200 bp, mus musculus
attttgttcaattccatcatctgtttggttgtgttttcctgtatttcttcaaggacttctacctctttaccagtgttctcctgtatttctttaagtgagttattaaagtccttcttgatgtcctctaccaacatcatgagatatgattttaaaaccaagtcttgcttttcggttgtgtttgggtatccaggactggctgagttgggagtgctgggttatgatgatggcaagtggtgttgttttctgttagtaagattcttatgtttgtctttcaccatctgataatctctggagttagttgttatagttgtttctggttggagcttgtttctcctgtgattctgttagcctctgtcagcagacctgggagtctagatctctcctaagtctcagaggtcagagtactctctgcagtcaagctctcctcttgcagggaaggagcacagatatctagtgttcagacctgcctcctggctgaagatgaaggcctgaaacagggcctgtcccagaaactgtgttgcttctgcctgtcccagaagctatgtcccttctgtagtccgtactttcacctgtgcagactagtctctgagggatcaggacccaagattgatgccctaggtgctctggcagagccctcccgggcgtacatctctcctcttgcagggaagctgccctgatatctggagccccaaacggggtctgtcccagaaggtgtgtagcttctgtagtccgcactctcacctgtgcagactagttctgagggatctgggatccaagatggctcccccaggtgctcagtggcagagccctaccaggcgaggtggacatctcttctctggcagggaaagtgctcggatgtctggatcctgtcccagaagctgtattgcttctgtatttagccctctcacccatgcagactagtctctgagagatctgggacccaagattgaaaatgttcttttgatcagaaggaagtagctttcttttaatacttctcagcaaaactgagatactttcatcaattcacatagtaatataaatcccaaagagtagtgaagttcatacttacccttccagtgttaacaggaaaacagtagttaggggccaaagttgaccatgagtggagggtttatagtcagtgacctctaaggctcttaataactgtgatagtgcttaccatttgtcatggaaaaagcttca

SEQ ID NO: 1305 - DNA, 1000 bp, mus musculus
acaagatccctgttctggagttcagtctgaggtccctgtggacctgctggaattggctctgggtcccttggcctgcacagaggccaaggacggcaggttctagctctttggtaccacagatgttgctcagtgctgtggaagtgataagaactaagagtagagtgtgggcttgtggggttggctctggccctgggccaaagggaaaaaggcagggttcccgcagggaggacagtctttggttttcctggtcggtggcttgagttggctggcagctgtggctgagaatgcagggaggcttcctgagtgagatgagatgggaggctctttcaaggaagacctgctccattgttccttgcagagggtcttgatgagaagagacagtccatggtttcaaggcatttattgtcctggagagaggcagaggaaggcagagctagggagacagtagagagaagtagaggccatgtggagaggagagggggagagtatgcgaagagaggggaagcaagaggacaagtaagagaggcaagagtaagagagtaaaaacaagaatgagagagtaagagagggaggaggtggggaaacagccccttttatagtgggcagggcctacccggctattgccaggtaaccatggggaggagcatccctgactgtggccaggtaactgtgggcatggtgttcagacagaataccaggagcttggggcattgccctatatgactgatgtccacagaaatatggagctggggccttgtgtcaggagtctagtgtctgggagtgtggcaaacttctttccattccttgcagagttatctgttgggtccccggggtggggtttaaacctagctcaacctgaaaacaggctgcctttcacagtcccacaaaattattatctaatatttgaagaagtgggccatcccaagcaaagcctctataaggatggtaaagctgcctaaatataggaactgtagtcagcagaaagtgtctggctgtcaac

SEQ ID NO: 1306 - DNA, 1400 bp, mus musculus
ttatctggatataggtacatgactgtgttcactttaggaaaatgtacaaagtttacattcatgattagtgtgatttttctatatgagtattatgtttctatagaaacttcaaaaagaaagtgaagaatcattgtcacaaatgagtgaaacaagccaaagtagtgtaagtgtttaataaccctagagacttgggatcattaaaccttaaaaatataagagcctcaaagttgattgactcaactgtctcatttcacaggcaaagagaaacaaacttgtatatagaaacaccaagaccacacaaggattcagtagtggaatcaggtctggtgaaaccctcagctcatagtcctctgctcttcatgattctgccttcctaatcatatgatgaaggggagatgtattttcaacatgagccatgaatctcagcatgtcatggcatacacactttcaaataatgattaatacaatatctgcctcacaaatggtttcagcagctgggatgaggcagacatggctacactaatgtgctgtccatgacgcatgggttgaaagagtggggtggagtcagttcttgagtgaaggaacaaaaggagagtttatctgcctggaatgcaatggggatgaagattccaagaaggtcatccagggagacactgtgcctgaatcccagagaagtctgggtgcatttactgacatcccaaacatctgtgcttttgcaagggagataaaagggaatctgcttctctgcctcgaggcatgatgtatgggcttctgagacactgggtgtggactgctcttgaaggcacaatgcagaggttgatagatgaaggctaagggaactcaccaggccacacattaataaaaagtgatcaacctgccctggatggcggagtagaatgctaatgccattctccatgcaagtgttgacaacagagaatgtctggagggtgcaaccctcctctgtctatctttgccttgattctacatgtccaaattagattctctattcttctgccaatggcctaagtaagccaaggctggcaaggcatattctatcctaaaaccacccatggttttcacctgcctctagccattcttgactaagagtgagaaactgtgttctcatcataacttaaacccataagtaccccctcaccctccactgctgaaagaagaacatctagctattttaacctggcctttgagtctttcatcaaaaactccaatctcttctatatggtgctcctgtaggtaacttccattctggcctcatgtctatccctttgcctgaatttcctcttttattggaatatttccagaataagctcaatgccttcataaaggcatcctcaactatcagatactcaaactaaagtgatatattatctattctatctcta

SEQ ID NO: 1307 - DNA, 1000 bp, mus musculus
cactttacaggcattctaatgcacccaagatcacaggatcagagatgaggaggatacaacatctgtcccaacaccacctcaagtaactgggaccaactggatctagggaggcaggaaacccgccagaccagtggcatggtcttgaggtctgggccagaggcctgaacagaccttggcctgaactctgcagccagtcccgcaatgcccataggaagctccacttccaggtgttctaacacaactacgatcccagaaggatcccaggggctagatcacatcaggatctcagggtcccagaggctgctggactctcagtacctctgacacactcaggatctcggaatcacatgattccagaaccacaggatcacagagacatctggactctgaggagttctgacacaacaaagctcacaggaaggacagcctccagtcagatatagtgagggcaggtagcactagcgataaccagatggtggagaggcaagcataagaacataagaaacagaaaacaagattaactttgcatcgtcagaatccaattctgatcaccatcacacctgagaatcaagttttggagctaaaaatcaattttcatgatggtgatagaggattttaaaaaggacataaataggaggctgcaccatcttcagctccagacaaccagccaccttcctggccaaagcaacacagctcatgggaaagatcctgttttgggccttcatcttcagccaggaggaggtccaaacaccagataactgtgcaccttccctgaaagaggagagcttgcctgcagagactgctctgaccactgaaactcagaggagagagctagtctcccacgtctgctgatagagggtaacaaaatcaacagaggaacaatctctaaacaaagacaactataacaactaactccagagattaccagatggcgaaaggtaaacataagaatcctactaacagaaaccaggaccactcaccatcatcagaacccagaacg

SEQ ID NO: 1308 - DNA, 1000 bp, mus musculus
aaatggatcgggcccatcagtaccattataaagcccctaacaaggaaatactggcaagggggatgtaaataagctagtatttaacaaaactgagcactgatattttagactgcctttgcagagacaatgaaatcaccaatcaaaggctcagcgaataccatttgacctctgaaaggtgccacatgaggtccactaattaaagacgaggggatttctaggaagccattgatgacatggtttgctgacagaataccctttctatgctgctaaatgagcaagtcctgggttagcagtcatcacccgtttgcaatgaatttttttgcttctttcccaccctgcacccttaggatatcataatgggcaatgtgttttatttttctaggtttagcaatcacacgagataatgatgctgcaaagtttccattgtcatacctttgggactcttggcagctcaatatgttcaacagttatatttgggaggtctcaggctcatcaagaaattccaacctcaaacaaaccagcaacacttttctgtaatttgttgtttaatccttgatgcaaactttttaagcatatgaaacacactgagaattctcccagtttactaatcagccctgttacaagtgccacataatgcagcacttaagagctttaacaacaaaccatcttcttgctgccgccaatcacacacatgctttagttcattttaccttttccatatggtggcgggtccttgttagtgtccttatttcaaagctaatgaaatgctctgagtaaataaaagttttcttaatggagaatacatgggcccacatctgaatctgtcatagatagatttcttccaaaaatttgttttaagttttccatatatatatttgtttatcaatgtgaatatgagccatatgtgtgtatttgccagagaaggctaaaataaagtgcattaaccctgagatttggaattatagatatttgtgggtcatccagcttgggtgctaggaac

SEQ ID NO: 1309 - DNA, 1600 bp, mus musculus
gagttctctggtagaatttttgaagtcctttatgtatactatcatatcattcacaaatactgatacattgacttcttcctttcaaatttacatctttttgacaaccttttttgtgtaattgttctagctagatcgtgaatactattttgaataaatagggagagagttggcagccttgtcttgtccctgattttaatgggattgcgtcaagtttctctccatttcatttgatgttagctgttggtttcagtatattgcttttcttatgtttagggaagttccttaaattcctgttctttctaagatccttaacaggaggggatggtatattttgacaaaagctttctcagcatctagtgaaatgatcatgtggattttttatttgaatttgtttatatagttgattacattgagggatttctgtaaattgacccaagcctggcatcactggggtaaagcctccatgatctttgtgaatgatgcttttgatgggcacttgaattccttttgtaagtattttattgagtatttttgcattgatattcataagtgaaattcatctaaaattctctttgttgggtgtttatgtggtttcggtatcagcataactgtggcttcaaagaatgaattagttagttgtcctgcgctatcttctcgccagcaagaactcacacggaacaccaggatccttctgcagcaaagcttttattgcatcttgaagaggaagaccccaagccccagaaaggcgctgcttatatacaccctagcgtggagtgtccacgcctgactggtcgcttacccatgatctcattgacatgccccggggtgggctatgacttcgctcaaacacactcttgcacatgagcacacagcttgtagagctggcgcagcggaagctggcgccatcttatcgcggctctccacagttagtattccttctgtttctattttgtggaatagtttgagaagtaatggtattagctcttttttgaaattctgatagaattctccacttctggccctgtggtacttttggtagagagacttttagtgactgcttctttttctttaggagtaacgtgactctttagatagttcatctggtcctgatttaattttagtatttggtatctgtctagaaaatcatccatttcatctagatttttctgttttgtaggatataggtttgtgtagtagtatgtgatcattttgtgaatttcctaagattctggtgttatgtctcttcatttctgattttgttaaaaaggaaactgtctctgttccctctagttagcttgactaagggtatatctatcttgtttatctttttcaaagagccaacttttagtcgtgttgattctttgtgtcctgctatttgttcctaattgcttgatttcaggttttagtttatttccttctttctacttctctttggtgtgtttgcacctttttgttctagaactttcagaagtcctgttaagttgctagagtaggacctatccagtttctttatgaaggtactcactgctaggaattttcttcttagcaatgctttcattgtatcccatacgtttggatatgctgttccttcattttcatt

SEQ ID NO: 1310 - DNA, 1000 bp, mus musculus
ttaattgaatattttatttatttacatttcaaatgttagagcctttccagacttccctccctcaagaaacccccatcccacccccccccccgcttctatatgggtgtgcccccaccctcccacacactcctgcctccccaacttcgaattctcctgccctggggcattgagccttcatggaatcaagggcctcttctcccattgatgcccaagaaggtcattctctgctacatatactgctgtacctatgtgtactcctggtttgtgatttagaccctgagagagctctggttggttgatattgttgtttttcctatagggttgcaaaccccttcagcctcttcagtcctttctctaactccttcactggggactgcatgatcagttcaatggctggctgcaagcatctgcctctgtatatatcaggctctggcagagtctctcaggagacagctataacaggctcctgtcagcatgaatttcttgtcatccacaattgtgtctgcatttagtgactgtatatgggatggatccccaggtcgtgcagtcactgaatggccttttcttcactctctgctgcacactttgtctccatatctgctgatatggaccacttctaaatacttctgcatcatcacagataaatatgtgattccaaattcaatgttaatccaatgcattaattaatggtattaatccaatacattaatagctgaaaaagacatttgaataacaaaaacaagaataacatatgatcctttgtactgaatttttgttctatttctaccaggtgttatttgaaattataaataaagaaactaaacagatttaaatggtatgaattagtcagaaatttacatgacagaagaagcacttaaaaataacctagaagacaaaaacattggatacaaatatacctgaagttaggcagaaaggcacaacttatttaatttttgatgaagtctaagtcatgcagacattgctgatcttgaatttcacc

SEQ ID NO: 1311 - DNA, 1200 bp, mus musculus
gagatgttgggagccgcccccacattcgccgttacaagatggcgctgacatcctgtgttctaagtggtaaacaaataatctgcgcatgtgccaagggtatcttatgactacttgtgctctgccttccccgtgacgtcaactcggccgatgggctgcagccaatcaaggagtgacacgtccgaggcgaaggagaatgctccttaagagggacggggttttcgtttctctctctctcttgctttttcgctctcttgcttttctctctctcttgcttttctctctctcttgcttcttgctctcttttcctgaagatgtaagaataaagctttgccgcagaagattctggtctgtggtgttcttcctggccggtcgtgagaacgcgtcgaataacaggggataacatttgaaatgtaaacaaatacaataaccagttaaaaattaattaagcttattggcttaaattggctttattgacttaaaaagcaggaaaaaaaggaagcttattggcacaccctctgaacatctaggtaccacatgaacatgttgaaatctgttttgagcctatttgactgtggtcacatctctcttcctattgtcttggtctgagatgttctggatgcctcatctacatgtggaagggcctgaggtattttcctttcctaactgatggccactaatctctctggggctgggggtcagtggctatgtgacaggggcctggtgtcagggcttcaagtttttagctcgaccttaacaggcttccacatgcaggcttccaccgcctgaatggccccactcctaccttttcaattctgagattctcagggtctaagctaattcaaacttatccgttctgtctagagtcaaggtccacttgccaaacagaacttgtgagaaaggtggattggaggtagggagcagatattgggatgtaaaagtgaatgaatgaatgaatgaatcaatcaatcaatcaatcagtcaatcaatgggagtaaaataaaatatctcttgccctttagccctgtgttcacaattctcactatgaacaattcaccaggatcgttcaggacaatcctttattcctattaattaccagattcagggctgttgaccagtgactcacttcggtgagacatatttaacccactcactgctcatttgctacatacttttcaaactttgtggaagttacgaaaatga

SEQ ID NO: 1312 - DNA, 1000 bp, mus musculus
tttgcaagtccaatgggcctctctttccagtgatggccaactaggccatcttttgatacatatgcagctagagtcaagagctccagggtactggttagttcatattgttgttccacctatagggttacagatacctttagctccttgggcactttctctagctcctctattgggggtcctgtgatccatccaatagctgactgtgagcatccacttatgtgtttgctaggccccggcgtgttctcacaagagacagctatatcagggtcctttcagcaaaatcttgctagtgtatgcaatgctgtcagcgtttggaggctgattatgagatggatccttggatatggcagtctctagatggtccatccttttgtcacagctccaaactttttctctgtaattctttccatgtgtgttttgtttccaattctaagaaaggggaaaagtgtccacactttggtcttcattcttcttgagtttcatgtgttttgcaaattgtaacttatatcttgggtattctaagtttaaaacaatcatccatcctgaccaattaggttttattccagggatgcagggatggtttaatatacggaaatccatcaacgtaatccattatataaacaaactcaaagacaaaaatcacatgatcatctcctcagatgcagagaaagcatttgacaaaatctaacacccattcatgaaaaaagtcttggaaagagcaggaattcaaggctcatacctaaacatgataaaaagcaatctacagcaaaccagtagccaacatcaaagtaattggtgagaagctggaagcaatcccactaaaatcagggactaaataaggctgtccactttctccctacctagtcaacattgtacttgaagtcctagccagagcaattggacaagaaaaggagatcaagtggatacaaattggaaaagaagaagtcaaaatatcactttttgcagatgatatgatattatatataagtgaccctaaaaa

SEQ ID NO: 1313 - DNA, 1200 bp, mus musculus
aagaagaagaagaagaagaagaagaaggaaagaaaggaaatcacacagacatatattgtgcttcattttagtcggcaaatcttcaatttctgttgagttatgtaagagaaagcattgtacttgtgttcaaagggcaagcttgaggaaaagcttaggacactgcctgcattctaagtggccccagtgatggagggaatgggccctgttccaaattgattagttctgccaccttctcattattgttctgcctgaagtttggcacgcaagcaaggtcattccatgcaccggtctgcgtgacttcaaggattctgctagagactttcttcccatccacctcctctccccccaaccccaccacagcatgccacctgcactagagaaaattaaaaagcagcccatacattttacatgagctcccaggaccagtgagaaattaatattatgttgtcttttgataaagatacagctgttttataagatgctcatccaattcagtgatagaaaaccttgtttaaattcctccgtggagcctgaacttcacgactggaagaggaaatgcatacagatacagcagaatatgtttgagtaagttttcaactttcagttcaccttacaacaagatttcagggttacatatttgattgccaccctccccaaactctttggtaccttattagctctgggtttccatattttctttatagttgctgccttagtgttttctgttttatatcctcacgctcagatatttatgattctcaaggttgacttcaacatgtcagtttccaggaacctatctgattctctcaaaattaggtgtttttttttccatttttattaaatattttcttcatttacatttcaaatgctatcctgaaagtcccctataccctccctccccaacctacccactcctgtttcctggctctggcattcccctgtactggggcatatgatattcgcaagaccaagggcctctcctcccattgatggctgactaggccatcctctgctacatatgcaactagagacacagttctgtggggtactggttaattcatattgttgatcctcctatagggttgccgacccctttagctccttgggtacgttttctagctccttctttaggggtcttgtgtttcatccaatagatgaatgttcttgactattgacttttctggtcaggagatgagaata

SEQ ID NO: 1314 - DNA, 1000 bp, mus musculus
tacttacacataaatttcttactcaatgatatcagatcatcaggtgatagacacacagggctgtttcaaacagaactcagcatagcattttctatgaattgtagattgtagaaccaagcattttcttccccccacttaagtctgaagtagtaagctttgtctaagccaatcatttcaactctctatgccccaaccataaagtggagactggtgagattgttcccagtgatcacctctggttcagacactgcaatcccatcctgagtgctgttgtgcagtgatacaatatggaaattgccaatgcgagcaagtgaaacctccacatgaaccgtgcagatagctggctattacacaatgggaaatgtcgagaaaataaccttatggagtggaaagtattgaattgtctgattatgacttactctccaatataaagatatagccatgcttggctgctcaagggtgaaaatgtggtaatgtgttaaaatgctaatgaaattgaaatcctataatagatgtttagaacagtttgggttaccaagacatgggaagttagagagcatagctcataaatcctgttgataaggccaaactcttcagaacatttaaggccctttataggttgatcctaacttcttttttttttttcaagctcatctctttttaccctgtgttcaatccataatgagccatttgacattctccatgcacagcaggttctccggtgtcacatacacagaaagtcattttatttccagcctcttatttcacactgctccatcccattgccatcgtctattctagatcaacatcactcacccacagagctccttataccctttcttgcctggtcatccagtctctggtattttctgattctaatccaatgtcctcatcatcaccaaagtatatttcttaatcatgtatccaatcaatcaggtctgtctggcttaagttcatttgataattattctattgcctctaaatataaaaaccaaaattt

SEQ ID NO: 1315 - DNA, 1000 bp, mus musculus
gttgggaggcttgaatttcactgagaattggaaatagattagacatgggatgggtggaaggatgtgggttaaaatgagggtcctgcttctgcttggggttcaagccactgggcgaggcgggccaccagaaagtttgactgtgcccacccccacgttactgtctgggtgggtgtcaggctgtgagaagccgcaggaccccattctgggggtggggagccacagtctgaggtcctcgtggaactgctggagtgggactcagggtctctgggcctgcaaagaggccagggatggcaggttttagctcttgggcaccgcacactttgctggatgtcgtggaatccacggaacggagcagggccaaagtccaaagggaacagggcagggagttgtgtgctccagttcggtccctcaaggaggagagtccttgtcctgctggacagctagcttggtttgttggaagctgtttctggtagcacaggaaggcctcctaactggaggttagatgcaccgctcattgagggaaagcctgctccttgctccagcaatgaggatcctgatgagaagaggcagttcatggttttaaggaatttactgaagaaaggcagagagagggagaagagtagaaaagtagaggccggccatggccatgtggagaaaagggagaagggaagacagccaaacattcagtggattttcaggaatcctgtggaagagttggaggaaaaaatggaaggagcaagaggggtcaagggcatagaaagaataactacagaacgaactaacttgggctcaccaaggttctagcaactgaactgccaatcagagagcatgcttgggatggaccttggccctctggcatatgtaacagttgtgtagttggatcttcatgtgggactcccaaagcaggagcagggactgtatctgattctgttggaaacatttcccctaactgggttgccatgtcttgcttcaagaggagaagatgtgtcttactgcaact

SEQ ID NO: 1316 - DNA, 1200 bp, mus musculus
ctgcatggccatcatataacaccttgtcacaagccccaaattgaaaaaaaaatcaatcatgagccttttggctttataagttgacaatctcaggtactgattatgtagccacagaatcctggttgacatagtcaatgactagtgaaaagttacctagcaactaacaagtacttggaagagcttgtttgaaataaatgagatggatgaagatgttaagtgggcaggggtggggtggtgggatgtgcacagacagcctgatctccagttgagcaaaggtctggaaccctggtgacgtgaagggtgatgatttccacctacatgggacagaaggtattcgatcatgtctcctgggcccctggctcctgtggaagttaccacccccacagccccccaacaggagaggtgtgtggctatcagtcatgcttgagcagcaccaagccttcccacatgcaaataaggtttcccccaaactctcagtccaagccaaggagaggtacctgctgtcgaaccctgaatcaccccccaaaatatatataaatcctatccaaggaattaaaggtgtgggagaactactccatcgtatgagccttttgttctaagagctgtaaaacttgggaagagatctgctctcccaaagcactggctgaggctccactgcactacttactgactagtcagcctctcattgacccagcccaaccagacttagttcagagcagctcgaagttactgagtgatctggaagtcatggccgagatggaggctccctgtccccacacgcttcctttcgcctgaaccctggcaccaggcctggccagagatctccgtggaaagcctctggtactgaggcccacaggcaggcacaattatttgtccatattgcacaacagacaagatgagaggaagacagttgcagaaagaagctcagaaaaggaacaaaatctgccttctgaaaggaaagcatctctattgagaaaatgccttcataagatgcactgtagataccacctatgggatattatcctagttggtggttgatgtgggatgagacaactcattgtagatgatggacctcctgggtaggtagccttaggagccataagaaagcccaacgaacaagctatgggagaaagccagcaagcggcactattatatgacctctgtatcagcacctgcttcccagctcctgttcagcttgtg

SEQ ID NO: 1317 - DNA, 1200 bp, mus musculus
actgataagtggatattacccaaaaagttcaaaatacccacaatacaactcacaaaccatattaaacttaaccagaaggaaagcccgagtatgaaaacttcaaccccacttagaagagataacaaaataatcatgggaggcagagggagggagggaactggatgggagagggaaggtatagagggaaagggggacaggatcaggtatgggggagacaggagagaagtccacagagccaatagaatgaatagaagtatacaacagtgtggggtggggattggggaaacctctagaaagtcccagacatcagggatgtgagaggcttctaggacccatggggatgaccttagccaaaatgaccaactgtgtagagatgtaacataaaaagactaccttcaataggtagacatggcccccatttgaggcatggggccacctgaccatcttcaaaattgttaacccagaatgttcctgtctaaaagaaatgcagggacaaaaatgaagcaaagactcaagaacagtctatccagagactggaccaacttggaattcttcccatgcacaggcagcaaactctgacactattactgatgccatgttgttcttgcagacaggagactagagtggttgtcctctgagatgctctactagcagtagactgagacaattgcagatacctacagaaaaccattgaattaaggtcagggactcctatggaagaggagttaaaagaaggactgaaggagctgaaggggattgcaatcccataggaagaacaacagcatcaactaacccagatccctcagagctcccagagttaagtcactaaccaaagagcatgaagacatgggctggtccatgtcttcaggcacatatgtaacagaggactgccttgtctggcctcagtgtgaaaaaatgcatttagtcctgtagaaacttgatgccagagcaaaaggggatgatagctgagtgtggttggagtgggtgggtggaagggggaagtaaaggggtggaggaattgagtgaagaacttgtaaaggggtgaccaagaagagggtaacatttggaacataaataaataaaataataaaaaataaagaaagtaaagacctgtaatagcttatcttttaaagactgccaataagtaataactgtggccccttttaaaaattacataataaatttctgacaaatcttaat

SEQ ID NO: 1318 - DNA, 1600 bp, mus musculus
ctcctgtgatatgggcctgtttaaatagtttacctgctcttgatttaactttggtatgtggcatctgtctagaaaaccatccatttcatttagatttttccaattttattgagtataggctttaatagtaagatatgattaattttttttgaatttcctctgtttctgttgttatgtcttacttttcacttctgattttgttaatttggatactgcatctaggccctttagttagtttgggtagaggtttatctagcttattgattctctcaaagaaccagcttttggtattactgattctttgtattctctttgattctatttggttgattttggcccaaaatttgactatttcatgtcttctactcctcttgggtgagtttgcttcttttttttcttgatctctcaggtgtgctgttaagttgctagtgtaagatctcttcagtttctttaccagggcacttagtgctatgaattttccttttagcactgctttcactgtatcccataagtttgggtatgctgtgtcaacattttcattaaattccaggaagactttattttgttcctgaccatgatatcattgagtaaagagttgttcagtttccacgtgtatatgggctttctgttgtttctgctgttattgaagaccagacttaggccatggtatgtcgactctctgtcatcaggtccaggcaagaagagagaacctggtccagccgagtgtctctgaagctgagcgaatggtgagtgtcatggcccaaaacaaacacacccaggcctggagtctgtcaaagcaggaactccactttatggcatcagctcctcgtttatgtaagttcagaacacagggaggggaatttttggtgcagtaagatgatttaggaggcatgggagggtgacagatggtatggagtgactgacagggtcaatggcaaagctctagatcagcagcaacatcagaggcagggtcaaacaggtcttgctgaatcacccagatacggacatgactaagacaaaactggagccaggatcaggtttgttctcaaggcccaaactaaggccaaaatagggcaaaataatggtgatctgatagggtgcatggtattatttcaatttacttgtattacttgagggttgttttgtgaccagttatatggttgattttggagaaggtaccatgaggtgctgaggtgtattatttagttttagggtaaaacgttctatagatatctgttaaatccatttagttcataacctctcttagttttgctgtgtctctgtttagcttctgttcctatgaccattcgattggtgagagtggggtgttgaaatctcccactattactctgtggggttcaatgtgtgttttgacctttagtaaaatttcttttatgaatatgggtgctcttacctttcaggcatagatattgagaattgtgactttctcttgatggattttccccttgatgtatatgaagtatcctttctcatcatgcttgatcatttttagttgaaaatctcctttattgggtattagaatggcaactccagcttgtttccttggaccacttgcttgaaagacatttttctatccttt

SEQ ID NO: 1319 - DNA, 1400 bp, mus musculus
gtttattactgaacatacaattatttctaagttgaaagtcaaaacaaaactacatcaggtctaaatactctctgttattgcatttgtaattttttattagatattttctttatttatatttcaaatgttatccctttcctaatttcctctccaaaaatctcctatcccctcctccctcccctgatcccaacccactcactcccacttcctggccctggcatttccccctatactggggcatagaaccttcaccaaaacaagagcctctcctcccactgttgaccaactaggccatcctctgccacatatgcagctagagacccaagtcccaccatgtgttttctttgattggtggtttagtcccaggaagctctgaggggtattggttagttcatattgttgttcctcctatagtgctgcaaaccccttcatctccttgggtactttctctagatacttcattggggaccctgtgctccatccaatagatgactgtgagcatccagagactgccccacctagggatccatcccataaacaagcaccaaacccagacatcattgcagatgccaacaagagcttgctgacaggaccctgatatatctgtctcctgagaggctctgccagtgcctggcaaatacaaaagtgtttttaatttttaacatggaaaatattgttcttttaatctctaactctctttcctttggagacttcattttactatttgcaaactaaattatttctttctacatttatttataacctgtttctttttcttttactgttttcaagttttacattaccactatagaagtttgacatttttctgtcccactgtgcctccaggaaaattttcttcctgtccttctatgtgtctgcaggctcctcaaactagcttgcttctatgatggtcagcttggcccgtttgctggctccaactagctgcctgtccttgacagtactgttgaggcactgttgggtcttccatgagaggtgagcctcataccctcagcaaccagcagtgtgctgtgcctacctgccccatctctggaacgttgcttgcctgtgggacctgcactgaggctctgtgtcatcctacctgctacccatagtcctttgtttgctccttttaagagggatttagactacttccaaactgtaaaactttgtctgtctctggaaagtgcttgttctctgcctttccacacagcactttttctcgagctctaagcttggattttactagtccttttattggatgccatttgtaactgcttaggcctgttctatgcctgacccactcccagataatgacatggagactatatctattaataaatgctattggccttatagctatgcattgtttcccactagctataactcaattatttcattta

SEQ ID NO: 1320 - DNA, 1000 bp, mus musculus
tctctgtgtagtcctggctgtcctggaactcactttgtagaccaggctgcccttgaactcagaaatccgcctgcctctgcctcctgagtgctgggattaaaggcgtgtggcaccacaaccggctgcctgaatgtttcttagttctgttgcttacaatatttctttttttttctttttttttccattttttattaggtatttagctcatttacatttccaatgctataccaaaagtcccccatacccgcccacccccactcccctaaccacccactccccctttttggccctggcgttcccctgtactggggcatacaaagtttgcgtgtctaatgggcctctctttccagtgatggtcgactaggccatcttttgatacatatgcagctagagtcaagagctccagcgtactggttagttcataatgttgttccacctatagggttgcagatccctttagctccttgggttctttctctagctcctccattgggagcactgtgatccatccattagctgactgtgagcatccacttctgtgtctgctaggccccggcatagtctcacaagagatagctacatctgggtcctttcgataaaatcttgctagggtatgcaatggtgtcagcgtttggatgctgattatggggtggatccctggatatggcagtctctacatggtccatcctttcatctcagctccaaactttgtctctgtaactccttccatgggtgttttgttcccaattctaaagagggcatagtgtccacacttcagtcttcattcttcttgagtttcatgtgtttagcaaattgtaccttatatcttgggaatcctaggtttggggctaatatccacttatcagtgagtacatattgtgtgagttcctttgtgaatgtgttacctcactgaggatgatgccctcaaggtccatccatttggctaggaatttcataaattcattctttttaatagctgagtagtactccattgtgtaga

SEQ ID NO: 1321 - DNA, 1200 bp, mus musculus
gatgaaaccaatacagaagatctagacaaatccacagaattcttgcccaagtaatcaaaccaaagaaattgcagtaaattaatagaatcagaattgaaccaggaaacattacaacacaaaagaaattcaactgaagggatttgcaaccacataggaagaacaacaatatcaaccaaccagacaccctcaggctccgaggaactaccagccaaagagtacacatagacgaagccatggctccagctatatatgtaacagagggtggccttgttgggcatcaatgggaggagaggcccttggtcctgtgaaggcttgatgccccattgtaggagaatgccagggtgggggagtgagtgggtaggagagtacactcatagaagcagggggagaatggataggattgggggtttgtgaaggggaaaccaggaaaggggataacatttgaaatgtaaataaataaagtatccaataaaaaataaaaatataaaagaaattgagaaccatggtatatactgtgacctgatgccatgtttgtgcagctttctaaggccatgttaatgtctgtgttccaactgttacaactgagagccaagttggtgcccctggtccttaatcctgccagaggatgtgttaatgtctgtggtccatgctgttgctactaaggaccatgttgatatttgtgatcagggctctgcaggagaccatgttgaggctcaagttccatgatgccacaggagaacatttggaaacctgtggtctatgcgactgttagctgttatggacaaggaagtttcttttgcattgatattgatgactatagcctcataattgaaaatgagagaaattgaagccagtgggacaatagtccctcgaaaacaaattaggtaaaaggccatggaagaaagtccattatgatacatatgctgaaatgtaagtcttcacagtagatggcttctaggagcaaatggaggtggactcaattttctttaagggactggccactggtagattaactatgttccagtgagtaaatgtatggacaacacaaactggacttgctgcattttcttacctattgatttgtattgggagagcacaaggacaggaggctacatctgggtgtaataggaagcaagtgtgatctgggtacattgtaggaaactgtcaaataatcaaaaaaatatgatttggtttaaaagc

SEQ ID NO: 1322 - DNA, 1000 bp, mus musculus
tctgatgtatgtttgagtaccaaactagatctgaatccctttagcgaaagaattaggaaaaagttgggtggttttttgttgttgttgttggtgttgttgtcttaaacctgtttacctaatggtcagtgccaggccctgaggatatatttagtatgttattgtaaaacccaatgatcaccctttccagagagttttgactttccctcccaccaatattggaacttgacagacagagaaggaaggtaatctgtctcagagaaggcaattctgtttcctccatactctcaagctcaaaagatgcagagagtttccccagtactgcagagggcaacccccagaccaacctcactgtacctgctgctgcctggccctattcccacagccccttaaaacaggctggttccccagtaccagtcttgtggggggttttgtttgtttgttttgttttgttttttaaaagatttatttattattacatgtaagtacattgtagttgtcttcagacactccagaagagggcatcagatctcatctcattacgggtggttgtgagccaccatgtggttgctgggatttgaactcaggacttttgggagagcagccagtgctctttaaccactgagccatctctccaggccccccactcttgtttttagttattggcttttctgcttttttcatggtatctaactttagaggaaccaagaagaaaacttcctaaagaaacatttacttatgcattcaaagctcccagatgtcaaggcccattaattctgataccataaagattgccttctctcataaacagacctcatgctaatgctgaaatacgttttaaaataataatctccatatcaggattttctgttcttttctcagccctgtgtatactcttgacatatggctgaaggagaagtgcaaaccaacaaaccacttggccttgaggaattctccaaataagtactaatgctgttgttacatagaagatgatttgtgtttg

SEQ ID NO: 1323 - DNA, 1000 bp, mus musculus; identical to SEQ ID NO: 1322

SEQ ID NO: 1324 - DNA, 1000 bp, mus musculus
cagaagaggacagggattaaaggggaagaccaaaaatggcaaataacctggatcttttggggctcccagagactgagcccccaaccagagagcatgcatgtgttgttcctaggccccctgcacatatgcagcaaatgtgcagcttggacctcatacaggtcccacaacaactggagtagaggctgaaactgaatcctgttgcctgcctgtctgtgaattcccttcccctaactgggctgtcttgtttggtctcagtttgaaaagatgaaaatcttggattggcttgatgtgatggggtttgaagacactgggggggggtagtgtgtggtgtgatacccaaaatggagatactccttcttaaaggaggatagagaggaatagaggatggatctgcatgaggagattactggtagaatgggtgtgtgtgtgtgctgatttggggatgtaaaaaagaagacagatacaaaaggatgttagatcatccagttttcagtgcttagaatgacagctgaatacagatgaagttaagttttacttctagcaaattgaatgctttaaagcctcagttttcatttcctttgaatacattcactatttcttagagtatgcaacttaatagtgaacatattttttactcatgaactttttactgaacttagactacatagtacagaatactccaaataagattatacatatgagaaatagaattccaagaaatgtggagcacacatctctgcttataaaaagaaacatttcttttacatgttagagattataatatacttactccacttttcctcctttttctccccataaaattcttccaaatcttccttttttttttacttttttcattcatagtacctttcatcattatttgtttttgcgtgcgcatgcgtgtgcgcgcgcgcatgcacacacacacacacacacacacacacacacacacacacacacacacacacattatattcagagctaatatttgatattgatt

SEQ ID NO: 1325 - DNA, 1200 bp, mus musculus
taattcctgacctcttttctaggttttccatttccagagttgcctccatgtgtgtgtgtgtgtgtgtgtgtgtgtgtgtgtaattgcttctacttccacttttaggtcttggactgcattattcatttccttcacctgtttggttgtgctttttatattattttcagggatttatttgtttcccctttaagggcttctacctgtttacttgtgttttcctgtatttctttcattgagttatttatattcttcttaaagggttctattatcttcatgagataggattttaggtcagcttcctgattttcatgtgtgttgtattcagggcttgctgtggttagagaactgggttctgatgatggccatgtatactggcttatgttgcttatggtcttgtgcttgcctcttgcatctggttattcctggtgtttgctggtctgggtgactatgtctggagtctgcctgatttgtccctgggttgcttcaggtctcccagtaggcctgtggccctggctgtagcaggacacctgtggggtcttctaacttggggcttttcagagtggcagagaatctgttcctttattgccttggctgcagtagatcttctgggaggtcttcagagtgttgagtctccagaggagtagtgaagctattgtcctgtgtgaagatgttctccagaggctctaacagacatggtttctctttccttgcatgcagcagaactccagggatgcttccagtctgttggttcattttccctttatgccacagaacccctaggaaatcttcagactgtggtgtctcttgcctagttccctgtgtacagaggagctactgggatgccttcaagctgtggtgtcttccagggagcagacaagttggtgatcagttgcttggttgccctgtgtgcagaagatctcctgggatacctcaagctgggttgccagatgcccaactgctctgagtgcaatgaattctgtgggatggctcaggatatggtgtcttcaggggagcaaaccagctagcagtctgccccagcagaaaggactgggcagaagcaagtcaaggttttaatcaacacctatctctgaatcaggatctgatataactttgttcacagctaagaccaatgtttctaaaaaatccgtgagacttctacagagccttgtataatttctgtaaatgaattggcccatttct

SEQ ID NO: 1326 - DNA, 1800 bp, mus musculus
aagaagggaaaaaaagacattttgtagatggaattaagtttgatgaccttgtttgaaataaggtcattattactaattatcaagatggatctatctaatcattaagcttcttaaagtagagtgtattccctctgctattatcagaaagaaatgtgatgaaggacaagtcaaagagatgtgatatgatattgctgggtttcaagatgaaggagaggggcattatcaaaagcatgtgggaaatttttagaatgtggaaatggcaaagggattctattctagcctcactagtgtgggatatacccttgccaacactgcaaatttaatccatggatatttgtttcaattacgacctatgaaactgagaggcaggtaattaattttgttaaaattcctggtgtttatagaaatttgtagaaaactaacttatgtaatgaactacccaataggacctgtgatcttataaaaaagctggaagctattgaccaacaatattctgtctttgactttctaaagccctgccagtgtcttccatgaactaaacacattatatgagagcttaaggaaaggctagacagcgcaatgtaattttcagatattaattttgaaagtttagaatccagaagaaatgaatggagaatggatttaaggtggtaaatagaaatgttctacctctgtcaggtctgagccagtgccctgagcagactttgagtgctagctcctcacccagtcctacaacatccagaaaaagctcaactcccaggttctctagtatacctaagatcacaggtaaggagcccacaacatctcccccaacactggaagaaactggaccagtgggagccaggaacacaggaaccccagcccaaccagtgtcacaggttccttctggtttgagcctgtaccctgagcagatgttgagtgctagctttacacccaatcccacaacaactagaagaaacttgactctcaggtgctctaacacagctaggatcgtaggatctcaggagcttggtcacaccaggatttcaggataccagaggcaacttgacacccaggagttctgacacatgcagaatctcaggatcacaggatcacagagacaactggaatgtgaggagttctggtacaaccaggatcacagaggggacatgtttcaatcagagaaagggagggcagacagcactagagaaaaccagatggcaagaggcaagacataagcaacagaaagcaaagttacttaatatcatcagaacccagttatcccaatcatagcaagtcatggatatcccatcacagtgaaaaagcaagagtcagatttaaaatcaaacctcgtgatgatgaagaaggactttaggaaggacataaataactgacttaaagaaatgcaggaaaaaataaacaaacagatgaaagaattgaacaaaactattcagaatctaaaatttgaaatagaaataataaagaaatcataaaaggagacaaccctagacatagataacctaggaaagagatcaggagtcatagatgctagcattaccaacagaataaaagagatagaagagagaatcacaggtgcagaagataccatagaaaacattgacacatcagtcaaagaagaaaatgcaaaatgcaaaaagttcctaacccaaaatatccaggaaatccaggatacaatgacaagatcaaacataaggataacaggtgtagaagagagtgaagattttcaacttaaaaggccagtaaatatcttcaacaaaattataaaagaaaagttccctaacctaaagaaagagatgccca

SEQ ID NO: 1327 - DNA, 1200 bp, mus musculus
ctcttaagtgactgctatttcattttggacaaagtttagctttcttccatggttgacgaacattgaaaaaaaatctcagccctatacaattttgaatttctcaaaaatcagcatacagcttatcttttagaacatggtgctgcagcttttaccattttgaatttctctttgacttacaaaatgatttactagaccaccaaccaaggagtgtacaagaaggcacccatgactccagagacatatgtagcaaagaatggctttgtctggcatcaatgaaacgggaggcccttagtcctatggatgtttgatgcaccagcatagggggatgctgagtggtggggcaggagtgggtaggtgggtgaaataggaagtaccctcatagattcgaaggggaggaagaggtcgaatagaatagtagggttgtagaggggtgactgggaagggggatatcatttaaaatgtaataaaatgtaatgattaataaaaaataataaaacagaaagtttatgtaacacacacatacatgcaagcacacatccaatgttgcaccacccaccagaagactattgtctcatgcctgcattcctgtcccactttgggataccccttcagttagagacccaaagtatcactgataagtacatccatctgagttgcttgccattgtccctaattagccctttttcttaattaaatacataagactcaagtcacaaactcaatccatccctagaatcccaggaaactgctccgttccaggaagtgacattagactgacaatacgaattcaacccacccatgtagccttcctaagaaccacaagtcaatgccttcccccttttattgttcctcttctcataggaggccaagactcacatcagcaattccacaaatacttattgtctaaggaaagctcctcattgtgtcttcaagattcccgaagaatggttctgagaatcttttatagaaagtctacttccagctgagaaacctgagtcaaattgacccaagactattttctgatatcctattgtaactttgacactgtatttcaaacatggaaccccagcatccacatagctggtcaatcacatgacatgttagagtaaaaagaaagagaggtttgaacattttctcaacaatgtagagacagaattagaatatcaatatattactaatgacctagctccatgtactcag

SEQ ID NO: 1328 - DNA, 1200 bp, mus musculus
tcatggatcacaggatgaggtcagtcatgatcagggacgctcaggaattattaattgcctttgttctattccctatgttaccagctctcttgaggtaaatgtactgtaattttatagagtatgattctgttgcttcttcctttttcttcttctttttttttgaatagtgcagttcaccctcccagtccaccctccgactgttccgcatcccatacctctgccctactctcctgtctccacaaggatgtcccccacacaccagacctctaaactccctgggtcttcagtctcttgaggtttaggctcatcttctctgaacgagcacatacctggcagtcctctgctctgtatgtgttgggggcctcctatcagctggtgtatgcttcctggttgacgatccaatgtctgagagatctcaggggtccaggttaattgaaactgctggtcttcctacagggtcatcctcctcctcagcttcttccagtttttccttaattcaatgctgacaggggtcagcagcttctgtccattggttgagtgcaaatatctgcatttgactctttcagctgctttttgagtattttggatggcaatcatgataggtccctttttgtgagcactccatagcctcagtaatagtgtcaggccttgggtctgcccttgagctgggtcccactttgggcctgttgctggaccttctttccctcaggctcctctccatttccatccctgcagttctttcagatagacaaaaaaaaaaaaaaaaaaaaaaaaaaaaaaagggtcagagttgtgactgtgggatggccacctgcttccttacttaataccctgtctttctgctggaggtggactctacaagttccctctctccactgtctgtcatttcatctaaggtccttccccttgagttctgagagtctttgaccttccaggtctctggtacattctggagggttccccccaacctcctatctcctgaggttgcctgtttccattctttctgctggccctcagggcttcagtccttttcctccacccaataccagatcatgttcccctctcctaccctctcccctgtccactgtccctcctagttccatcagatctgttgcctttcaattaccatttctttgaataaagtatagcttaagtatacagttactgcctctgatcactggtagttttggtgacaaatat

SEQ ID NO: 1329 - DNA, 1000 bp, mus musculus
ggagagatgggggtaaagaagcaataccttagggaataatctacatagagattcccacaatgaaggggactcctgacttttataacattttatagcagtggttctcaaactgtgggttgtgactgctttggggaggggatcacatatcgaatatcctgaatatcagatatccccattacaattcataacagtaccaaaattacatttataaagtaggattcaaataatttcatgttgggggtttactacaacatgaggaactcattttcaagagccttggtactaggaaggttaataagaactgttttcgagacataatttatttcatttatttacttcaatataacacacaagaagaaccattcaacgtgttgtgtactggctaagaccataaggtaggagcaataaaaaccaaagcacaaaacaattccctaactttgcataccaggtctagcatttcaggtagggatggctatttttttccaggctgtggaatgtagatccttaagaatgacagcttgagccttccggtccactccagcaccagggtaccttgcctacggagtctccgatcacatgcaaggacccacacaggatcccccacaggatcctaagacctctggtgagttgaacagaacctctgccaggaggcaggttcaaatatcagatatctgggcaccttccctgcaagaagagagcttgcctgcagagaatactctgaccactgaagctaaggagagagctagtcttccaggtctgctgatagaggctaacagagtcaccggaggaagaagctctaaccagagacaactataacaactagcttcagagattaccagatggcgaaaggcaaacgtaagaatcctactaacagaaatcaggaccactcaccattatcagaacgcagcactcccaccccacctagccctgggcaacccaacacacgtgaaaagcaagacccggatttaaaagcatatctcatgaggatggtagaggacat

SEQ ID NO: 1330 - DNA, 1000 bp, mus musculus
agtgattgtaatacagaaccaaagaactgcaaacacattgatccttgaatcactggtgaatttcccagacttctatcacatggtaggccttgtaaggacacacatagtacactttccaaattcaaacaacttcctggaaatcacccactgtggaggggaagctgagacacctccccaatacacaaactgcctctctcctcatatactattttcaaactccaccctgaatttcctctccttctctgtctagcacattccatagccacaatcaggagtttcttcttgttgttgttgttagctcccttaggacctacttcaagctctccttcaggtctctactttccccttttgcccccccccctcaaaattcttcccagctatcatcctcaccaggaagaaaaacatgaccaactgatgagaaggatcacaccacaatgaactcctgaagaggaggacagggctctatgttctaatagttcttagaacagtactctagtctaagagtacattcttctagtcctcagcacattagtgtgggcgagctgtcaagtggatacccactccaatctcctgtgaagagtagtgtgttcctgcacgtgctcaactggccaggaagaatgacactgcaacaggatccttctgcacacgtttattgggagagcattgattgcataggtgaaagaagaaccccgaacaaggaaaatgatgctgcttatatacccctccatgtgacgtgtcagctcctgattagctgctcactcatcaccccactactacaccccgggatgggcagtgacttggcacgaatttactcttgcacctgcgcacattacttgtttaccagttaggcacagcggaggctcgtgatggcaattgctcacggctctccatatctcccccatttattttacacatgagaaaacacaggagatatttgacttactctgactgagttatttggcttaacatgacagtcactggttctacccatttgcctaca

SEQ ID NO: 1331 - DNA, 1400 bp, mus musculus
aaggaatttttcggcaaatggatggaactagaaaatatcattctgagtgaggtaacccagacacaaaacacacgtggtatatacttactaataagcggatactaacccaaaaactcacaatgcctatgatacaacgtacagaccatgtggagcatagaaggaaggaagatcagggggtggttgcttcagacctgcattgatgagggaacaggacgattgtgggagatggaaggagagtggaacaaggagggaggaggtggaaataagggtggcagtatctgagtctggaggagacatgagagaggtacagagaaaggatcaaggaatcaaataaaaataggtagcaggggggacgaggaactgggcatagccactggagggtcccagacaccagagaagcctgatgctctgaggacgaaatggaattgactttagctgcaatgcacagagaaaagggagatagaactgccagtagacaggcacaacccctggtagagggatagagtcactcacccatctcaaagtttttttgtaatacaaaaatgttcctgtctaaaggaagaacagggataacaaaatggaacagagactgaaggaagtgtcaaccaaggaatggctccacctggggatacatcacatctgcagacgacaaacccaacagtgttgctatggtcaagaggcacttgccgacaagaacccagtgtagcagttcctgggaaggatcggccagcaactgaccaaagcagaggcagatgcttcgagccaatcattaggctgaactcaggtaatctcgtggaggagctggcagcgggactggaggaatcagagacctctttggaaaaacaacataggctggcatgaccacccagtactcccagagactaggccaccaaccaaggaatacacctggagggacccatggctccagatgaatatatagcagaggacagccttgcctgagagcaacaggaggggaggctcttggttctggggatttttgatgtaccagagtaggggcattctggagtggtggatgtgggagcactctcatacaggcaaaagggagggggcagcaggtgtgggatgtggggtggggtgggggtggaagtggggtaaccaggaaatgggataacatgggatgaggggtaggttgagggggtaacagggaagtaggatatcatttgacatttaaacgaatggaatgattaacaataataaaagaaaaatatgtgaaaaaaagggaaaaccaaccaaaaaatgaaagtaagcttccttttgaaagatgtaaaacacacaccaaaaagatgtagggtatattaaatacacatattacagtgtttttttttttttttttttttgtcaggatagaaagttgaaattggaacttgatgatgtgtgct

SEQ ID NO: 1332 - DNA, 1400 bp, mus musculus
cttataatggaattttcagttatgctgtatttcaaagccactttaaaaaaatttattctataatgtcaaaatccagaattatgcccacagaacatatggttttggcacagctttagcaaagtatcaaataaataaaaaaaaaaaacttttcataaaactgacatttataggtccctaccatatatttccttaatattctgtccaaacactgatacaaatgaaaaatgaaagtttctttgccaatgagaaaccaaagatacaccgtgctataacgaatctagaatatcaacagtttgagacaagctgcaaataaagatgacaagtgtgagaatctggagggatgtatataatgttaacatggagtttggatttttcttgtgtaatattcaaattcatgcacgcattgtcttttgaatcaggctcagctttttattagacatgttaacaaaagaggtttggttgaaaagacaaaagcgtgtgccatcatcagacatttgagtttcttccttctttgcttttcccttcttctacccagcgtgagcagcaatggtggaggggccaggactgcctactcgaacaactccagctcctggagcaggcctgacaggaccaaccttgcagataaggttcccaatgttcaagtttgccatgccctttgtgaagaatccagaccagaaaggttcagcattggcaccacaccaatcttagtggatgcgtcatctaaaccaaacactattgaatgataacagtactagttgtacagttagcaactaagttacagtaattatatagcccatgttactaaaccagatgtttcctcaagctaacaacaatttgtgtttctgtgctataaatctgagataccaggtaaagctataataatttttttattaaggtaacaaagggtattgtggtatgatctagcatccacactgtgtcatgtgtctcctaggatacttaccttgtagttcaatgtaagtgtataataggaggagcacatgacgtcagcatgtcatcatatgctgtatttatgcaccagaggaaataccagcttctcataagtatgattatttcatgaaaagcacaccccactgagatgtcttattgctgttataaaaaatctttattgcagggaattcttttgagctgtaggaaaatgaattccacactttagaaatgttgaacagcagcttcagtagactgctatggttctcacagattactctaccccattagaatattcatgatccaatcagaatgcttcctaagtctctgcaatttttccattgtaaaataaactaggtacgttttgatgaaacagcctatgctgagcaaatgccttcattaatttttttaaaagtattttatggattctgttactatcaaagaacattgctctg

SEQ ID NO: 1333 - DNA, 1200 bp, mus musculus
acattcagaactgaccctagagattattattattatttttagcaactaaataatcttttcttaggatatgtttcctggaatctaagggtctcctctcaagactcacctctgacagctcctattttttatcgactcactactctaagggccgagatttcaacaaatgaaggcttgtggcaaatcacatctaaaataacacatcttgatctcttggtcttgtaggagtagcttcttatcttttgaagtcttgtgcccttcttttaagtataaccatccaagcctaccatgttacctactggggtcattgctggtatattttcatggctttattttgtgttttttttttttttttttttttttgtcccaaataatatatgtatctttatagggctcaactgatctctaagaccacagttgagacttatgctcttccataggagtttagatgtggacaggaagctcactggtaattcaaatatttaaaacaagcattgccatttaacaatatgaaaataaagtgtggctctcctgttcttacacactgaaaatcggtagccatatcaggtaaatgaatggtttgggtctgtactggctggttttgtgtgtcaacttgacacaagctggagttatcacagagaaaggagcttcagttggggaaatgcctccatgatatccaactgtaaggcattttcttaattagtgatcaaaggaaagggccccttgtgggtgggaccatccctgggctggtagtcttgggttctataagagaacaggctgagtaagccaggggaagcaagccagtaaggaacatctctccatggcctctgcaccagcttctgcttcctgccctgcttgaattccagtcctgacttccttggtgatgaacagcagtcagtatggaagtgtaagctgaataaaccctttcttccccaacttgcttcttgatcatgatgttttatccaggtctagaaaccctgactaagacaaattggtaccagaggtggggtattactgtgacaacctgacaatgttttctggaggactgtggaagactttgtaactgtgggccagaagttccattaggtgttaagagctttgtgagacattgtgtaggagcttggaagataatgttgagaacagtgcagaaaatggaggcctggcttgtaaaatttcagagggaagattaaagatccttttcag

SEQ ID NO: 1334 - DNA, 1200 bp, mus musculus
tgaaaatcctacatgattcatgggtataagaaatccccaggataagaatagatctaatctataacacaagtcaaaaagtattcctgattatagaaagttaaggatcggcataaaagaagacttacatggaaaataaacaattacatcagaaagaaaaagttcagaaggtcaccagatatggttgagcacttgctatatcatgatggatgctccttttgctgtagctaatgcatcctcttggaatgcattgtgaggcactatcaggtaaagggcagcaaagctgctttctcggtgccattcattgttaagaagctttactgaagcctgagggccagcagaaagaatggaaacagtcaacctcaggaggtaaggagttggcgaaatcttccagaatgcaccagagaactgggaggtgagagactctcaagactcaaggggaagaaccatagatgaaaggccagacagtaggcagagggaaattatagatcccacctccagcaggaagacagagaatcaaatgagggaaggggggcgcatcccacagtcacaactctgacccataattgttcctgtctgcaagaattacagggatggaaataaagaagagcctgaggaaaagaagatccagcaacaggcccaaaatgggatccagctcaataggggtcccaaggcctgacactattactgaggctatggagtgcttacaaaaagagacctagcttcactgccctctgaaagacctaataagcagctgaaagagtcagatgcagatattttcacccatctaatggacagaaacagctgaccccagttgctgaaggcagaaagaagctcccaggagaagggcaaccttgtaggagaatcagcagtctcaattaatctggacctccaagatctgtctaacactggaacaccaaacagacagcatataccagctgatatgaggcccccaacacacatacagtagaggaatgccagatatgtgttcattcagggatgatgcacctaaccctcaagagactggaggccccagggagctagaggtcaggtggtgtgggagaaggtatgggatgtggagcaatcagaaggtggatgtggggggaataaaatatggagtgtaaaaaaaattaattaattaaaaaagaaagagcattaacttaacagtggtaagggatgagagtacccacaggcctccatgat

SEQ ID NO: 1335 - DNA, 1000 bp, mus musculus
tagcttttgtatccattgcacaaacttacaagtcatacacacagatatctgttttagtgtaaaacttcaatatttatgttttttgtatgatgcttctctaatgtgtaatcacttccctcttctgtttataccattaatttctataattatccttggcacaaagctcaattcttcaacaatatttccctcttagtctatgtgatttttccatttgtttaaacagtaataataatgtttccctagctcatttttatggatatagtgttttatttgagttttttgaaatcagaaatatacactctcagacattaccaaattcatggtgtgacatgaatatacctattctcaaaacatagctacagttgccaaccaagattgatcttctttgctctagctgcaaaattcaaaatacggccaaatacttggtgatcaaaaataaattttcatccacttaatattttctgagtggcagaaatattacaaatattaatgcttctgatcaggaaagaaaagaaaaatgaaaaaaagatcaaaaggaaagaaatcctggaacacaaagaactatgttcattgtttctaagccagactttagagtaggaagaggaactagtcctgggaaatgagactcccagactttcctttataaagcagtgtacaaagtaggtcagtactttccaaaagaaaagactgggagtacaggcattcagaaaagaatggaagaacatatcctttaaagctctgtaagctacggtctaatgcaagataaaggacaggagaggtgagagtgatgtcaagaggcacaaacaagggcaagcagaacccgtttgttggtgactgggctgcagtggagggtcacacctgcttgctgtgctttctctgaggaaaacagagaggagaatagaacaaaattctcagtaaaactctggctgtattttaagtttgttcatcttctgccggtgtctgatggcatttagagccaatgctttataaggtgggaaga

SEQ ID NO: 1336 - DNA, 1000 bp, mus musculus
gaaacatctgcatactagacaatctatgatttgtaactgtagaattattagtagctgcaaatatttattaatttgaattagtaattaatcgtttgtctactagaaacttcattaggcactgaacataagcaaatatgaacacataaacatgccaggtaccctccatataaacagactagacgtttctatgtgtgtgtgtatctatgtgtgtatgtatatgtatatgtattatatatatatatatatatatatatatatatatatatatatgtataatgcaggcatgtatatgtaaatataatgtacaaacacacacacacacatatatatgatcttttatatattaacaattcagtacacaatgaagatggaagacaattatatttacttacaaagaattgtacatttgcccatttagtagatggctgagtcatttttgtggcctgattgctcttaagcaaatgccttaaacacactgacattttaccaaaaacgtaagttgattattgtcatgctcctgcatatcttctaccaattctatatgaaggcaggaagtgggataattccaggcactatatttatgcttatcagaaatattgaatgacttgacagccattttcaaaactatttatgattcatgacaataatttatttggaatacttttgccatacagatattacttcatgaagtacacatattttaaaacctttcttagagaatttgtaaggagaagaaactaattccattggacaaattgctcagattttccagaggtgctatggaaaccgtttcccttgaaaggaagtacactgaggtaactgatcattttcttgtcttttttgtcagtccatgactttgtagagtatgaactcatggtacagttgtcaagtgagtgcaatggaatgactgtgctgtacgcaaggggctcctgtcctgacatgtgtctactctctgatactttcaaaactactcttgggtccttacagcatggaacttact

SEQ ID NO: 1337 - DNA, 1000 bp, mus musculus
taacctatcattcactgttggtgatgtatgacaaagaattattcttgtggttaacttagtagatgaatataatgtaaataattttacatatgctgatctgtgagtatgctttgaatgtgtactgaattcctgaatgatttgctgctctgactagtattgtgatatttgggacactctagctgtgattcctgatgaaaacgctactatatcagaactgtaagacacacttcagctcattatgattataattcactacttatctgcaagcatgagaacaataagaaggtaagacaaaaattgagagtgtggtattttcattatgttttgaggagagaattgagtcttttagggcctctagtaggagagcagaaggatggagatatgtgaggaaatgtggtggccagaagttcccattaagatcaattgcctaagtctgcagagagaaaagattagggccatggagacattttagatggttccagtgtgaactcatgaaagatggtgcatgccattctatgacttgctaactggtctgtgactttgaatgagtcactgaggctacctaaatagatttgcaatttgatagaggtagcccagggatttgttaagccataaccaattaaaaagcttagcagttaagcagatttttaggttgaaccaatggtcacatcagcaactttgtggtttatcataatgtaaggggaaaaatagttcattaattttatgttcatgttaaaacactagatttatgtaattaaacctaactaacagcagtccacaaagaatgtggagattgcatctttctatgaactgagtattcaagctccggatttatcattagtgcagagagggctctggtcctcacagtcctttgcacaatggtgtctctggctatgtctatgtttaatgtgcctttggctgactgctgcactgtttgcatttagtcaaggggaattttacctgaactatatacattggcaatgtctggagatatttcatg

SEQ ID NO: 1338 - DNA, 1400 bp, mus musculus
aaaaaagttaatttaacaaatattaatggtctctaaaattaacctgtttttctcatgaagttattctggctacagacttgtcctcaaaagtattatctactttttttttaatatgtaagctgtgaatctgaagataaacatgactctatctgggagccttactcaaaatcttcagtttcattcatagaatttgggccagcagcatcatgcggcaggattacctcaatataagttgagcaggtccctcttctctcatgacttgaaagcatagacattctttgttcattaattgttgttacttgtatgtgtgtgtgtgtgtgtgtgtgtgtgtgtgtgtggagagagagagagacagagacagagacagacagagacagagagagacagagagagacagagagagacagagagagacagagagagacagagagagacagagagagaaggagggaaagagagagggagggagagggagagagcacatatgaacttacagtggttgtggcactaagctcaagatctgtaaaatctcaagtaagaaaaaaaaaaaatcccagcatgcagatgagacatggatatgatttcaaacctgtggctgagtaattattgacaactgagaactgctgggagagagaaagtcagttttcattcaggacctctgtgggtgaccatactttagtggaatgccactcatatgggcagcaaaaactggtcatttaaaaatgataacaagccaggcagtgctggagcatgcctttaatcccagcacttgggaggcaaaggcaggtgatttctgagttctaggccaccctgatctacaaggtgggattcaggacagccagggctacacagagaaaccttatctcaaaaaaacaacaccaccaccaacaaaaagataacaaaaagaggtcacaaagttagatgggtaggggaggataaaccttggaggattggtgggaggtggataactataatcaagccactgtacaaaatcctgaaagaactaataaaaataaatatatgtatgtttacactaaaaaaaaacccacacatatcaccctgtacaaataaacaacatcaaagtatggcccagggataggagaaaatatttgtaattatatatctaattaaaggctaccttccaaaatacattaagaaatcaaataatccaacttcaaaaacatcaattaacttcattaaaataagcctaagaacactaatatgtatttctacaaattcattcaaaacattatttaaccatattttgagaaatgtatgggtaaaccagttagaacataacttggatttgtacaaatatccattactgctttgttaatacatcctaaaacaccttgagactctatgattgagaagacaagaacacctttttactttttgga

SEQ ID NO: 1339 - DNA, 1200 bp, mus musculus
tgagttattgatatcttccttaaaggacactattatcttcaagagatggtattttaggacagattcctgattttcatgtgcattggtgtatccagtgcttgctgaggtggtagaactgggttctgatgatgtctacatattttggtttctgctgcttatagccctgtgctttcctttcgccatctggatatccctgctgtttgttgatctgggtgactgtatggagtctggctcttttgtcccttgggtgtttcagatctcctggtaggcttgctgccctggctatatcagagcacctgtggggccttcctattgggggctcttcacaggggcagagaagctgctgatctgttgccctggctgcagtagacctcctgggaggcctttagactgttgggtcttccttggagcagtcaagctgctgtccaactgcactgagtgtagctgacactcatctttcctgagagcagcaggtcctcaatttatctgagtgaagagggtcctcaactgctcaactgcactgagctcaggggttcctctactgctctgagtacagcaggtcctctgggatgtatggagatatggagtcttcaggtgagcagaccaactaggggtctgccacagcagcaagaaccaggtggaaggggtgggagggatggaaggaaggggagtggtattagggagtgtggttgttttggtgggtcatgggtcctaagtccaccaggctcccagcagcagctcaggaacttaggcaggggtgtgtgggggtggttcttaccaattgttttgagtgcagtaggtcctctgggatgtatctagatatggagtcttcaagggagcagaacaactaggggtcttccccagcagcaaggaccaggcagaagtaaatctactttaaaatgcctcattagttcttattcatcagccttctgtgtctaattttatagcagaaggaaacaatggcagattcagtcatcaaaatacaatttcttatatatatgcaggtgcagcaaataaagaaaaacacagcctccttgttaaaaaaaaaaagaaagaaaaaaaaatactttaacaagatatttaggactgtatgttccagaatttcagatagtaaagaattaatacttatctttccagctagaatttaattaaaatgtgagatgcatttttatgtatcaatgattcttaactcaccattac

SEQ ID NO: 1340 - DNA, 1200 bp, mus musculus
ttggaccactttgttcaattccttcacctgtttgattgggttttcctctatttctttaagtgatttatttgtttcctcattaaggacttctaactgtttacctgtattttctttatttctttcagtatgttatttatatcctcctttaaggattctattatattcatgagatagaattttaggtcagcttcctgattttcaggtgagttggagtatccaaggctttcttttgtgtgagaactgggttctcatgatgtcaaagtacattggcttctgttgcttatggtcttgcacttggctctagctttctggttatccctggtgttcgctggtcttggtgtctctgtctggagcctgcttcctatgtcccaggttattgcaggtctcctgggaggcctgtggccctgactgtagcagacttcctgtgagactttcagactgtgaggtcttccgagggttgcatattccagtgacctattgccctggctgcaattgctctttttggagggcatcagactgttgggtcttcagaggagcagacaagctgttgacctgcatgtagctgttctgtagggaggccttcagactacagaacctcctgtcccgtgtgcatctgaactccagagacactttcagactgatgggtctgttgccctgtctgcagcagaactcctgtgaggccttcaggctgtggtgtcttcagtggatcagacatgctggtgatctgccatgtcagaaggcacaggacagaagggccatggaattcaggtggcatgttttttatggggtaatgaggaggattccattgggctcttcaggatgcccagctgctgtggctgttgagagggtcccataccaggttgcccagcatgcagccatactcatgggatgccttcagactgtggtgtcttcagaagatcagagaagctggtgatctgctcaaacagaaggcacaggctgaaaagccacacacattttaatatagatttatctatactgtactgaacaccaaagaacatgggctcaagtcccttgagagtcatgttttgtaatgtttccattaaaaacaaactctgccttcaattccctatagcaatattatgaatatggctttatgtagatgaattataaatacactttagctctactgtaggttaaagagtcccatgtgggctacactatggatattgccaacttata

SEQ ID NO: 1341 - DNA, 1000 bp, mus musculus
actcttgtatgtctcaaaaatatcttaactaagttgttattttaaaatgagtctttgctccaataattcacagatgatatagatttttggataggccaaaacaaagccctggatctgggcatagttggtagctgagctagtcagcttgtgcactctttcatctactccccaagggcaagtagcccagtcctgcttttgctaagccacctagtatctcattcagcagaaagcaagctctcatgtcctaggggttggctcaccttcactaatacctcctgagcctgctcctactccactgtgtagccctactgaggcaagactcactctgcctagtgctgcatccaagaaaaggataggcaagctcttttctgactttctcacagcctcatggcaggcttccctgtgcattctccattggggccagctcctctccaggtctacatcaactggtggggcagggatagatatccttctctcatgtacttggggccagcattccagactaccacagatggcaaggaatgagaatactggaggccatcacccctgtgccaactccacctcacagcaggtgagtgaatgggccagatccatcatgaccttgggactagatcatctgacccttctccaccagggccagttctattgctctgtgctggtgacgtggagggactgccttcccaagtgctgtagctggccagaggcagggccagctcactcattttcatgactccaggactagctacatcatctctgaactattggaacttgtgaaaggaccagtcctgataatctaaagctgcagtatctctatgatacagggcagcaaaaggatcacctgtaggagtcctggtggggatcactatttatggtgtcatggaacctagaaaccccagaccagtgactcactgcaatgagcatttgtaagtgaaaatgtgtggacagtgaggtatatggtaggacacactgtgaaactacatctttcatgacaagatggttt

SEQ ID NO: 1342 - DNA, 1000 bp, mus musculus
taatagaagagaaagcaatactaagccaaagaaagtagaaattataaacactgtggtgataaggaaacatttggctcagaatgtgagccatgcagggtatggtaacacacatgcctttaatggcatcactagagaagctgaagcaggattggatataaacagactgtctcaaaaatcgtaactcatgtaaagtaggtcttgagcctagcttttaacggctaagtcatctctccagcccaagtaggctatttattagatatgatgttggctattaaagcgtatgttggagactacaaccaagtcacatgacacatctttagtgtaaagtatctgaggaacacccaatagaagagctaaggaggcaatgtttacgtgcacgatcaagaagcaataagattacacaaaatactaatacaagataaaatctcagctagtgattggcaagttttaaaagtgccctatttatttacttacttacttcaattatgcagaaatatggtcactctaagcataaatactacaagtgttgacagaaatggacttgagcatataggaaatttggacactattcatcctttctgtagtttgctagattcaaaccaaggattcaagaaccggtactcagaggccagatgccaactgcctgtgtggactgtgtgccatagccctcaggccttccaaagtttctttgcttgggtcattcataatcacagagcttcagaaataaaactgtcactaaaaaaaaaaaaaaaaagaaatctgcagctgccagggtgatggtatgaggtgtgggaggggaatcattaggaggtcccaaaaacctgagatgggagaggttgcctggagtcaatgaaggtgagtatagccaatatgcctaacagatgagacatgggacctgaagaggccaactatggtagccaagaaggactcccagtgtacacataaggacaccaaaccttactcctaccccaaaatttttcctgtgtctaaaagaattgca

SEQ ID NO: 1343 - DNA, 1200 bp, mus musculus
aggcagtttgaatttgataatcacactatgtcatttagcaattttaaatacttggaacaagattgaaaaatgaagaaagaggcttgagtcatttactaaaattatataaggcccaaaagaagcttttactgattttttgcaaaggttgatttcaactgtaactagaacaggatcagatttagaaaccagaaagatactaactgaacctttgaattttgaaaatgctaattcaaaatgcaaaagggtgattatccccttaaaggcaagattggcagatctcatatttatgttgtactctgaaaggactgaaggagctgaagtggtttgcaaccccatatgaagaagaacaatatcaaccaaccatatcccccagagctcccagggactaaaccaaaccaaagactacacacggagggacccatgactccaacagcatatgtagcagaggatagcactgtctggcatcaatagaaggagaggcccttggttctgtgatgtcttgattctctagtggtataagggaattccaaggcactgaggtgggagtgggtgggaggaaaagcatccttatagaagcagcaggggggggtgatgggatagggggattccagtggggaaaacgggaaaggggataacatttgaaatgtaaatacataaaatatccaataaaaaatcaaaatgtgagatgttgtatatgtattaagtcatttgagaagggtccataggcaaggcattcctggaatcattgggtatttgtttatttttttttctcctacagataatacaaaaagaagaagatgtaaaaatatttttgctaaaatcttggcatctaaatttccctcttcagcaggttaatactcaactactaggggttggaaccgtaactcacgtgaaataaaatacacgatggctccagtgtatagggccagaagacaaatcaaaaaatgaaaggcatatagagataatagacatgagatttgggggatgtggtttgttatcacaatggaaaacgcacagtaacatttctccaatctcagaaataaatgataaaataaagaatgcatttgagaagaatatttaaaagtattatcaaaaacagttacaggcttcccagttgtccataaacaggacaaaacatgtaatagtttttcaaattaccaactaacctacctttaagttagttaactggcaaagctgtgt

SEQ ID NO: 1344 - DNA, 1000 bp, mus musculus
cgcaaccacctggaatcttccgtggcaaaagctttactgcttacttcttcaggaagaccccgaaccgggaaaatggcgctgcctttatagcccgcaagcatgacatttcagcacctgatatggcatgacagctcctgattcgttgctcgcccatcaccccactattacaccctgagaatgggagtgactagaagtgagttcactctcgcacctgcttacaaggcttgtttactagttaggcacagcagagatcagtgccatcttataatggcgattgctcgcagcacggctctccacatctccccctttttattttattaaaatttgaggctggtctaggcctgtgtaattatgcccatcctatgtggctcctgtcttaggtcgttcctccaatgtcacagcctttcctgtcatagggtaaccctattgccaccgggccccatgtcttagattgatctgtgcatgaggaaagttgcccgtccctggataccacagtgctatgtgacagtaactactaaatgacctagggcgaactctatacaagaggccagccaccaatgtcaactaatttttgagcatagatagccagattttgggggaggccccttgctcgatggcagcaagtgcttgagttatcacaaccttgtcatttgtttgttgggttctgagtttgcaaaccaaccagagcatgaccacaagtccacagcaggtggcaacaccaaataaacccacccccacccattccttaaaataagaaaatggagatgaaatccatgaggagaggccctctgtcaatgacaggtccactccagtcgagttgatctttagaacggccgctctcagggcctcaagggtctcatcgaatctttcagaccaatttcctgcaagatataaagaaagctgtctagaagattcgctgcataagtaaaattttcatattggacactggtaatgcacagagcttccagttttctttcacaacccaactgggccatctggt

SEQ ID NO: 1345 - DNA, 1000 bp, mus musculus
agtaatatgataatgtttaaatatgttaataactcttttaagtaattgataaatactattaaagaagaagactgtgaaacaatgtctttaaaggctacttaaaagataaatattatgcattcctggcagaccagcttatcctccctgctccctccaacactccctacccctgcctgtctccctggatgcttgctctaatagggacacagatgagacccacccactccctgcatcaacccccatgccacctgggaccccacagagctgagcatacctaggctctgttctgctctatagagacttatctccctcctggtatgcacctctaactggacactcaaggaaagggtgcgcctgcccttaaaagcctactgttgtgcttgtctaccaggaggtctgctctaacttggaacacagagcaatgcctgtctcctgggatgtctactcctatccaggacaaccagtccagttaacaccagggaccatcagatggtgaaaggtaataggaagagcatatccaactgaagccaatgaaatatggcaccatcagaattcagctctcctactatagcaagccctggatagtctaacacatgtgaagagccagattatgacattaaatctcatcccatgaagatgacagaagtctttaaagggcatattagtaattcccttaaagaaatgaagaaaaacacagtcaagcatacagaagatcttagagaggaaagaaatccctaaagaaataaaggaaaatacaaccaagtttgtgaaggaaatgaataaaacagtctaagaactaaaacagggaaatataaccaatgaagaaaacaaactgatgcaaccctagagataaaaaatataggaaggagaacaggaactacagatgaaagaatcactaacagaatatcagagaaacaagagctaatctcaggtgataccatagaagaaattaatacattgatcaaggaaaagcaaagtgtaaaaaaaaaaatgcataaaa

SEQ ID NO: 1346 - DNA, 1000 bp, mus musculus
accatcttcacaagaacaaggatgtccccagctcccagccccaccccaccagacctctccactttctgggtcctccaggctcttggtggttaggtgcatcttctctgattgagtccagaccctgcaatcctctgctatatatgtgttgggcgcttcatatcagatagtgtatgctgcctggttggtgacccagtgtctgagagatctcaggggtccaggtcagttgagaatgctggtcctcctatagggtcaccctcctcctcagcttcttccatagcagcttctgtcctttgatataaatatctacatcagattctttcagcttcttgttgggtctattggacggcagtcaagataggcacaccataacctccataatagtgttagaccttggggcctcccctttagctggatcccaatttcggcctgacactggtcctacttttcctcgggttcttctccattgttgtctctgcagttctttcagacaagagcatttatgggtcagagtttttgactgtgggatgacaattccatttctcactttataccctatctttttgctggaggtgggctctacaagtcccctttccccactgtagggcatttcatctaaggactctccctttgatcctgagagtctcttacctccaaggtctctggtacattctgtagggtcaccccaccttctaactcctgacattgccaatttccatttttctgctggccctcagtgcttcaatacccacacaatacctgatactgttccctttttcctctccctgtcccatttcccacccaggtcccttattccctccccttcttgtaattgctttcttctctctcccaagtgggatcgaggcatcctcatttgagccctttcttcttgttaacctttttgagatctgtgagtcatatcatgggtagtctgtacatttgtttgctaatattcacatattagtgagtatataccatgcatgttcttttgggttacctcact

SEQ ID NO: 1347 - DNA, 1000 bp, mus musculus
ggcatagaactttgacaggacaaagggcttctcctcccattgaggagaaactaggccatcctctgctacacgtatagctagagacatgagtcccaccatgtgttttctttgtttggtagtttagtccctgcgaactctgggggtactacttaatacacattgctgttcctcctatgaagctgcaagccccattagctccttgggttctttctctagttccttcactagggactctttgctttgttcaatggatgcctgtgggcattctcatcggtatttgtcaggcaatggcagagcttcttaggagacagctctatcaggctcctgtcagcaagctcttgttggcattcacaacagtgtctgggatgggtggttgtttatgggatggatccccaggtgggtcagtctctaaatggaatttttggtgtttttatatcttacttggttgtgctctttatatatgcaggacattaatcccctgccagttgtataccttgcacatttttctttcattctttgacctctttttaactgattggttggttcttcagctgtgctgaatgtttttagttttctgaattccacttgtcaagacttgggtttaattctagaataagtagagtcctgtttgtggaatcatttcctagagctttattatgtagaggaatgcatatgctttatttcagcagttccagtgattgaggtttcacacttaggtctttgatccattttaagttttttttttttttttttttttttttttttttgtgaggtgatagacactaatctaattttattcttctgaaaatggatatccagtttttccagaaacattcattgaaaattccttcctttgcccagtttttattttggtatatttgtaaaatattaagtggctgaacttaaatatgctcatgtttgcatatgttttgaacacaaatatttttgaaccaaaataaaccttgtattcattatgtttctgttagaatgatacaatgct

SEQ ID NO: 1348 - DNA, 1000 bp, mus musculus
ggaaggccatccagagacttcccccaatggggatccataccatatacagtcaccaaatgcagacactattgtggatcccaagaagtgcatgcttagaggagcctaatacaactgtttcctgagagcctctgccagagcctgacaagtacagaggaggatacttgcagtcaaccattgggctgagcaccagatccccggtggaggagttacagaaaggactgaagaagctgaaggtgtttgcaaccccgtaggaagaacaacaatgtcaaccaacagaactcctagggtctaaaccaccaacaaaggaatacacatggagggacccatggctcccaccatattgtagcagaggatggccttgttgggtatcaatcaagaagaggtccttggtcctatgaaggcttgatgccccagtgtagtgaaatgagcgggcagggatgcaggagtgggtggatgggtggggatacaccctcatagaagtaggaggatgggagatgggatgggggtttctgtgggggaaatcgggaaaggggataacatttgaaatgtaaataagtaaaatattcaatttaaaaaaaaggaaaggaaagaaagacagaaagacatattcttgtttgttttcaaccagtattcttgtgtataaggtctggccaggagcatggttggtgtacccagcagcatttagttgaagaaaaatgattttccctctctcggcagctattacttacaaaggtttcttgggtatatgtaggattttatggtcacttaactttgtccctcactgggattctgtctggcctcatcttgtgcagaccttgtacatggtgtcacagggtctgtgatttcatatgtgcatcaggttaatgtgtctggaagatgtttttcctatgatgtcatatccatcctttggctcttacatacagtttgaatgtcagacaatgtgagattaaaaatgtatttttaaaaatcataaattacactttagatactgcatttttgt

SEQ ID NO: 1349 - DNA, 1400 bp, mus musculus
ttgtattctgttgttgatgctcacatctatggttccagatttctttcctagggtttctatctccagcattgcctcactatgggttttctttattgtgtctacttgcctttttaggtcttctatggttttgttcaattccatcacctgtttgtttgtgttttcctctttttcttttaggacttgtacctctttatcagtgttctcctgtatttctttaagtgagttattaaagtccttcttgatgtcctctatcatcatcatgagatttgcttttaaatccaggtctagcttttcgggtgtgttggggtgcccaggactggccaaggtttgagtgctgggttctggtgatggtgagtggtcttggtttgtgttagtaagattcttgcatttgccttttgccatctggtaatctctggagttagttgttatagttgtgtctggttagaggttgatcctcctgtgattctgttagcctctatcagcacacctgggggactagctctctcctgagtttcagtggtctgaagtggtctgcaggcaagatctcctcttgaagggaaggttcacagatatctggagtgtagacctgcctcctggcagaagatgaaggcccaaaacagggcctgtcccagaaactgtgtggcttctgcctgtcccagaagctgtgtagcttctgtagttggcactctcacctacagtctagtctctgaaaaatcccagaccagagatggctcccccaggttctctggcaaaaccctcctctggcagggaaggtgcctggatgttctggggcctgaaaaggggttcgccccagaagccatgtcactcctgcctgtcccagaagctgttttcttctgtagtccacagtctcacctgcaccgacttctctctgagggatccgggaaccaagatggatcccccaggtgctctggcaaagccctcccaggcaaggcagacacctctcctctggcacggaaggtgcccagatgtctggagcctgaaacagggtctgctcagaagctgtgtggcttctgcctgtcccagaagctgttaacttctgtagttcacactctcacctgcacagaatagtctctgtgggagttttttacttcttaagtctaaaagatttccctttataacttccttaattttaatgagctttcccttaggatggaattattcattctgaaaataatgacaggtgtcaatctatacacatggtgtaggaaaacctaaaacacagagttttcatgctctttcatgtctctgactgtgtaatatggtgaaaagccctaagtagccttgtcaatcatgtttgaatgctctaggtggtcatattgctgaatacctacatggactaaatgcctcccccaacccctacttctctgtaattagctttt

SEQ ID NO: 1350 - DNA, 1000 bp, mus musculus
ttcctggtatctgtctagaaaattgtccacttcttccagtttttccatttttgctgagtatagccttttgtagtaggatctgatgatgttttggatctcctcaggttccttcttagaatggggaacaaaataccaatggaaggaggtacagataaagttcagagcagaaattgaagaaaggactatccagaagagtctgccccacccagggacccatcccattaacaaccaccaaacccagacactattgcatatgccagcaagactttgctgacaggactctgatatcgctgtctcttgtaaggctatgccagtgcctgacaagtacagaagtgaatgctcaccgccatctattggatggaaaacagggcccccaatgcaggagctagagaaagtacccaagagctgaaggggtctgcaaccctataggaggaacaacaatatgaactaaccagtaccctccagagcttgtgtctctagttgcatgtgtagcagaggatcgccttgtaggccatcagtgggaggagaggcccttggtcttgtaaatattatatgcctcagtacagggaaatgccagggccaggaagcaagagtgggttgggaagcagggcgatgggaggaaataggggactttggggatagcatttgaaatgaaaatgaagaaaatacctaataaaaatgtttaaaaaaaagaaaaacttgttttacaaggaactctcctcggcagcaaacgatggagacaaatacagcctctcaagccacacctcttgtttaaataaccccctgatagataatgactgagtaaaggggaggagaaggtgggataaaaggcgatcaatctgatggagaagcaacaaaatgaaataggatgaatcattaacctgagaaggatatttgagagtacagagaggtccagaatcaaatgagtctgataccgaagctattttgaagaaatttcacagtaaaagcagggtaaaaccatttgacatcctgtgattgt

SEQ ID NO: 1351 - DNA, 1000 bp, mus musculus
acatggtcacacaggagatgtaatgttgaagctcaagcaccaataaaacccacagtgactaggcactcggccagtacctctagtcacagatagcacaggcagccaggacatcctattgagactgagaccaagccctatgtttttacagttaggagcttccttgacttaattgtcttatttaaggaaggcaaaggcagctccctatttcgtctgcctatgatctccagtgaggtattcaatggctggttagactggtgtggcctcgtataactgtgtggtggggtctcttatggctcacaggaagtgttttagctacaagcttttaatttcaatctacaacaaatcttgtcaaactgtcatggtgtcattggtgtgtattactaaggtttctgctgtgaaagcagccttctactgaactgtaattgatgatgaataagctagattattttaaattaataaagttcctattatagtaagcaaattatgaagcttagcatataaggacctggtattaatttaactgaattttctcataatatccatttatattaacattgttaacctgaattataaaataatgtctataccttctaagccaactctaacattctgctagagggttcccatttcctcacgaagataaaatttgggatacagagttcagtcactgttgacaggaaggagtgtgcacagagtgcttgcgaggcaggaagcaggacttctacacagggaagtcagagaaggtgtgttcaacattctgaaagtgttccgaaccaagacaaagtgtttggcagcagagagcagagcccagtttgctaaagcaggacctcagagttcttcaagccaccacaccatcttccaacacaaaagttatagcagaaagaagctctaggtgaaacagttctggtttggagatttctcctacatcactggcaaatacagtaagccagttaatgatcccaaagacaggccagcgccaggcctcaatgcccaaggcagt

SEQ ID NO: 1352 - DNA, 1000 bp, mus musculus
tgccgatggcaaaaaggactgtaggttatcatcttagagactgaaaatacacatgaggaatggagtagagatcagagcaaggatgcaaaagataaaaccatggggtggacatgaaagtcagtgcagccaacacgaggtagaagccgcgcaagcctaggtgagagctcagggctcagttctactttgtattctcaaaaacacaaataagaactctgttggcagaacaggaggcaagataaactcgttcccctctgtcttaagactgtcattcaactttcattcttcaatgtctctgtactcacacaaatcatgtatgaccccaaacaatttgttcatcacagccctacaaatcacccccacttgaccaatattcaataacacacagacggcatgataggacagctgaccaaaggggagaggaggaggaagggaataagaggaacagaaatgggaggcccagccaggcaagtggtaaacgcctttagtcccaacactagggaagcagagggaggtgaatttgagaccaacctggtctacatagtaagtttcaggatagccaggatatagaaagaccctgtcttgatgatgatgatgatgaggaggaggaggaggagaaagaagaagagtaatagtagttctggtcccagctctgtgcttcacagcattgtcaattacacaaagattaaagcctttgcaaactgcagggtcctcatatacagagtgaatctacccactgccctatgtgtactttatggtacagatggagaaactggaaactgtgtcacatatggaagagctcctgagagggtggtggcacctggaagaggtcagtgtttgtatctgactggctgcataagcactcaaagctctggcatcaagttagagcagtgtgtcttccttcacaccgtctcccttgctctagtaagacaagtccaatagcccactccctcccagaccttctatctcccaggataactggagctttggatagatttttact

SEQ ID NO: 1353 - DNA, 1000 bp, mus musculus
acaaagtgtatccagttttgtaaacttgaagaattaaattcagatttggttaggactgcttaaaggtaaacataaaacatgtcaaatttcctataaattaaaatttaaaaaactttgagtactgaagaaaatgtatgtacaattgtttcatcccaatcactgccttctgagtttagtaacaaacgcatttaaagaaaccctggtggaaggctaatttaaaagtaaacatgcttttaaaacttaaatatagatcttgtattagtcccacaacaggatcaagatcactattaaaatgaagcctggggcacattatgatgcctaagattggtaggtggattttaattgacttgaagactgtcatagttctattctcataaaacctgtaacgcatttccagcatggaggacccatctgtgcccaccatccatctgtttagacgtgattggcaaagtggtagggaactcgcagtggttgccgctgcctgaaaggaatgaaccacaggatcttccaacgagtgccaaaaacttctgagaaggtctgctgccatggctttcggggccgcgatctacagaagacagcattattagtgaaagacagcactcccatggtgcccttcagtcagctaaaacaatacaggttggctggggatccattactggactctgatgcactgtgtctcagcatcacaaatgcagctttcctttcaatgtggcatgcagctgagcgtcagctctggagagcagatattgtatctgcatcgtcaatcaacctagggtaactctggaagcagaggagaagctcagcataacagaatgtgtgtcaacaacacagtagcaaatctcttttgatgtactttcaggacaaataatttagcttacttctgtgagacagggaacaagagtgatcggtacttattttgtttaaaagctcccatggctgaaagacccctacagtaagactgggatacgcctgtctagcttgggcctcagacaggacacca

SEQ ID NO: 1354 - DNA, 1200 bp, mus musculus
aatattaaaagcagtaagggaaaaaggtcaagaaacatataaaggcagacctatcagaataatcaaggagtaataagtggtaaacttcaacacaggagggaaaccacaccctagaagaagcaagaaaataatcttcttttaacaaaccaaaaagaagatagccacaaaaacataattctacctctaacaacaaaaataacaggaagcaacaatcatttttctttaatatctcttaataccaatgggctcaattccccaataaaaagacatagactaacagactggatacataaacaggaccaacattttgctgcatataggaaacccacctcagtgacaaagacaggcactacttcagaggaaaaggctggaaaagaattctccaagcaatggtcccaagaaacaagctggagtagccattctaatatcaaataaaattgacattcaatgtaaagttaacaaaaaagataaggaaaaccacttcatactcatcaaaggaaaaatctaccaagaagaactctcaattcggaacatctatgctccaaatgcaagggcaccaacattcataaaagaaactttactaaagcacaaagcacacattgcaccacacacaataatactcgataaaattcaacaccacactctcatcaatggacagatccaggaaacagatactaaacaggaacacagtgaaactaacagaagttatggaacaaatggatttaacagatatctacaaaacattttatcctaaaacaaaagagtataccttctcctcagtacttcacgctaccttctccaaaatttgccatataatcagtcacaaaacaggcctcaacagatacaggaagattgaaataatcccatacatcctatcagatcaccatggactaaggctggtcttcaataacaacataaacaatagaaattccacgtacacggagacgctgaacaacactctactcaatgataacttagtcaagggagaaataaagaaagaaattaaagccgttttagagtttaatgaaaatgaagcgacaatatacctaaacttatgggacacagtgaaatccgtactaagaaaaaactcatagctctgagtgcctccaaaaagaaactggagagagcatacactagctacttgacatcacacctgaaagctctaaaacaaaaatcaaccacacaccagaggaaataatc

SEQ ID NO: 1355 - DNA, 1000 bp, mus musculus
ttttcacgggctctgccatgggtggtattcttgaatgatattcacattgttatactgatttccaaaacgtaactatttcagagcatctgttttggacttaactctgcccaccaaagctgaagttctgcccagtgagcagaacaatagtaatcatgtggattatgtacgttttgatcatcggatgtggagaaatcaagctggtactgacctggaagctcccccctctctaggtagcttctgggatgccagaaggtgccgctgtgctagctgctgtggaaacaaggtcatcagcacgtcgcctagtggtgaacctgtgaactgcagtagcccagcgtggcaagacatatcatagtgacacaggtgttatgggtgtaaccaggaacgttctgagaggctctagagcctactttacaggtgggtaaacttggccaagaagccttatctggggaaatcataagacaaagagaagaatctactactattactttgctaaatggacaaagtattaaactgccttctaaatactcatctttacacctacatattaatgcatcccttaacccctcatcagagatgcttccttttgaagtggatgccgattaatacaagagactctgatcaaagcgcagagaataagggaccgtgtttaaccttacacgggacatctgttgtcacaccccttcctccctcattcagggaacatcaaggaggcagaagattgtaagagccaggatcctgggaagactgctgtgcaatggtgacttttagaaacgacaggagcattgagctcacagcagctggagttgcctgttcagctctgcatgagatcaagtcagtcaacactccagcacacagatggggcaggtgctcatgaggcctttccttgaagtgagacgctattagcacttgctaagggagcaagagtgacgttttcctcagcagatggccctaaacgcgtgtacatgggcagagaagcactggaatcatggagtcatgtaaa

SEQ ID NO: 1356 - DNA, 1200 bp, mus musculus
tgtcaacacacatcctcaagatgtattctccaccaggctatttacttacaaccagtcctattgtttgtatatcttaaatctgtgtaggcatcccacaataatactaaagaacagaagttgcataaatatgaaataactcaacttttagaatcagaaactcatgagttaggtatatttaaatttaacttgtaatatgaatgtataacttttataaccagaaaaatacaataaactgcttctactgggagaagaaatgccataaagttaccaaaaacaacatctcagtatgccaccaagtgttcagctcccatttaagaccaaaggaaaaatacataaattcagtataatctcctcagggcaattagtaattatccaaatgccatctctgtttgatggctcttaggacacatactcagtattagggggagtataagtaactaaggtgtttaagatgatctccgtccacatgctggggctaaaacacaaatcttcaaaatatcagtttatggtccttcaaagctcaaccctagccgattacattttattccttggaattcaacggtactgggaaaaggccagtgaacagaagcagtaacaaactctaaagaagactccttagaccctggctgcagcggggagttgagcacctagaggatccctcactgtctactccttgctcccccattcccgcagccccagcaggcactgttcttgctcacaccctatctgcttcaaaatcgacccaggtgcaccagggaatgaaggaaacttatcactgtctgtaaggtcacatatggactctcaaagagacatgaaggagcccagaggagaaggtggcctgggcaattacctgtgtttaaaatgtaacaggaaatgaagttgctcacatggtatctgaggagcaaatgacaacagggaagaagataatgagtcctgctgaaactcttcaaaaaataaatgaatgaatgaatgaatgaatgcagattaccatgaagaaaaagcttgtctgactctgatcaataccaaatcatcataagtgtgtgtgtgtgtgtgtgtgtgtgtgtgtcacattctacagatgtagagggagcaaaggccaactgcaacttaagagattactcttggggggagtataggggtttttggaatagcatttgaaatgtaaatgaagaaaatatctaataaaaattttttttaaaa

SEQ ID NO: 1357 - DNA, 1000 bp, mus musculus
gagagggaagaatgaaggctttatacaattttagggtaatagtaaattatttgggggtactttagggcttggggaacatcaatgagctgagacaaagtgacccaaagaacgggcagtggtttttaaatgagtctctttggaatatggaatggggtcaaaatgaaagacactagggtgtgacaaagtcctcacaggtatgtggtcagtgtttaatctcccttcctgtgctgagtttggctttctctggttagtgaggtttcagtaaatcaaactgaaggcagttggtatccaggtcaggtagacaagggaacttggtggaagagccctatgttagtctgtgataaaataccatggtcagaagcaacgtagaggagcaaagggtttattctgactaatgattcaggagggattaagtccacggaggcagggaaggcagacaacaatcagaacagtggtaacaggaacaggaagctgactggtcacatctcatttacacacaggaagctgaaagaaacatcaagatagaatggggcctcaaaaccaatctgctgtgataggcttcctctggcaaggctctacctcctaaaggttctacaacctccccagacagtgacaataactggaatcaagtgctcaaatacatgagcctatgagaggcagttctcaaactacagcaggacccttgttgtgcatgggattcgaggagccaggcagggtcacagggagcttgacctgagttcacgtccaaggccctctgtcttctcttataatagaccaatgaatattgatgaactccacatcctctgagtcccagtattatttaccaaaattcaaaactgaatgagcatgcattactttttcaacgagaagccaaaagctcaccagaactcacttgcagtgttctaatccactgaagcatcaggaaaactgaagcagtgtcaggtccagatttgccagtgtgggaagctgtgcattgatggtgatggtgaatactaacaca

SEQ ID NO: 1358 - DNA, 1400 bp, mus musculus
gaagctaggacttggctgattttccagacctttatctttctattcctaattttatttacccatgtctatttactgaatagcttttacctcaagcattgtaaacacttcaaagtgtttacactttggagataattgaatctcttcacttcccacaatttttttttcagtttatatacaatgtatgtttccaagacaactagaatacataaggaacattcagataaaaatggactgataaattcaaatgaaggtatgctgagtcacagcataactgtaccagactggggcttgaaccctctgacctctatgtatctgatgccctgaatgatgcccctgtagttagttgggccagtcataatacaggtttgccccttttcccaccccatctggatgaagaggcagaagtattctgttagagagatcagaatctcaggcctggatccccctttcctaatgtgtgggttaccatgttgctactctttcttttgcaacatggttaggaaaaccttcctagtcaggcagaagtgcagagcacctgggcctggcctctctagcttttgccaaactcaataggtgagggcatcctattcagcagcgctctccaaccacgatggtctgaacactccactggttcctagtcccatccaaatcctattccacaactccaagctccatgcatctcattctcctctcattccccactctcctggatcactaaactttagtcccatcctcattttgtcacacactgctttgtatcaagcctcattagtactccatttactcagggggtttcccctgtgggagctctttcccacttccaccaccatgtgtactaggtccccctccccgcatgctcttggttcttggtccctagcaagtttcttctcctcaaagaagccttctagacctataagacgcatggaagccttcccactgtacagcttctcagacaaccatgcaatgtctgcctgtcttcattcttcctcttaaagtgctcacccagagactgcactcaccagattgcccatactagcatcctctttctttactagtgaggagctagggagatgcatgcatactgtgatatgtttatggggtgattgagcaagtcgggaaatgagtgagcaagttaagaaatggcttctctgctgcagtattgaagctttccttggaaatggagctatgtaaattggtatgatggctttcacattttcaaatgaatgttatgataatgaatctataaatatataactctttcttgatcagtaagtgcagcagggccatctcaggttaattcagaagtgtttgtgtagatggtatagagcaattcagaagaaaaaaataaagctgttgaaagtggcttacaactataaagttattcatacttttatattttg

SEQ ID NO: 1359 - DNA, 1800 bp, mus musculus
gctactatctagcctgtggcgtgagctgcaagtgctgaagaggccaagagagcagggccagtcctgtccactgccttttgccctggccatccgcacctacttccgagggttcttccgctatctgaaggcaaaggcacacagcgcttgctcctgggagatcgtcagagtccaattgcaagtggaccttccagcgttcccactgtctgcgagaagaggcccaagatgaggagaagccccgtgcaggaatctctctgctctcgtgacaccacgctccctctctccattcaaagcagacatacggattcggattcagcaccaacaggcgaaatgggcgtgcatcgacaaagagcatcgagttctttatgtcttccctgccagaggccccgaagcatcctactgtacatcatacactgcgaaagatgtttgaaagaaatcctgtgctcttgcatttgaggtggcttctgaataaattgatggtctcggttttccttgggaggttttgatcacagatgggggatgcccatgggccacgggggttggaaaacgtgccttgttgcagcaaggctcattcgggctgttgggtgttagagccgttctctctcctgtcacggggttctgggtagcttcttgtaagctgggaactccagactctcagtctggagggcgaaggcgacctaggctttgtttatagagagggccttacgaagggactgttcagcccctggatgagcccctggatgagtgagcatggctctcctccaagtcccgaagcaggattccacgattcttctcctcttctgttctgttttcttttgttttgtgtttctacctgcttgcctccaaacacgtatcacagtcagcacgccacagtcccggtgtttcacataaacaccagggggcagatggggaaagtttgaggccatggagctaaaggcatgaagaggctgaaaatatttcactccacttggaagctcctgccctcccttgatcactcaattcctggggtgggatgggtgtggtgggagttgagtggggaagagggcgggagacctttaatttctcagaagcctttatcggcactagagctgggcagatacccatgctctacgggattatgtccgtttcccagcccataacacctctctgcaatttccccacccccttgcctctgggcttctcttgactcctgtaggccagccagcacccagggccgttattttggattctcacctcaaggcatcttcttccctctccaccttcctctctctcctggaccccaaaccccacccgtgtcccttctgcccagcgggtggctgtgggcaacagctttttttttttaaatgtttttttattcacatttatttagttagttagttatttttataaccaagagcgtggagtcaaggagttaggtcttttggtccatgcagagtctcgtgtccttgggaacaaccctgccttggaagcgagtacttatcacgaccatgcaccacgaaagatcaagccctctcccccacacccaaccccccaccccccacacccaaaacaggagtcacataagacatctttctcaggattccagaagagaatgaaggacgttggattacctattctggctgcggggtggtgtgggaatttttggcaatagaaaacaaaacctctccaaacccctagctacctggtcaaagtaatacatgaaggaagctgctgaaaatgtgaccgcattcgtattcagaatgggagagaaaactcgtgctgacttacagagggagggttgatgtcagaaggagcagagacagg

SEQ ID NO: 1360 - DNA, 1200 bp, mus musculus
aagaaaaaaaaaaaaaacagaaacaaaaccaaaaaaaaaaaaaaaaaaaaaaaccacactgaaaagaatctgaacacgaaaccccacttacactgtatcagggttatctacatccacacccaaattacattcaacacaagcactcaagcagttgtaccatgctaaaaaccgccacacttctgacttattcatgtattaaacatttcagatacctttgaaatcagttgaaattaatataaacattatttcaatacccatcagtgttttatctattatttagtttgagacaatgtctcactacatagccaaggctgtcctcgaattctaaattgtcccacctctgcttcttgccccgagatcatgggtgggagccaccatgcccagcaacatcattcttgggaagaaagaggtatcgcgattctccaaaatataacaaattaaacttatattcgattcaactaactattccacaatacttagcagtttgaatgatatctcttctacttattacatggaatagttacctagaatttctttactttcctagccattctttagaatttgtgcggaacagaacaactaaagataatctcagccatcaaaatttacccaacaattatcctaagttcaatgtggaatcttagcatgagaacacagtcacttttcagccatgacgcttatcccaaaactcttgatattatacctatcaaaattaacatgtcctggcaccattatccagtattaagaaaagaacaggggagcaggctgcagaggactgctcggctgtcaacagagtaccctgttctgacaaaacccaggtcagtgctcccaactactggagaggatccaaggccctcctgtggcttctaaaggcacttcactcacattcacatgtcaacaacaggcagtcatgtaatatacatatcatttacgaattaagtcctttaaacgttttttttttctttcttggctacatggcaagttcaaggccagcctcaaaaattgaaaagaaatcaccaggaaaagagaaaaaaaggtaaaacaagattttcaaaaatgaacaactaaaaaccctattcattaagtgactgtggagcttttttcaattttcaaaggaattttgtggggcttttttttttcaagtttagaatgtatggcctaattagggttttctgcaagattctcttcaccatctcccaa

SEQ ID NO: 1361 - DNA, 1200 bp, mus musculus; identical to SEQ ID NO: 1360

SEQ ID NO: 1362 - DNA, 1200 bp, mus musculus; identical to SEQ ID NO: 1360

SEQ ID NO: 1363 - DNA, 1000 bp, mus musculus
tttcttcacctccagaagcagaactccctgaagcttttaaaatacccaaaagttgtaatactttagtttataataactaatcacgaatctgttaccaaaaatatcagatggagctgttacagctttctggctataccatttatcataccgtaagtgccaactaaatcaaaatctatcctgttcctaactatttatctgtcctctttaacaaaaggctcatttcaattggattcaagcatcttttgagtggctatcatgtgccagagtaacagaacagggttgcagactctcagtgtctaatggaaatcagattaagcttttaggaaaccctaggaaaagagaaaatttgaaaatctaacgagctcagtaaatgtgttatataaaacatagttacaggatgcctgcttgggcgttgctagtgctattaagtcttgaaatgtttgtgcactctaactttttattatacgattgtccacattttctccttgagataggagaacctatctcctcactaacagaacccttttaggagatagttttacaaactgttaagcgcttgagccatggcttcagcacatgccaatttatacttgactctgccactatggagtcttacatccacgtatcacctttaagtcttggtttcctgatctctaaagcaatgatagcaaggatcaatgtctagcactgtgaggttaaatataatcataagcatagaacaatcaaaattcctgcatgggcgaagtcgtcaatacatagtaactacaaccatggcacatttattttcataaagccagaattagaatccctaccttccatgtggtcattagtgtcttacctgatatattttatgataaatatcttctcatatttctaattgtaaccaagttttaaaggctccagaagacataaaaatcttctgtctgccctgttaggtgactccaatatatttcccaatacaatttcatgattcacccataaaaagttgtggatcttcaaa

SEQ ID NO: 1364 - DNA, 1600 bp, mus musculus
aaatccacttggcttcattacagtattatttgtgtcaattgctatagtatgcattaaaggcacagaacttaattatctagcattaatcaaagtgtataacctcaagacagcatctctgttactttcttgtccttaaatctgaaagccactattctcctaattctatgatcttgaaaatttagggctacaagaaagttcgtgtattgcatctttatgtgttttcaaatgaaagtagcatgacctgtattcaatggatgaatgataatcttgtgtgtacatgtgctgcactatcactatcatgccttcagttcttcagccaatgctttttatatatttgatattatgctcaatgctgtttaaatttttatttcttttttattagatatttgatttatttaattacaaaaattagcccctttcctagttacctccaaaaaccccctatcccttcccccctccccctgctcaccaaccaacccactcatgcttcctgtccctggcattctcctatactgaggcatagaaccttcacaggaccaaaggcctctccacccattgatgaacaacaaggccatcctctgctacatattcagctagagccatgtgtcccacaatgtgttttctttggtggctggtttagttctagggagctctagagatactggttagttcatattgttgttcatcctatggggctgcaatccccctcagccccttgggtactttctctagcttcttcattggggaccctgtgctccatccaatggatgtatgtgagcatccacttctgtattgtcaggcactgacagagcctctcaggagacagctatctcaggttcctgtcagcaagctcttgttggcatccacaatagggcctgggtttggtggttgtctatgggatggatccccaggtagggcagtctctggatggtcattccttcagtctctgcttcacactttgtctctataactccttccatgagtattttgttcccccttctaagaaggaccaaagtatccacatgttagtcttcctttttcttgagtttcacgagttttgcaaattgtatcctggctattctaagtttctgggctaatatccacttatcagtgagtgcatattatgtgtattcttttgtgattgggttacctcactcaggatgatatcctccagatccatccatttgcctaagaatttcataaattcattgtttttaatagctgagtagtactccattgtgtaaatgtaccacattttctgtattcattcctctgttgagggacatctgggttctttcctgcttctggctattttaaataaggctgctatgaacatagtgaagcatgaatccttataagttacttccttgctattttcaacaaaaggtgtataagataaattctgatcaacaatgtgaaaagacgcttttgcacattgtaataagcatttgttattagtggtgatgcattgagtcattacatacataaggcacattgatggtggttttcatctctatgtttgtgtgcactaattacattttttcctcataaagatatttctgactttgcctccaaaatctggaattaaaggcatgtgcca

SEQ ID NO: 1365 - DNA, 1000 bp, mus musculus
aaatggatggaactggataatattaccccgagtgagataacccagtcaaaaaggaacacacatgatatgcactcactgataagtggatattagtcccaaagctcagaatacccaagataaaattcacagatcatatgaagctcaagaaaaaggaagaccaaaatgtggatgcttcagtccttcttagaagtgggaacaaaatactcacaggaggtagagggtggaaggaaattgggaggaagagagtggggcaggaaagggtggcaggatcaggtatgacaggaaacagggatgatatacagagagtcaggaatttgaacagaagtgcgtagcaatgagggatgaagaactggaggtaggcaccagcaagaggctcccatgaaacaacaggggtgagattagctgaaatgctcaacaaaggggagggagaacctgaagagaacatatccagaggttaggcagggaccctggttaggggatgaggccacccactcatctccatattcttaacccagaagaactcctgcctgaaaggaaataaggggacaaagtatggagtagagactaaagaaaagaccatgcagagactgccccatctggggatccatcccatatacagacatgaaacccagacactactggggatgccaagaagtgtttgctgacaggagcctcttatagctgtcacctgaaaggatctgccagaggctgataaatacagaggcaggtgcttgcaaccaaacattggacttagcaatgggtcttcaattgaggagttagagaaagaactaaaggaactgaggggggttgtagccccataggaagaacaacagtatcaaccaaccagaacccccagagctctcacagactaaaccactaaccaaagagtacccatggagggaccaatgcctccagccgcatatgtagcagaggatggcattgactggcatcaataggaggagaagctcttggtcctatgaaggcttgatgccccagtgta

SEQ ID NO: 1366 - DNA, 1200 bp, mus musculus
ttcctcagagacttgaagttcttgttatacagatctttcacctgcttggttagagatactccaagatattttatattatttatggctattttaaagggtgttgtcttcctaccatctttcttggcccatttatcattttaataaaggagagttattaatttctttgagtcaattttgtatccacccactttgctgaaggtgtttatcagctataagagttctctgctagaatttttgaggtaacttgcggggctgtgggtgttggggagagaggggagtgggagagtacccgtgtcctgccagagttccagtgctctgggcagaaagacatgggaggactgtccatgctttccaaatagccctaggtgggcatctggctgtgttaagccactgaccaggcacagcaggtgatggacaaggggcagccccaggtatgagtttctctgcctccggcaccccatggtgaatatggtggaggagctgagaacagaagagaggccctgggttggcactcagcctaggagaggaagggaagagagggcactgggggttggggggaaggcagtgctggatcggtcccacgaagatgagagtacttagtccagtccatggcagcagcataggaaggccttctggtgggaggttagacgtggctccttataaagtctagtccatcattcaagcatggtgggccttgatgaacagagacagtctatggttttagagttttattgtagaaaggcagggagaaaggagagaaagagagagggagacaggccatggccacgtggagagaggggggaagggaaagagagaaaacaggaagtctagagagtaagaaaggtaaaaggagtgcgaagtggggccaagcagtccctcttatagtgggctgggctatcttgctgttgctaggtaactgtgaggaggagtctagccagaaggcctgaaatttgggacattgtctatgtgactggtagccacaggcctctgctgtgggggctgtggaggtaacttctacaggagccaggggtccaggagacatgatcgaatgccttctgtcccatgtaggtggaaattaccacccaccgggtcccaccagggttcaagacttaagcttggctggagaccaggctgtctgtgcaaagcccattgtcccacagtaagttatgtatactatcatattatatgcaaatatagata

SEQ ID NO: 1367 - DNA, 1000 bp, mus musculus
agtactgcatctttcattgggaaaagctgcccaagggctctgtgggttgagactggcagcatcttctaaatctcctctctgaggttgagcagatggcagctttcagattggaaacttgattcaatgctgcatttagtgtgattaaaaacaaaaacaaaaacaaaaacaaaacaaaacgaaaaaaaaaaaaccaatgagcctggggctgagactatacaaccccccacagaacaggtggcaaaatggaaaaatgaaggtaaaccagtttgtttgttatccccacaccactaaagaaatggcttgatgaatttttttccccaagtggaatgactatttttttttgttgttgttgttcctctcctcatcaaatgaattgaactgaccagctgtattggcatcctgtagacagggcctgaaaagtctcctgctctaacaggcttcaaactgttaggggtctgtagtgacacagcaggtgcagggagatctaagcccttaaatgcagtgtatacacagagctctgcagacagtcctgcggagctaccacataagatggtttttcatgtgtaaatgagaaggtctttcatttttcaagcttttgcattatattcccttctgttgaaagacaaacacaggaaagcaaccagcactgaggcaattacagaagggtggccagtgccatcgccaggacggctggcttcagtcagaaggcttaagtgcaccagcatggctctgagttcctaactagagttcaaactcttgttgggcatgcgtgatttctcaggattgcttcttcggaaatcagtgtaaacaggagcgcataggtgtgggcaaggctttctcggattgagggtgagaatttaagttcgacttagtgaaaagaattctaaatgactgattttcaaggtgagtatttaccagggatatattttaggaggtatattttcctttaaacccattgctagaaagcaattctatggtctttcaggatagattaggtgaa

SEQ ID NO: 1368 - DNA, 1200 bp, mus musculus
cctaatgtggatttcctaatgaggagagtgagtcaacctctactctttggccatagttacctttgatttactaatccattagtttattaaaactaatgacttaagagtagtttggggggcagactcctacttggtctgctcccatgaagacaccatagcaagatccatcctagaggacccactgcactcagagaagttggtaagaacctcttccctccacctcttgagtcctggggctacagctggtagcctggtaggcttgggacccatcacccaccaaaactctggccctccaatatactacttcccttccatcccttcaccccttcagcctggtctttgctactagggcagactcgtagttggtctgctcctgtgaagacaccatattcagatctatgctagaggacctgctgcacttagagtagttgaggatccactacactcagagtagttgggatcagctgcactcagggcaggtgcacaacagcttggctgcttcactgaagacctattgcccgagcttttgtccctgccagcaagaacacactcaggacaaccagaatcttctgcggcaaagcttttattgcttacttatcaggagggaagacccctaaccgagaaaatggcgctgcttatatagcctgcagcgtgacattcagcacctgatgtggcgtgatagctcctgattcgttactcacccatcaccccattactacgccgcgagatgggcagtgactaggcgtgagttcactcttgcacttgtgcataaggcttatttactagttaggctcagtggaagccagcgccatcttataatggcgattgctcacagcatgctcgcggcacagctctccacaaagacccagcagtatgaaatatcccaggagatctactagagccagggcaacaaatcagcaacatctcttcctctgtgaagagcccccagttggatggccccatatgtggtttgatacatccagggccacaggcctacttggagacttcaagcatcccaaagacaaaacagggagactccaaacagtcaccaagaccaacaaactccagggatatccccatggtgaaaggcaagcacaagaccatgagcaacagaagccaaaatatgtggacatcatcagaacccagttctcccaacacagcaagccttgaatacaccaacacacatgaaaatcatgaatc

SEQ ID NO: 1369 - DNA, 1200 bp, mus musculus
taatactgcccctaagataccacctttctggttaggtaatactgcttgtttgaataattttatatatttcaaggagatcataatataatcaagattattaatgatgcaataatgcagctccacagtccacacatctctcgattctgatctttttttttttgatattttatttatttacatttcaaacgttatccagtctcccatttcccctccgcacactccctatttcatcccccatcctcctgcttctatgagagtgcttgtccactcacccacccactctcaccacctcaccaccctggcattcccttacactgtttactctttggtttgtggtttagtccctggaagttctcggggtctggttggttgatattgttgttcttcctatgggattgcaaacctcttcaactcctttagtcctctccctaactcctctttttgggatgtctttgctcagcctaatggttggctactagcttcaacctctgttttttacaggctctggcagagctctcaggagacagctatagcaggttactgtcagcaagcagtttttggcattagcaatagtgtttgggattgttgtctgtatatgggatggatccccatttctctagactgacttttcttcagtctctgatccatactttgttcccatatttcctttagacaggagcaattctaagttaaaaatttggaggttagcaggtagcctcatccctcatccaggggccttgtctaaactctgaatatggtctctacatgttttccctcccctttgttgggaatttcaggtattgtcatcccagttgtgtcctgggagctttttgctttcctggcatctgggactttctagtggctatctccagttcctcagcccccatcgccacatacctctgctcaatttcctgactctatcatccccatctcctcccatacctaatccttccccttttttatcctctacttcctttattcctcccaaatcccttccaccctctacctcctgttattattatatttccctttctgaaaaggactgaagcctctacaatttggtcttccttcttcttgagttttatgtgatctttgagttgaatcatgagtattctgacctttggggctaatatatacttatcagtgagaacatactatgtatatccttttgggtgtagattaccttactcaacatgatat

SEQ ID NO: 1370 - DNA, 1000 bp, mus musculus
tctccacatgatccatatatgcatagaaacttgtttctctaagtctaaggaccttaaaattactgtccatgaattgtgactaaaaatgctgttcattgagccaaagagaagtgatctttgtggaatagtatgcatttatccctttgtcaagccaagatcttcctttttcttatagttacactccatggatgtagacattcctgtaaacatacagggtagatatgtgtgtatagaatatagtgaggccagtgtgcagtcctttcccattctccttcactggagtcctgtcctcagctcacttgcccctgagcactgctatgacactccccaggacaaaatgccactcattcttgtggaatcaatctttatttatataccaaattattgggaactacctaatacttaataagagatgaaaccctgagtttatcaagttatgctccaagcaggagttattttcactattagaatacttattacctcaagatacccttgataagaaatgcagaaatcaacaataattgaacatcaagtctagaccacagactacattggtggcagtactttgatgctgtacctcctacccatcagaagcaggagcttatcactgtaaatggatgatttttgtcaagacaataagcatacaaaccaggatattgaataaggccaaccagccccttacccacagggttgacttctacagaagtgattcttggcttgttttggaaggctttactgtgtactctagactgactttgaattcatgacctttctgtctcagcctccagagttctggcattaaaggagtgagtcccatggccaatcatgttttgttcgtaacaccggtcttaggtttgttgcaattggacctcaacgttgaaaatcactgaagatcagtggtgcgttttcccctgcactatgtgcaaaacaagcaaatatcccagctgtaccttgacaggtaactgtttataccacatgctctcacatagatcatgcttca

SEQ ID NO: 1371 - DNA, 1200 bp, mus musculus
agattattttgctttattattttacattatgtaactccaatattttgtcacaatgatgaacacgaacacacatgtaaaattgtatccatttgtaagatttagtgatttatttctacgtgcaaagtttattttaaaattttatgctttgatgattttgttattcttaagaaatatttatcacaatttcatatttctttccacttaatcatagaacaaaaaaatctagttcactaaagaaaaagtttcatagaaaacccagcctccccagggtaacaagtcccttccagttggggccagcactgggtcacctggacgcagagtcagtagatacccgcaaggtccctagaggactctccacacaatcttaggacctccggtgagtggaacacaacttcttttccattccaatcgcacaagacatgaggcagcattaggaaagcagaaaacctggcctgaccaggatcaaaagtcccttccaatcagctccagcaccgggtcaccttgggtgcggagtccgcaaacacccccaaggtccctagaggacagtttctgaggcagaccccatttagggctccagacatttgggtacctttcctgccagaggagaggtgtcgctccacctgggagtgctttgcctgagctcctacaggagccatcttggtccccagatccctccaagactagtctgtgcaggtgagagtttggactacagaagctatacagcttctgggacaggcagaagccacacagcttctgaagcagaccactttttgggcttcagacatccaggaaacttacctggcagaggagaggtgtcctccctgcccgggagggctttgctggaggacctggggaagccatcttggttctctgatcgttggactacagaagctaacagcttctgggacaagccctgtttcaggccttcatcttctgccaggaggcatgtccgaaaaacagatatctgtgcacattccctgcaagaggagagcttgcctgcagagagtgctctgaccactgaaactcaggagagagctattctcccaagtctgctgatagaggctaatagaatcacaagaggaacaagctctatccagagacaactataacaactaactccagagattaccagatggcaaaaggtaaaacttaagaatcttactaacagaaaccaagaccactcatcatcatcagaatgca

SEQ ID NO: 1372 - DNA, 1400 bp, mus musculus
aatatgtattcccctttctcatcttttctaacattttgaattcattcaatctttccatgtgctatcattttcatttgtcatataattaaacatgtaaaacaataagtagttcaaatatactgatcgagattcatgctcagctttttgtgatccataccttttgctataagatgaactactgtttgtccaggttcatgacaatggtagtttctttggtagcaataatgttgcagaaaatttatttaaggaaatttacccaaccataagcctttgcacttagggtagaaacatacttaagactctacggttttgtttctttctctcatctatactgccttgtgaatacatgtaagtgcccagaaaaaaaaaaaaaaaaaaaaaaaacagagtaagctcaaacccctcaacttaatctaacctgtaatgtcccttgtgtcctacaaggtaacaaatacatgtgttttaagagattagaaggagtgtgtttagaaaaagatgcaggatcctgtctcctgaaagagaaactgacaactccacagttaacttcatcaggactgcttttctttcaaagtggctgctccatctcctattttcacctgggatgcatgaggttataattgctctgtgttctagccaagacttgtttattaccagttgttttcataatagccatcctagtggttctaagtgttatctcactgtgattttgatttgcatttcctaatgactaatgatgttgacaaccattaatgtgctcactgactgctcttataccttttaggaagacatgtctattcaagtgaacaagggggtgtggtaatgatttattgattacagaattattgaacagtcattgttttttcataagggtaagacagtaaatatttcaatttgattcctttggtatttaacagcatgagataaatttaaatattagcatacataaagatattgttctgaaaacttaataaatatcattgtatcaataaacagtaaatgctattctaattcaacttaatattcatgtaaatttcttaaagcttttaattattacatatataaaatatttttaaatgatatttgtatatgttcctgagtgcatatttgtgtgtgcacatgtatgtgcattaagcacttatttttaaatataacagtgttttgtaaaagcctggcatatgtttaaaaattacttttttaaaattacttctaatgtgagtaatatttaaatttattgataatgactctttaaaaacattttataattttactactgatttttagagtttattaatattgagagagataagagtatttgttacatggttatataatatagtttgggctggttactatccttggtcattctacaagaaattacccaagtgttcggattatgtgtg

SEQ ID NO: 1373 - DNA, 1000 bp, mus musculus
atccagtaaaatactgcaagaaagcatgcaagacccgccacactactgcagggacaaatttggaacattcgtgctatggaaatgccatggttccaggaggctaagtttccatgaaacatttttgcctcaggactgtgtccaagctttgggactgcctcacagtgttcactggagtgggtgtagcaatccccaataatgttatatttttatgaagaatccaaaagtattactagaaagataacaaagatgagaataatagaataaaaggaaaagcatttgaagggaagagaaatcaccagtgatatttggtaaatcgagctgctccttccagttaatattctttcaaatactcatgcagtctaacttgaataactcaaacattaattcctactctactccaaaagatttttttcttagtcctcctttgagagaaagatgaaattttagaacctacacatcatgtaaaatgtaccagaaagtttttttgtgagcccgaaagactgcttgaggctgagaacaaagaagaacaggcccaggcatgtcctagcaggccagtcgttaaggcattcctaagaacagcttgaccataaagataaaaaaagattacaaggacagaacagggctatcttggctgagtcaacaccatctgcccgctgacctcctgactcagttcagagtcatatattaaccagatgttccactgatgtagataagcacccaaccctcagacttcctgacaccccaatctacaggtacacttttactgatatataaccattctgttgaagtttaaattatccaatcatgtgaaacctcactaattccttccccagccccagacccttttctataaaaacccctagcttccaagcctcttggccaacatctgctatctcctgtgtgagatacaatgttggtccggagttcggagttctgtcattaaattacctcatgtgtttgcttcaagacggtctctcgtgatttgtttgggtgcacaccg

SEQ ID NO: 1374 - DNA, 1000 bp, mus musculus
tatcagcagacctgggcgactagctctatccttagtttcagtggtcagagtactctctccaggcaagctctcctcttgcagggaaggtgcccggatatctggtgttcgaacctgcctcctggcagaagttgtgttccactcaccagaggtcttaagaagatcccgtaggagttctgtgaggcccttaggggtgtccagaaactccgtgcacaaggaactctgctgctggagtgaaccggaagggacttgtgcccctgatcaggccgggttatctacttccctagttaatgcagtctaaggtcctgcaaaattggattggagcagacgctgtgttccactcaccagaggtcttaggatcccatggggaatcctgtgtggttccttgcatgtgttcagagactgtgtgggcaaggcacccaggtgctgcagtgggccggaagggacttgtgcccctgctcaggctgggttatctgcttccctagttaatgcagtctcaggtcttgcaaaattggattggagcagatgctgtgttgcactcaccagaggtcttaggatcccgtggggaatcctgtgtggttccttgcaggtgtccggagaccccgcgggcaaggcctaaactcttttcacgagatagtctctattccaaatgatactcctgtaacagctccctttcctcagtttatgtgaagtaatatacaggcattaatggttaagtctcaaaagaaaatacaaatactgaccaagaggttaaggtcccaaatctgagtgacttctcaagaataggaaaaagactactcaggagagaaagactgtcatcaatgaaaacttttcactcattatcacagtgcagcctaatacagaccctcagtgtacttaggactaccccccaagacagtatgtgattataacctgtgtcctctagtttccttagcacatggcctcaataaacctactgactcccaataacttttgtttcttaagttttagcacagaatctggc

SEQ ID NO: 1375 - DNA, 1000 bp, mus musculus
atatataacttagagtaaaacatcagcttttacatagtttaaaaacatgatgtccccactggcaatgggcaaaaagatactttgttggtagtgttcttatatcggtcaggggcggagcagatggcagtcccttgtttatcctagcctgatgcctggcttggtggccaaagctgttttatgtctaggacatatcaaatgaaattaaatccagtcaggatgacagagttctgccatgtcacacagtgtgagctggaaaggatgcccacaggtttattactaagcagtgcagcatgggagaaagacagacagacttgtagacctatagacttccatgccacccacagacctgccctcctatgcttgacacaggcaaccgtagatactcccttgtctgaggatgtcacccacggtcccaccagccacatggccagtctgcagcgggagccaccacactgtgtgaggagatggtgggcagaggggcaagaaagacatgtggagcagcgggaacattatgaagatagttggaactcgagaaatgaaggtagaggggagtggcctgttgatagtggccaacccttgttatggggcccatggtgaagtcccagccagatgtgcctctgtcatttgtgtgtctggatttgtggctatgtagcagctgggatcagggtcaatgtctgtggaccacatgacccacctgggaccacatgcatgccccggggctgtggaaaataggccccacccttcactggctacaacctcactggctagccctacctctgaccagcagcaacactctggagaatgggcctgagctttgcccaggtcagctcagtggagttttgtgtgaacagccccaagagtataagtgtgagagagctgacctcaccacggatgtcagggtgatgccactactcctcttacacttgggaaaattgtccacagggtcatgagctcaagagagctatccttgccctcaccagctgcagaacttggaagagtg

SEQ ID NO: 1376 - DNA, 1000 bp, mus musculus
cacagacctggaaggcctctactgtatgtgtgttgggggcctcatatcagctggtgtatgctgtctgtttggtggtccagtgtttgagagatctcaggggtccagattaattgagactgctggtactcctacaggatcacccttctcctcagcttctttctgccttccctaattcagcaataggtgtcagctgcttctgtccattggttgggtgcaaatatctgcctctgactctttcatctgcttgttggatcttttggagggcagtcatgataaatccatttttatgtgtgttccatagcttcagtataagtgtcaggccttgggacctcaccttgagcaggatactgctttaggactgtggctggaccttcttttcctcagaatcctgggatgggggggagcacagaaaggggaacatgatctgatattgggtgagggaaaagaactgaagccctgagggccagcagaaagaatggaaataggcaacctcataaaataggaggttggggggaccctcaggaatgcacagagacctggaaggtaagacactcccaggactcaaagggagggaccagggactgtagatttaatgcctgacagtagggagagggcacttatagagcccacctccagcaggaagatagggcatcaaatgagggatggggctgctatcctacagtcacatgtctaacccataattgttcctatctaagtaatttgacttttgacttttggaaggaatcatagtttagagattgctgtgagtctcagaaaagactttgaatttttaagcagtgttgcaaatgcaaaagagtatgggaattttcaaagttagactaaatgcatcttacataatggtgtgagcatgaaactgtggggtagaatgtggtggtttgatgagaaatgttcccaattggctcacatattttaatacttcatctgtggttggggtcttatttggagaaactgaggatttttagaaggtaaaaacctgttg

SEQ ID NO: 1377 - DNA, 1200 bp, mus musculus
ctgatactttcaaggaataaaatatctccttattaattttgattggagtgcattgtaagcagcattgagcagagggaatgtctttgatatttaacagatacaaattatacaaatcttaagtgtatagttcaatgtatggcacatccatataaaaccactcaaactgagatataacatattttcaggaccggaaagcctagcttcctgctatccatcattaatattcctgaatgtaattttaattttgaccactattgctgtctttttatctactttgggggatcttatatgttttctacatccatatttgtgaagtccaatcttgcctctgtctccttgagcatatggaatgtggttataataattgttttcatttctttgtctgctgactatcatctctgttcattctaatcattttaattggctggcttttctcctcatgtgggttatatttttcactttccttgcatgcctggggattttcatccgatgccacatatggtgaattttattttggccactattggctgcttttatctatattcttgccctgagacatggtaaatttactttaaaacagattacttgggggtcttgcttttaagaagcttcctttagatcatcccagaaccagtgctaatcccaatttctacattagtattctacacaaagcccccataaattatgttttctaccctgtgccatggaaaaataaatcagtctgtgttaaaaagagattcaatggttgttcctaatattttcacttgtatgtaagcacttgtggcaaccttccctgaagactcaaaggaaccccttcggacttcttcctatgcctaactctaatccttagagaatccatccaccttggctttcagagtctcagttccagttcccccactagggagagcacagaggcctcccatgcatggccttcctatgccacagtctgaaaacattccaggagaatacagggtacttcctactttcattgccatctcccaaggatggttgtcctttggtgcttgctccccgtggcttagaaaccaccatcactttgtacaaattttagttctttcaggtagtacaagaaatctgattcaagttccaccatcttgaactgaaagttttgtctgctatactttacacatgattatatgattacattcaatgttctttgtgtgtgtatgacttcagtgactc

SEQ ID NO: 1378 - DNA, 1200 bp, mus musculus
tctggaacatacattttaaaagggagatattaggaaaaggtcagtgaaatcaagagtcatatgggaaacagattattttctatctttgactttaaaaacaaaactaaatcaaagttcacatctcagttttaccaattgtcttcatttgggttgcattgctgtgaagagacaccatgaccaaggcaactcctttgggcctggcttacagtttcagatgtgtagtctattatcatcatggtgagaagcatgtcagcatccaggcagacagactagaggagctgagagttctccatcttggtctacaggcagcagaaggggactgtcctctgcaggcagctagaaagggctctgattctatgctgggtgtagcttgagcttatatctgagacctcaaagcccacctccacagtgacacttcctccaacaagaccacacctcctaatattaccactttctttgggccaagcatttaagcacattaatctatgggggccatacctagtctaaccaccacaccagtcaacatttgctctgtagccctctttatggactgagttgcagtagtgacataggatgtctagtgataccagctccttcttggaaatgtactgtcgttttctcaccagtgtccctaaggcaactggcatagacaaccgaaagtctgatacatatgtgacagtaacaggagtcacagatggaatgtgaagtgacagtgggtgtatgttggaaaccactccatcccaggagcctggatcctgagattctaggtccagatcagccacttggtaccttcataactcagtttccctcctcagggtatttcccctgctcctgttttcatacttgctaagtagtatttgctttcaggataagctaatctgagatctggaatgaaaagcctttacttttgcactgttaggaaatgtgagaatctggcaagttccaaggcttagcttgctaattgcctctccatttggctttgatacagtgctgtatgattaacagcaaatgctcattaaccagtggtttaatgagaatgggaatcctgtttgattttctcaccactgtatcaccaacaattaccacagtccctggtacacaggagcgctaactccatcatggtaactgacttattgatcggcctggatcattttcttcctaaactatcatgaagactggttctgctcttctcttcccaag

SEQ ID NO: 1379 - DNA, 1000 bp, mus musculus
attacatgcctccatgaagaaattataaaattctcgcactaataggtttaaactatgtctgaaaggtctagaaaaaaagaagcaagtacaataaagaagagtaaaaggcaggaaataatcaaaataagggctgaaatcaatcaattagacacacaaaaaagaatggaaataatcaacaaaaccaaaagctggttctttaagaaatcaagataggcaaacctgttgtggaaaatataaaagaagtgatcctgccaactctcctcggtgtcagaccatgctcccatgctcctcccacctccaactctctggagctaacccctacagcatctggccatgagccactagttccctctatctctctatccctttatcccagtattttgaaccttgtgaaatcatagctacttgtggctggaaaatgtcgcacgtgtacatgtccgcagccatggtacttctccctcctattctgccatgctccctccctctgcgactcttagctctgactccctttttactgtccaatcacaggcctcccactgccctaatgtgattggacagggaaaatcctgcaacataaacccttagccaaactttcaaaacgactgagagagtgtatccaaatacatgaaactagaaatgaggagggagacataatagcagatagtgaggaattcaaagaatcattgagtgttacttcaaggcatgtactccaaaaaattggaaaattttaagacaatgcataattttcttgacaggtatcacctagaaaagttaaatgaagatcagattaactacctgaatagtcttataacccctaaagaaacagaagtagtcataaaattctaataacaacagcccaaggcataataattttagtgcagaataataccagactttctaagaagagttaataacaatactcctcaaactatttcacaaaatggaaacagaatgaaccctgccaaactcattctctgaagccagaatcaccttgatactt

SEQ ID NO: 1380 - DNA, 1000 bp, mus musculus
caaccaagggcctctcctcccattggtgcccaacaaggccaccctctgctacatatgctgctcgagccatgggttcctccacgtgtactccttggatagtagtttggtccctaggagctctggggagggggggctctgattggttgatattgttgttcttcctatggggttgtaagcccctttagctccttcagtcctttctacaactccttcattgagaatatcatgctcagtcgaatggttggctgtgaggatccgcctctgtttttgtcagactctggccgttcctctcaggagacaactatatcagggttcttacagcaagcacttcttggcattcacaagagtgtctgtatttggtaactatagggatggatcccaaggtggggcagtctctggatggcctttccttcagtcctgctccacattttgtctccgtattttctcctgtaagtattttgttaccctttctaataaggactgaagtacccacactttggtcttccttctccttgagcttaatgtggcctgttaattgtatcttgggtattttgagcttttgggccaatatccatttatcagtgagtgcataccatgaatttccttttgtgtttgggttacttcactcacgatggcattctctatttccatccatttgcttaagaatttcatgaaatcattgttttcaatagctaagtagtactccattgtgtaaatgtaccacatttcctgtacccattcatctgttgaaggacatctgtgttctttccagcttctggctattataaataaagctgttatgaatgtagtggagcaagtgtccttgttatatgttggaaaatcttttgggcatattcccaggattggtataggtaggtcctcagttaatactgaatccaattttctgaggaaaacatcaaactgatttccagagtggttgtaccagcttgcaatcctaccaacaatggaggaatgttcctctttctcatgttgcttcccc

SEQ ID NO: 1381 - DNA, 1000 bp, mus musculus
tgggataggagaggctcctaagaaccatgggagtgaccttagctgtgactcacagcagtggggatatagaacctgaggaggctaccttttatagacaagtaggaaccccagtggagcgataaagacaccaacccacccacaaaacttccaacccaaaatttatcctgcctacgagaaatgcagggatgggagcagagactgaaggaatgatccactaataatcagcccaactggagaccatctcaaggaattggcaagcaccaattcctgacactattaatgatattttcttatgcttgcagacatggctgtcctctgagaggctccacccagcagctgactcagacagatgcagagacccacagccaaacagtggatggagcttggagactatggaagagttgggggaagaattgagggccccaaaggggataggaactccacaggaagactaacagagtcaaataacctagacccttggagactttatttttcttggagaccctcagagagtgaaccaccaaccaaaaagcatacataggctggacctaggcccctgcacacatgtagcagatgtgcagctctgtcaggaacaacaggagcagggcctatcccaaaagctgttgcctgtctgtggaaaccattcccttaactcggctgtcttctctggcctaagtgagaaaagaaacatctagccctaaagagacttgatgtgtcaggctagggcagggagacgcaggaaggaccccactctctcacaggagaaggggagggaggaggggaagctgtggggggactagaatggggggacagcagtcagggtataaagtgaataaattaaagaaaaaagaaaagagaagtagaaaatgaaaaagctaaatgacttagctggagaaggaaaaggagagggagggaagagggaggggaaaggggagaggaagaagaagagggagagtgagacagactgaataactttgtatgaaggtcgttgcttacagct

SEQ ID NO: 1382 - DNA, 1400 bp, mus musculus
tcaaaaattaagtggttttccaattgtcccaattcccaatggcttaccctcatttctaaagtggtttggaaaataattcagtgcatttgaaaagcaagcttatagttagttttcagtctttactgataagcctattaaaatcatgaatatgttttattagactttatactcaaatatcattcagggaggctgtccacctatagcagcccctaccttctgatggctgctcatcatgggaaactttcagtagctgtgattgtatttcataatcttgcccaactggtgagagttattagtcagattgagggtacctgacccaggagggaccaatctgattatctgttcgggaagtgtggatttcactctcagctatatagcctgatagtgtttgtgagatgtatgtatgtatgtctgcacatatgtatgtatgtatgtatgtatgtatgtatgtatgtatgtatgtatgtgtggtttacaagaagaaatgaaagcagattcatgggaattggaagtcagagctaaaggaatgatcctagcagagtgtcttcctagttttgagttcttcctttctcccgaggcctagccagagtccttgtcagccttctttagatagcttagttttattatctcatgttacagctgaggaaactgaagatgatgggtgtaaagaaagtgtcttcctgtgagctaccggaacattccgactgtgtggcctcctcaccttcgctatctagcatacaatctagcagacatgtatcttgtatatatctacaattctagaaagttaacttcactctttagaatctaaaacgggagctgtgaatcagagacctattgttaggtaacaaacacactgtgtattcttgctacctcccttggttcttttgggcattggccagtgtcagttgaacgtttcttgctcagggtctcccctgtggcttcagttccagtcaccctgaatgtttcagtattcaaatgtctggtgacttttggttagggtctaaatggaggagatggggctccccaaactctttctttctgtggtagactctgggtatctgctagctgaaggtcccaaaaatgtctaccccaagcctcttttaacttgacccctgaattcacttgttcagagtcattttggcttcaggggtacaagaaaaagtcttgtttggtggaaggaatgtcaatgacttttcaagcctgttttacatctatactttccatttcccttctgtgtgtgataggaaggaggtgagccccatgctggctgcaaggagcttctgttttgagttggaagccctcccccatttccagacaactgctagtttcaggttttaatgacagtgacatacactgtatctgactcactttgtgctttcaatgaaaatggcctccttagg

SEQ ID NO: 1383 - DNA, 1200 bp, mus musculus
atctttgctaaagattttgttcctcacacagttgggttgggtgggcacatcctccatgacagtggttctcaacccaggggttgtgacacctttgggaggtcaaatgacctttcaatggggtcacctaagaccatcagaaaacacagatatttacattacaattaataatagtagcaaaattacagatgtgaagtagcaatgaaagtaattttatggttgggggatcaccacaacatgaggaactgtattaatgggcagcagtactaaggaggtggagaactaccactctatgaaatatataggtgaccacagagctatgtgttcttaccataacctggaggccaggtagcccatcacctcaggaaaaaaaatgtgtccacttgccagtgagcctgcctttttctccccagaagtctggatagatgcagtttaaggcaggcatatgcaagtgttctccgaaagcacggtagctgctcatatgaataaaagacatcacttgtttcatacaggtgcttcataatggaggacagaggctatctggtggctcatccgaccctcgttgaccccaagggtcatgcacctctggagcagcaacacattacccacaaggtattccttggccaagagggtcagttccattctgtgacagcctggggtgtgttaagtgacgtgtgtcttctgtcttgtggccttgtcaggagcccctggtagcaaatgatatcctgaaccatcccaactttgtgaagaagaacttgtgtaacagcttcagtgaccggacagtgcagagatcttacaaattcaacactagcctggtggtaagctgtgtgcacgcgcctgctccttcgtggacagaataatgcccatgtgccttggagtcacagaaccgtgggctgagggaaggactttagtatgactctcactgtgataatcgtaggacaaacggccaggatggcacagggactgtctgaaggtcacagggttggtactctggtttgattaatccaccaactgtattagttatgggtcccgagagcagtggttttcaacctgtgggttgcgacccctttggggactcaaaatgaccttttcacaggggtagcatatcaggtatcttgcatatcaaatatttacattacaatttataacagtagcaaattatagttatgaagtagctacgaaattaattttatggttaggggg

SEQ ID NO: 1384 - DNA, 1000 bp, mus musculus
caggctggccttgaactccaaaatctgcctccctctgtctcctgagtgctgggattagaggtatgcaccaagtccaggtagtgtttacctttcttaagtctgccactttgctgtggtaactaacctgctggtctgagttcctctgaagtcagaaacttcagtctcttgcatttaccacctcatagtaaagcagtagggtattaagtaaaggattaatttctggggcctgagttctggggactgagtgagtcaggttccttctggtgggcgccagcacagggccattttgggcccaaattccgcaggcagtcccacagtctccagagaactccccaccccacaggcaccctaggacacccaggatcttagtatcactggtaagtggaacacaacatctattccaatagaactgagggtgtctgtggacagctggagcaggacataggaaccccgcccaatcagtggctcaggttccttctggtcatcactggtctaccttggtttagaactcagccgatagccccatagtccccagaggaggtaccacttccaggtgctcaaagggcccagaatcttaggatcccaagatcccaggagattggtcacagcaggatctctgggtcccagaggaagcttgactaccaagacttctgatacacccagaatctcagcatcacaggatcccagaatcacaggatcccagagacagttggactctagaaaaagcaagaaaatagtctttcaagaaacctaaaaaagacagcaacattgtcttagttagggtttaactgctgtgaacagacaccatgaccaaggcaagtcttataaaaaacatttaattggggctggcttacaggttcagaggttcagtccattatcatcaaggtgggagcatggcagtatccaggcaagcatggtgcaggaggagctgagagttctatgtcttcatctaaaggctgctagtggaagactgacttccaggcaactagggtgaggatct

SEQ ID NO: 1385 - DNA, 1000 bp, mus musculus
cgaaacctccctggagaggggggaggggagggaaggtcataagacaggaagttcataaaacatataagacttacaaagttgagaaagttaaagatttccaaagcccctccccaagttgtagaagttacaacctaaccaactgatggggaggaggagattctttcacagcgccacgtggaagttggaaggggggccgcagggatgcagattttatgatttgtcacctatgctggggtaaatggtttggtgatgtagctgcctctgagttgtacgtgctctcataactaactccagtaaactcattggttcactagtttttttttttttttttttgatctgttgttgatgctgcatctgaggtgaacagatgcttgtttgtgtctccctggaaagagtcatataatttgcatctgggcagagatcaacagaatcaaatgtgatctagggaggtgtgaggcagtggacaatgagaggaagcctggtaaggctgaggtagggcttgaagccctggagatccagaagggatggacggtaggataccaactccaggtccctgtcatgtagccacagtctcctatagagagaattgtgtccatcagtcatgtaggggcagcaccaacaagtccctcctcatgtagctatggaatcttaggccaagtcaataggaagcacctgccgtcagactcagctcaccccaaagctgtatataagatcctatccagaagaaatagacgtgtgtgagaattactgttttctatgggcatctgtcatgagagctgtaacactacctgggaagagagggaagagaatgctctctccaagcttttgacaccagaagctccccatatactgcacttacttgctagctagccctcccctgactcagcttggcttggttcagcttggttcagcacagccagtgcagcatctcagagcaacagcagctgtgggggaagtggcagcagcagcggcagcagcagtggggtgtaccctttcccct

SEQ ID NO: 1386 - DNA, 1000 bp, mus musculus
attaaagtgaccaaactccaactcaaagcacttggaggaagaacaagaggacaggtgggtgacctggatgagcagtttctggagcctgccacccaacctagcagtccacggaggcagccactccaaatagtgtctgtccaaggatccaatggcattgcctctgtctcttgcatcgtgaggctccactgttctctccttggcgtgtgtcttcagaagaatcctttgtgggtcaggaaagatatcctccagccccagctcatgtctttccaatttaggagtagtgagggcccagagatgcccaatggaaactgacatgggggactctgcaggactctctggatggtgagggcatctgtgatgccaggcagggagtgtgaggcatggccaggattggcatgagctcccccaggcatgtgaaatggatgcctgacaagagcgtcagttaggtggtgagagaagatggtatgaatgggtctcaggagcattgcattcccagcacccatgatgagcagcagccttggagagatggcctgggtgtgcaaagctatgattcctgtctctagacaggtgactggtacagaaccaagaagtacatttgcaaaaagttggggtcaaattgtccaacagtaagcctccgacagaaaggctttcccacagcctggctctctgtaaaggaagtggctagcacagtggttccctggccctctctcacccagctgcaccaaactcttacaattttggaacattctatgccttttttttggtctcagcagagtgtcttcagcttcatttccctgactagaattgaaccgtgtggctttaatacctcagtacagatcattgcctctgagaagccttccccagctaccacctctccttggcatgtgtcttcagaaggatcttttgtgggccaggaaagataacctctagccccagctcatgtctttccagttcaggagtagtgaggacccagagatgcccaatggaaacagaaagctgt

SEQ ID NO: 1387 - DNA, 1400 bp, mus musculus
tgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagacggatttccagagtggttgtacaagcctgcaatcccaccaacaatggaggagtgttcctctttctccacatcctcgccagcatctgctgtcacctgaatttttgactaattccttttaatatgtgcttatcatactccagcaaaagctggtatgggatgctattgatgccaagaatattctgtgaaactttcccccctttgatattatatattgcctgtgatggctaatcttttgtgtcaacttgacacagatgggcagagggagactcaaatgagggattgcttgtatcagattgttctgtgagcatgtctgtcaaacattttctagattgttgattgaggtgaaagaacccagtccactgtggacagtcctacttctgggcacatggtcctgggattattacaaaagtaggttaatttgagcctggaagcaagtcagtaaccagtgttatttgctggtctctgctacagttcctgcttgagttcctgccctgacttgctttggtgatatgaactgtgatgtggaagtgtatcccaaataagcttttcctctctaagtcgcttttgtttgtggtgtcatacagcaacaaatactcaagccctgcctctctgccttgttcttcttgggtttcactttgttaacctcataggtacttatgcattctgtgtggatgatgggctcttggacttggagcctggatctactctcagtttaggagtctggaataaccacaggctgtattcgccaagaatccacatttatttatttcttcgatataaagtttattagaaccgccgctatgttttgcacttcatatttatttagattgtaattatattgtacactatcagtacctttagatggaacagaaaggaacttattcctacaatcttgaggacatcattccaggtttcaatatttccccctattaatttgcaaacaatagtaactcttcattttgtagacaattaggaggatttttagagataccatctcagttaaattactagtctggtgcctgacatgtaaagagttctataaatgttagatattacttctatatataataatcactaatgtcttatatataggaaatgctaaatacatttctgtaatgcatttcaattatacgctttgttttagagttaggatagtttgaatctgctctttaatatgactttccctctgacccttaatatgatccaagtt

SEQ ID NO: 1388 - DNA, 1000 bp, mus musculus
gctcccctcacacctcctcccacattccccctacctttctcctctgagaagagggagcccccacagggtctcaccccatgatggcacatcaagtcactacaggactagggacatcctctcccactgaggccagacaaagtggcccagttagaggaacaggatccacaggcaggcagcagattcagggacagcccctgctccagttgttgggggacctgcatgaaaagcaagctgcacagctgttattcagggattggtggtggttaggtccaacccatgcccgctctttggttgttagctcagtctttgggagcaaccaagtgtccatgttagttgaattttttggttttcctatgacgtctctatcttcttcaggtaccttaatcctctcccccaactcttccacaagactccctagctccatctaatatttgactgtgggttttcccatctgttccattagctgctggttggaacctctcagaggattaagcataatagagtatgattaatagtatcagggactgatacttgcccatgggatgggactcaatatggggcagtcattgggtggccatttgctccatctctggtccatctttgtccctgcaccttgtaggcagggcacattttgggtctaagtgtttgtggctgggttactgtccttaaccttttaggagccctgcctcactacaggaagtagccatttcaggcttcatgtcccccatagccaggagtctcagctagactcacctccatagactccctctctgtgtccctctatccctgtccaaggtctctggcatgccctcgagatgccctacccctaatcacagcctatttccattctctgccctactttccctagacactgctatcctgataccctgctccatttcctccataatctcctctcccatgcatttctctatctccatccacctccaatatctaatttatttctccttctgagaaagattcaagcatccacccttggacc

SEQ ID NO: 1389 - DNA, 1400 bp, mus musculus
tgagactgagtgtggagccagtgcccaaggtctgctcagggcacaggctcagactggaagaaaccagtgtcactgtctgggcatgggttcctgtgtccctggatcccaggggtcccagttattcccggtgttaggacagatattgtagcctctcctgtgatccttggcatttcagagaacctgggaatagggctccctctggatgttgtaggagtgggtgccaagccagcaccctaggtctattcagggcacaggctcagacgagctgtgtttttattttatgttattttttattacctttatttttattttactttttttaattaatttatctttgacactccatattccattccccgcccccccttcaaccttcaatgctccacatcccacaccttctccccacccccacctgtctccacgtggaagctcctcccacctgacctctaaacttcctggggcctccattctcttgagagttaggtgcttcatctctgaatgaacacagacctggaattcctctactgtatgtgtgttgggagcctcatatcaaccagatatttgctgtctgtttggtggtccagtgtttgagagatctcaggggtccagattaattgagactgctggtcctcctacaggatcacccttctcctcagcttctttctgccttccctaattcaacaacaggggccagctgcttctgtccattggctgggtacaaatatctgcacctgactcagctgcttattgggtcttttttacagttcagttgttacccaccttccagtctgccctcccatagttccccattcctttcctcttccaccctgtctccaagaggattgccccctgaacccctacctggcttcctcattccccagggcttcaggtctctcaagggttatgctcatcttctcatactgagaccagaccaggcagtcctttgctgtttatatttcggagcctcagatcagctcctatatgctgcttgattagtggatcagtgtctgagagatctcaggttgcccaggttagttgagactgctggtcttcctatgaggtcaccctcttcctcaacttcttccagcctttccctcattcaagaacagggatttcctaacttcagtccattggtttggtgacagtattcttatctgtttcagtcagccatgtgttggacctcttggaggacaaccatgctaggttcctttctataagcacaccatagcatcagtaatagtgtcaggccttggcgcctccccttgagatgaatttcaagtacaaaagagcctcatgttaaaatatttttaaatcatgaagaatctagttatttggaattactttgacctggctatcagaagacttatttttcccattcagtataatcttttatactgtca

SEQ ID NO: 1390 - DNA, 1200 bp, mus musculus
aggaaaaaagtttgcaccctgtatacacagaatgaaaagggcaaactactgaggattcttgtatcaaaaatggataatggatattgaggaagagagtcctgccatggagactgaagactatcaaaagagtaggaagaaacctgagtgtagtatcttatgcctgtagtcccagcacgtgggaggttaaggcaagagggttgctgtgagtttgaggccagcctaggttacagggtgagactgtttcaaaaaactcaagacaaaggctatcaggattaccgagggagggcagctgtgagatggcacaccaaggaaagcatacttaagtcactgtgccatggtgacttttggatgtcagtgtcatgaaggccataatacagcaggactgagtagtgaccacagcatagctggtgcccgcatcaatgttctttccaaaggttttctgggggaagaggaaaaggaagtaaacaggtagacagagggatggggaaggtttggggtagtgctcatctttttcagggaaagacttgagttcagaatgtgtaggtcagactggaagaggccctgcaagggaagagtaccaggtctatggtagaacagttgccttgtgaacaatggcttgcttctgaaacaaataagcagagaccatgttcctgcaggtacagcctctgtgttctgtctcaccccactgcctattctaaaaatgctgtaatgcttcctctttctgaaacatctgtgccattaagaactgtactaaagaaaaaccacacacacaaccacccacaccttttcaaactccctagagaggactcaacttcagattccagccaaggtgcttcctctgagaaacctgtatggctgtattggcccttcccccattgcccctcacccaaactttgagcacaacagtaaaacctcagggcagcattaaaggaaagtttcctctgtagctccaatcctccctatcctcccagatgattccccaccccaccccaccccacctcacacccatcagaaaatgggcatatggtgaagcagatagcatgtgctctgactcgtgtctttatgtccactttgaaaaggcaatagattgatcaacaatccaaatagctggaagaagagtgcttaaacatggtaattcccttatgcaggtaccccctacagggtcagctggtccaccttatgaactagtttgtctaaggt

SEQ ID NO: 1391 - DNA, 1000 bp, mus musculus
ccttctggacagaacactatgcgagaaaagatgagaggactctggcctggtgtgcatgcctggcatcccagaacatgggaggtgggttaagagttcaaggccagcctcagctacataagttctatgccagctgtgctacacgaggcactgtttcaaagcagagaaacaaacagaggggacatttgcttttagctatcatggaatatggggacaagttttatcttccgaacttaacacctagaaaaatatatgacacaatggtcttcaggaacaaacacagtgagccccaaaggaccttgctgacagcatggtgtcagcgtccagcctgcggtgaggacgggactctaaatagggcttagaagtctctctgagtcaagcaaacacaccatcacttaggaaggccacagagcaactgacaggacacattacttcagatgacagagcaacagagaaagctctgaagatctgcaaagggcacctcccaaatctatggccaggtactgatctgtgcacacatgagaggagacacagaggctaagaaccaccacgaagaagttaaaaaaacaaaaaccaaacaaacaaacctagcgttcataccggacgaggagctgtttctattcccataaagcagggtggagatgcagtggggagagcagaatgtcttgctaacacaggaaggaggctttggcagtgttctcaggaggaggccactgcatcagaagcataaatggctcttgagaatactgctcaagacttgctaacactactacagcaagcctaaggcctactactgtttccaagtaacttagctaaacgtaccaaaatccagtgccatttaaaggattacaagatttagcacagaaaagtgtgaaaacctattacgtccgataattaccagaaaaatatgcaccaatagaaacaattccagatcttcgttcttcttcagtttcatatgttttgcatattgtaccttatatctagctatactaagtttctgggt

SEQ ID NO: 1392 - DNA, 1000 bp, mus musculus; identical to SEQ ID NO: 1391

SEQ ID NO: 1393 - DNA, 1000 bp, mus musculus
gccagccctgagactgtgggtgtggcagagccagccctgctgacatgggagagatgccctcccttattaccccttgacacctacagagggcaggagagctggttccaaggtctcctgagaactattcctgccccttgcctactgcagcgatcaggagagctggccctgcccctcacctgaggcagcacttgggagagcaagccctgccccatacctgggcagcacagtagagccggctctggatgtagggactgtgggtgagccagccctgaggggcaggagtacaagagagctgaccctgactcttgtctgccatgcagtggcacagatgagggagagataccttccttccttccctcatgccttgccacctatggcaggtggaaaagctggccctggggtcatgagagaggaaaaactggccatgtccttcacaagccacaccatttggaatagcaggtccttcacctcacctgggcagcagggtagagctgaccctgattgcagggggtcactggtgagccaaccccaagggcatgagaacaggtgactggttggccagctcagatacctctcaggcccacatccagggctttgaattggctaacgccaacatctaccccattgatgaactgctggagtacatgaagggctgggtccgacagattcaaagctacaggatttccatgacacagggcaacaacagtgtatttgagaggagtcccagtaagattcagtattgatagtgtagtaaaagccagagtgtccatgccagaccaacaactcattgcaatgaacacttgcaagcaaagaggtatggacaaaagggtttactgtggaacatattgtgacacactacagcttccacaagattttctttttctctggaggttgcaagggtggagagtgagtatcagggcaggagaagatgagtggggttggggtgcacgatgtgaaattcaccaagaaccaataaagagtttaaagaaagggttgacca

SEQ ID NO: 1394 - DNA, 1000 bp, mus musculus
gagctacctttctttacactcctcgtctcctcctgttgccatctctttcgtctctttggactcaacatctctttcaccaattctctcttcatcgcctcgcatcctaatgcctcagctcatttactgggatgcaaacatcagttatattagctctcaagaagtctgtttggttatttcttatatcttctcatttattctacagtctccttccatcacatatattttgcaagccttgtcttttatttaagaaccattaagcacagacagttaccgtagagttcctggtgacccagctataaccaggtcttgttctgttatctgtagcgtctgctgacctctcccccagtccacctgttctttatagtttgcctgtttgcgaacatgtgctgctcagtgtgccgaggcgtgtgtgtggacagaggctggtgagctgtctgcaaagggcactagagtcagtgttccatgttttgcaggctgcttgccatccctactctttcttttcttggtcctcgttctctttcttttaatcgccctaaacatttgacaaaagcaagctgtagctctccggcctgcaggatatcactctaaagggattcgtgtgtttctcagggagctggcgtgactcatgtgtgatttgcttttactgtccataggtaaccagaattcccagcaggcagctctgctctccctttacctgaagtagctccacagcacctcctcaccatcccctacacatcggcaaagacctccaaccttacgtttgccttggcttccaaagtgctgacttacagttgctgtagcagctcagttttgtgcagctggggtcgcttctgcaggaggggtcgccatgcttccctggtgccaccattacagtcagtttgtcctgattgcttttcttagagggtgatcaatattacccttttaaccttaaaaaaaaggcagggattcaatgtggtcacattggcaagaaaaacagtgggccccaagtggtttaaatgga

SEQ ID NO: 1395 - DNA, 1000 bp, mus musculus
acttgtgggtgtgtggctagtaacatctgttttttttttttttaaggtcagtggttacttcctagttcctatgtagtacatttgggccttggtcaagatcatggacaatcccaggagcatggccaaggcaaatgtggctgttagtaggggtagaagactggcaagtgaccaggcaggcaggatataacgttaggatggtatggtgtcacttcagtcatttcattaaccagaatcattcaataagtgagagctttctttgcagccccctaggaggaacaacaatatgaactaaccagtaaccccagagctccctgagactaaaccaccaatcaaagaaaacacatggtgggactcatggctttagctgcatatgtagcagaggatggcctagtcggtcatcaatgggaggggaggctcttggtcctgtgaaggttctatgcccaagtatagaggaatgcctgggccaggaagcaggagtgggtgggtgggtgagcagggggaggggggagaggataggggattttcggaggggaaactaggaaaggggataacatttgaaatgtaaataaagaaaatatctaataaaaaaaattaaaagagagctttctctttcccctgacagctttactaccatttgccatgttcttagaagctaatatggtcaagttaattagcacacaaactgctgctcccagggcttccatgatgaggaagctctgatggtgaaagcatcctagctgttggcaggagtatgaggaacactgctcagcagtcaggagcagatgaatgctggtgctccctggctctcttctctttgttcagagaaagctttctttcttctaggctacataacaaagactagaatggtgtccagctctaccactttacctttgaggaagcttgctctcctcgtttgttaggaggcactgccagtcttcacaagagtttctttaaggccacgtgaaagcccaggtgtataagaacttaagtactgaggatt

SEQ ID NO: 1396 - DNA, 1000 bp, mus musculus
tcttttttttaatgcaggatttcactacgtagttctggctgtcctggaactctctgtggaagccaggctgaccttcaactcagaaatatctacctgcctctgcttcccaagagctgggattaaagatgacatcgccattcctgtggaatttagcattcttgctgtcagtcgttctattagacagacagactgatagacacgtgactgccagctcggaatgacatttcccagcttcctttgcagctgaatgaactctcactttgggaagcttctcctcttccagtctgagttttcgcgtctataagacggaagtcctaaggagactcgctggttaagtaaggctgtggaagcatgtctcacagtcaggatacatagtaggtgctcgtatcatagaacaggtggaggagagcatggaccctgatgttcaaaagcagaaaattccacaggaagggggcagtgtgtgcaaatgaacagggctcatgggggaggaatctggagctgtcagcctacagggtagatggttggcaacacaggaagtgcttggtgtgggcgaggtcggaaaagaatggtcattgatagtgacaggctgaactggagccatggaggatatgagtcgggtggagaaggaaggacgatcacattaaggtgggtaggccagagctgagtagggcacatggagaaatgaggagctctgagcaggccgtcacacatattcaggtagcagcgagagccccagaaccaatgagaagatggctgaacgagtgagcgggccagcagagactaagagaggcttggtgcagagaagaatggagtacaagggctgacttaagcagccactctttgctgaacaagaatttgcatctgcattatttagatctgtgtgtggctttacgtgccatacagtggcatgagcgcaatgaacagagagcgtccgggactggcagtgttatccataatgtcagtatctaggccccgccacatatgactgtcattcatgggc

SEQ ID NO: 1397 - DNA, 1000 bp, mus musculus
tgcatgcccttttgggcccgagttatctcactcagactattttctagttcaattcatttgcctgtaaatgtcaggatgtccttgtccttcatacttcagtagtattccattgtcacatgaaccatattttcagtatctattcttctgtcgttagacatctaggttgtttccagcttctggctatcacaaataaggccgctatgaacatagtggaacaggggcccctgtgccgtggtggtgcatcctttgggtatattcacaggagttgtatagctgggtcttcaggtagatctatttccagttttctgaggaaactccagattgatttccagagtggttgtaccagtttgcattcccaccaccattggaggagtgttcctcattctccacatcctctccaacatgtgttgtcacctgaggttttggccttagctattctgactggtgtaaggtggaatctcagggtagttttgatttgcatttctctgatcactaaggactttgaacattttttttttaggtgtttctcagccatttcagatccctcaggcatgaattctcagtttagtcctatactccatttttaattggtttatttgtttttttttgttttttttgtttgcttgtttttgtttttgctttttggtgattaacttcttgagttccttttatattttggatattagacctcaatttgatgtgaggttactgaagatttttttccaatcagaaggttgccaatttgtcttagaagcttttgagtttcatgaggtcccctttatcaattcatgatcttagagcatgagccattggagttctgttcaggaaattttccccctgtgccaatgaattcaagcctcttctccactttctcttctactagactcagtgtatccagttttatgttgaggtcttgatccacttggacttgagctttgtagaaggtgacagatatcggtctattctcattcttctacatacagacggccagtatgttcag

SEQ ID NO: 1398 - DNA, 1000 bp, mus musculus
gttctctgtacctaagggcggtggggaagccaaggtaggctttatgaggggagtattagttcctagggagggtaccactatgttgggctgtggagttggtggagtcggtacggtcgggaccttcgggggagccggtacgactggggggccctgttctataaggaccttgttgggccccacgagtgtcaccgccggttctctcactgtcagtctgatcgtgaaaatgaacccaggatctcttagtggaatgtatattcgccaaccccacctattccctttaagccaacttaaacggtgttgttttcctttttcggtgaaccttataagtagagggttgcagtatttatctttgcatggtcctggggggctgtttttaaaagcgcatccattctctggaaaatcacttaacttttcttcaccaccccagagccctggatatttattggggtctccttctccttggtttggcttatcatagccactacctcgttttaccgtgattaggtcccagttagaggagggcttccagtaagcttcccctgtcgtttcacatgaccatttaccacaaaagtaatctgatgcccctccacactcttgttgaagctttttgttctgaccctgaccagggcaaacataaaattgtgcagctctaagattagctcggtagaactgccccgaacatccatacgagttccctatcccacccaggacacactgctgttcagggggtgggttgctaagatcagtatgaccggggaggtcccaattgggggatcctgccgctaacttacagatgtcaggtgtgagatcaggccaccaagtccagaggggatggactgcagtggttgcccatacaatgtttcccttttcattgagcacttcccaggactgttgaattggagcatgagggttatggttccctaagttcagggtggcgcctacggcgcaaacgaagcttaagaggattgtcagtggctgccactgtccaattgtcttcgtg

SEQ ID NO: 1399 - DNA, 1000 bp, mus musculus
accgatggtcggagtcttgagaggattgagatagggtagtggtgccacaaagactctttcactggatgtaggtatcttagatctttttcagtgagtgttttatttaggaaactgacccttctgttttccgggggagtggccaaatcacatcagtggtgcacctgccaacagcttccttggagcgatggatgtctgcccgtttggaggcagcacgtcagagctgatgttcaggattttgtctccttacagttcattgatacattccttgcatagtcctctggccatcaccaagccaacgggattctaatattcttttccctgatccacccaaagctctttgtaaattggactcagcaggagtgagtccagtgacctcataaatagtggaaatgattgcaaatcagaattcatatatgttctcaactcagtgggtatccttctcccccacaaaggaagcaatcatcgctttcaaatttctgtttgccctttcactcagccacgcgaggagaaaatatagagagatatcttgctgtctaagcccgaaaggtccacttctccaccctgaaaagatgcaagtccggtggctggcccagtttagccagttgatcccacctggggagtcgccagaaaggcgagagcctgcctagggtctcacagaaacagtcttctgtcaggcacctgggaaaacatttcgtatctaaagaagcagttttgtggtggagacaggtactttgatgtcagtctctgtctccacctccctgtccccagagtttctctggcatggaggtggagccaggtgactcactttggctcatacacatggctgaaagtgccaaggtcccttgcatgcttggctcctctgagctccttcaccatccctttttttcttgttatctggattttacagtgatcatcagagaacccggagcgcctgaaggatgatggagaaacggagccgggagtcctggggtgacctaaagcagctccccacctgccggca

SEQ ID NO: 1400 - DNA, 1200 bp, mus musculus
ggaactcactctgtagaccaggctggccttgaactcagaaatccgcctgcctctgccctcccgagtgctgggattaaaggcgtgcgccaccacgcccggctaaattctgtttttaataaaaatctgggcatcacccaggggtgtgtgtgtgtgtgtgtgtgtgtgtgtgtgtatctgtgcctgtatacgttaattccagcacttgggaggcagaggcagcagatctctgtgaggctgagttgaagccagcctgttctatacagtaagttccaggacagccagggctacttgataagaccctgatttggttttgtttttttaaatttgagatggcaagcagtatggggacagttcaggagttctgtgggaagaaacccctaaagcaaacaaataaaaaatgatcctaaggagacactcatgacatcaggagcccaggttaggggaaagagggcatccctatctgacccttttcttccatccatccatccatccatccatccatccatccatctaatttctctctttttttgggacagggccatgctatgttgacatagccttggaggaactggtgctttctatgtagcccaaataggtcttgaactctcagaacttcctgcctcagcctcctaactgctgggattacaggcatgtgccaccaatcctggaaacccttttctttggaatggtctggctggacaacccgtaaccataaactcaccggagagcatcccctggccatgaaggccctggtgtagtaggagagatggccaagttggccacctgctgcgaaatgtcactggcctcctcagcctcctcatagagtgtcttggcatatcggacaaggaagggcagcagttggcacacctccttacgcagggatgaggtctcctccgccagccaggcacccaggatccgcaccgaggcaaacacaaagggctctttctgcttctctggccccacctgtggtcacaagaccccagtgaaacagagctgaaccaggtaccctcctctgcctgccagtaacagaactcaagggaaatcttggcctgtgggcccattacttgtgggcaccgagggccggtgaaatggatggctcagtgggtacatgaaaacctaagtttgattcctgggaatcacagcgtgaagggagagacctgactagctctccaaactccacatgtgtgctgtggcatgcag

SEQ ID NO: 1401 - DNA, 1000 bp, mus musculus
aaagtctccttgggtcatacaagccccgagaactcaagaggtgaggtaaagtgtgtgccatcatgaacttccagtcagcctgggtaatagcagatgagaagctgaccattgtagagcccggggcctcacagactgccttctctcaggtccacagcttggtgcggcatctttccattgtatcttacctccctgcactggtcactctgcacgcttctagaaagtgctgctactcacccgggaaccccgccttggctgagagtagagctcgtcttgtttccaccccaccccacccttctagtagcataattaactgtgctttattgtcaaactcttcttaataaaccatcacccaagtaagggcaggaaccacggtgggggagggggatgtcttcttttgctcttgcttccttgggccctagcacggagcccaacacataaaggaatacttgtggcatgaatggatgagtgaatgaatggactgcctaggaaaacagagaaaacaaagaaagctattccagagctataacagcccccagtcacttgctggcttactgctattaaagagtattttacacagggtggtccaggatgggtgtttcttgtggactagtgagttttccttcccatggtgacttagagagccagaccttatctgtctgtagtttagccatcccccaaatgttctacatccagtacacccttgcttacattcctttggctggaaccttgtctcacagtacacccaactgcaaaggtggctgggagatgtagtcccacccgagcattcgcttgtccctgacaatcagcggtactgagtttgggtagggtcattatttggggtggaaggagtctctgcaggcatagtaggataattagcagcaaccttagcctctgtctcccaggtgccagtagcaccaatcaatgtgataacgaaaaaaaaaaatgtctgctctcgtggtcagatgtcccctggagggaaaaattaccctctgctaagaat

SEQ ID NO: 1402 - DNA, 1400 bp, mus musculus
cttctaggatttcatagaattgatcaatttagaatgccttcagtatacacagtgtcttggatgacaccattctctgagccccaacagtatgtggagtcctccagagcatgaccatgaaagaggtgggtatatgactgatacccgcattgtcttacactataccactagctgccatcataaacaaaacaaaatgttcaagtaagcatttgaaggcagaggctaaggcaccacctagagagtgggtggaagttgtccttaatgagatttttatcccttgagccagcagcgccttggatggattaaatcccttaactgactgagtccctatcattgaagtctatgaaccgagagaccgctgtcacctttatcgttaacgtcccgcctgataaatcaatgcctcctatctccaacgcgttagtctgtcaggataaagatcctagatctcagagagaagggagagaacccagaggccctgttcacagctgttccctggtagtgtgtgtgtgtgggggggggggggggactctcacagtcagtagccccaccggcaaaccaaggagactgccattggtgagataagctaccagtgctaacccaggaggggagaaagaagatgaggtgagtcataacagtctaagcaatgggaactagagcttaccttactctcccaattccccccacttagtccactccctgctttctcttgcatcagctttcctaatgctgagactgcaagcctgtgacagacaccccggctcttctcctttgaatacattgtgcatggccaccacggagaagcagtgccggctagtgagtttgctatgggagaagagaaatctgagcatgtgcaagaggggaagccataacaaagtctgtcgctggcccacccttactgctcacagctgccagagtatccccaagagtggcagcccctagccagcgcgactgagagcaagctgaagtgttgctcagttgtggcaaggaatcaaacacctttggagagctgtctccacactccagtggcaaatggatgccccagctcctgcacctttctgagcagatgactctgagataagtgttttgtgctgttgctcagggttcctcgcagagccacttcatagccgtcctctgtgataaaaacgtgcccctgcccacctcgattcccacttccctactcctgttatgcacaccccaaacaagctaaatttactggagtctttctctcaagctcagctcttggaagaaaccacactaaggcacgatggtttagagagagaatacgctgctattttcaaagatttctttctgttctgtgtgatgtttgtgtgtggtatgtttgtggtgtggtgtgtgtgatatgtgtgtgtggtatggtgtgtgtgtatgtgtgtgtgtatgtg

SEQ ID NO: 1403 - DNA, 1000 bp, mus musculus
catttttctttcttttttttcaattttttatttggtattttcttcatttacatttcaaatgctatcccgaaagttccctgtgccctccccactgccctgctcccctacccacccactcccacttcttggccctggcgttcccctatactgaggcatataaagtttgcaagaccaaggggcctctcttcccaatgatggccaactaggccatcttcttatacatatgcagctagagacacgaactctgtgggtactggttagttcatattgttgttccacctatagggttgcagatccctttagctccttgggtactttctctagctcctccattgggggccctgtggtccatccaatagctgactgtgagcatccacttctgtgtttgccaggcactggcatagcctcacaagagacaactatatcaaggtcctttcagcaaaatcttgctggcatatgcaatagtgtctgtgtttggtggctgattatgggatggatccctgggtggggcagcctctgaatggtccatcttttcatctcagctccaaactttgtctctgtaactccttccatgggtactttgttccctgttctaaggaggaatgaggtatccacgcattggtcttccttctagttgccttactttgttcttccctggaatgcaggtgctccagcgtgtctcagaagggactgcctgctggtgtaagcagcctccagggccgaatccaacttaatgtcatttgagctgggtatgatagacatattatatgcctgtgatctcaacactcaggatcctgaattcaaggccagctttggctatagaatgagttaagagctagcctgggcaattgaacatgtccctgtctcagaaaagacaggtgtagagacaagtgtggagcagagaacatgctcaccatgtaggctgaggtcatggttttacattgctaaggggcagagccatcctctgttccagttggttctgagtagaaccctctagaag

SEQ ID NO: 1404 - DNA, 1000 bp, mus musculus
ggacaaatcacactgcctcttttgaatatcggctttcttatctctacaatgctcataacataagcagcctctctgtgccctgggactgaatgtgccaaggcccattataacccgtggccttatggctgctgtgcaaatggccgttggtattgatgttactaggaatagtgaaagtgagcgtggggctcctgcctcggaccccagcaccacgcctgcaacagagaagctccaggctcccaagggctctatcatctctcagagtctgtgaccaaacaagggcagtgcctgatccagagaaagcctttcctataaggacagacagttcagacccagggacctgtggagcctgtgacagttgttgagctgcaggccctccccaggaacatccatcgagggcctcctcctgcggctgtctcctggcatccccaggcagaggtgctggcaccaggagccagctttttcatcctggatccttggggcttgtcctcgcggcgggtgcaggttgcaggaacaggcgggacagatggtccctccgcgggtccctccgcctcctcccacactcctgtctggaaagcgctctggcttggccctacctgagcctcttcctggaggagactcagagccaattgctgtgatcgggtcccctgaggacagagcggagctgctgcagggatgtggctggggaaggagagtgtgagggtgaaggactgctgggcagggtgcccgggccctgcattctgtgagggcatcccctaggctgcccatctctgacctgggtccttctgtcctttccgttttccccatcagagcatctgtggtgactgtgcccagggccagacggctcatccagccttccttctggagaaaggagaaaagggggaccagggcatccctggcgtgccaggttttgacaactgtgccagggtaggaactgggcagaggcaggctgggacaggagggctccctggtgtagaagggcttcctggtgcaggtcccgcca

SEQ ID NO: 1405 - DNA, 1000 bp, mus musculus
ccggggcatctcttcatctcccccgtcccgcgccctgagaaaggctctctcgacatagccccgtctcagtcactatgttgaccaggctggtcttgaactcacgcacacctgcttgcctctaactctcaagtgccgggtttaaaggcgtgaggcaccacgcccggctgggttggtactgtagagtccagttttgcatcagacctccgccacctcccgctcagcatcccggtgctctacactggttcctccttagagcctctcacacgctggaccagctatcactgagctacagcccagcccatcgcacgagttttccatcttctgtggagctggaaacacagattcggcccaagagcaattaaaacgaaacttcaagtaccaaacggtcaccgatgccacattgaccaaactccagcatccgagacgtggtgctctcgcgagagtggacgccaagcaatcatgtgacaggccaagatggcgtcgcccagggagctggacgaagagtcgccggtttacctggtggtgagcgggatccctgccgtgttacgctcggctcagttacggagctactttagccagttccgggaacagcgcggcggaggcttcctgtgcttccactaccggcaccggcccgagaggggccctccgcaggcgagtcccgaggcggcccgggctggcccggaccccgccgctgaggatccggttctcgcccaggctccggcctccgatgcccgcgctgtccgcgcccggggctctgcggcagcccagacccgcacctgctgctgcgtcgtctcggtgaggggagcggcgcaagcccagcggctgcttcgcatgtactccggtcgccggtggctggactctcaggggacctggcttcccggtcgctgtctcatccgcaggcttaggcttcccaccgaggtttcaggtaagggggagagaatggaccggacgcacggcccttggaaaagaggcgcattgcctgggtggttaagataggtta

SEQ ID NO: 1406 - DNA, 1200 bp, mus musculus
taaacagggaagatataaacaggggagatataaaaacaagggagatatatagagaaagaagaaataggactgaataaacgtgtgcagaaggatcctgtagcggcgtcgttcttgctggcgagttgggggcgcgctcgacagttggtgccgaaacccgggacaagaaacatcttcaggcacaagtgaagaacccctgctacagggaggattcagaactgcatcacggggaaggagtggttaataaaagttcctgtaaaacagactgttgagaaggatctggcgtggattcagaactcttcagctggggaacggtactggtaagtctcccaaattgatccctgggttaaagggggatatttttaagagaaagaagaaagatgaagactgaataaactgctgttagaaggactggtggtcgcgtcgttcttgctggtcgagagcagacgcgacaattggtggcccgtacggggaaccgactcccccaccgagttcagaactttcagcagtcagtggttgccggcagggtaagttcaaggtgagtgaaacttgcgaccccaggagtttgggaaggacctcggataaaatagaggcaagtataaagttgccaggaagcaggcacaaagtaactcagtatcccgggattgggattaggctctcggtaaagagacagtaaggctctcggtaaagagacagtaaggctctccggctctggagacaaggaagtgaaagtaagagagaaagtgaaagtaagaggataatagggacaagttaaggttcctggctttgggacaagttaaggttcacggttttgggataaattaaggaactatgataacctcagtgtagtgatcaatagatcctcgctgtgtagttatgcttttttctcccgttgaccctttgtgggtaggtctgatagttttggtcttgtttgttctgatatatggactctgttactgtttgaaactgtgtgtagaggcagtcaagacaggtcagaaaatccttacagagcaacaagaaagtatgtcggaagaggagaagggcttaaaaagaaaaaggaaaaagaaaggagacacagtgttatcaggtggacagaaaggacaggacaacagagctgaggcggaggaggaaggtgaattagcttctgctccccctccctatgcctcctcggcagccatctatgggcagaccttctgtccggag

SEQ ID NO: 1407 - DNA, 1600 bp, mus musculus
caggcacgttccactcaaaccctctgcaacctgatgccagaccctctaagcagcccacagagagaaggggacccttggctcaggccaggccatctattcctctctaccctctttccctggctgaagtggtccagggagaccttcccttgggccatgttttgtccactgaactgacaaggttccctggggggggggggtgacgacggacatgtctggctctgttgctgtactaagagccttgctgtaccctccccaaagcacctctgaagtctgctcagggtcactgtgccagggatggagaccaccccttgtgtccctgcccgctgttcactgtcgctggggacctaccacagtgccgttgggcagacagatcatcatctctacaggaaagctgtacttctccaagtgcaggcctgccagctgcctgtggagtgggttctcctgctgggtctgtggagacaatgatacttcctggtatctgggcccagtgctgtcgtggggactcccacaggccgctccccctgatcccttgctcacctgcaggtcttctagctcctttaccagggaccaggtactgatgaagctctcattgaggagagtgaggatgggcgggctttccaggacagtctcccggagagtccgcccggaacctgttcagggtaaggccaagggtgagtagccctgattttacagcaatgacctcagcttaggtaaattccgtggggttttggaatgtctccacacccaggtgaagtaacaggttaaaagagtagacagaagctaggagtggtggcacacacctgtatcctagcactcaggaggctgaccacaaattcagggccagcctgggctacatggtgagtgagttataggctagcctgagctacagactgagagcctgtctcaaatgaaaagccaagaacagactctcaaggagtagatgctgaaggaggaagttgtaggatcagcatggacaaactggcacgccgagctgcagctgggggtggcccagggcctggtcacagtgaccgattctctctctctcttttctttctattttcttttaaataaaaaggttttttttttttttttttttttttttttttttttttttttttttaatgtgctcggcgttttgcctgcatgtgtggctgtataaggacatcagatcctctggaactgggaatcatagacagtggtgagcttccacgtgggcggtgggaattgaacccacgttctctggaagagcagccagtgctcttaaccactgagccatctctccagtcccagtggcagattcttgattccacttcgttctctgtctctagggcctttacacaggcacgttccactcaaaccctcttcctcctgtcatgtgacacaccactacgccacctctcaccatcctaggttaaatgtcactttctccaagaggcctcccagcttctcttctgttaccccactttgccttgcacacagctcgctgccctggggttacctgccctgcatgtgtctacaccacactgggataatgcgtagctacggcagggacccataatgttggctgggtgacaagattaaggcaggggcattgcttatc

SEQ ID NO: 1408 - DNA, 1000 bp, mus musculus
ggaccactagagcattcttcaaagtctcagacctgccagaggcctgtccgtcactcagggtctgcagccccaggctccttccaggagatcaaatgtgggaactgagttctctctactcagccatgctttctgaggctcccagactgcttaaataattcatggtcatctctccccgcaaccacgctgtgccctaagggccgggagtcagtgcgctctcgttaacgtcctgtttactctgcagagagcagcagaaagagaagaacctaacccctgacagaggacgctggccagagccaagggcagacaggggccaaggcgaggttagctgaactgcaccgtttcatgacacagagtctggtgccagggagccgggtagagaaatctcacccctgagatttccaaacccacagtttaagaggtccatggctctagatgcttttataagcactgctatttctgggcagactcatactatcaggtggtgcttagagagcatccatcccctagtccatgcgtcgtccatccacgtattcacatcgatctacccctcccccactgtatccatcctatctgctcacatcaattcaccaacatccactcatctattcaccaacgcatccacccatgcgtagctaatgtgccgtctacccatcagctcatccatgcatggatccactcattcaactgttcctatcaatctatcatccacgtatttactcgtccatccattggcccagctctctaccccccaaacacacaccgactcacacacacatctgctcgaccatttgaactgttcacatgcatccacccactcctacatctaccagtccaggtgtccatttgtccatccttttatctgtcggtcaggatgcccataccagtccagatgtgtgtatatgtgtggcccagggagtggcactattagaagttgtggccttgtttggagtaggtgtgtcactgtgggtttgggctttaagccccccatcctagcttcctg

SEQ ID NO: 1409 - DNA, 1800 bp, mus musculus
ataaaaagttgctggtcagtggggtcctttagactcccccaaatgttagaggctattgctatgggctaccttgcagacttgctggtaagactccattgctgaagaccccacaaccttgcattctataattctcgaatatggtgcgatcaagctggcaccgccttggaagcttcacccctactgtgtagctttcatggtcctgggaggtgccatgcacactatcagcgaaggaaatcaatcacttctgcacgctgtgtgctacagccacaactgcctggcaatagagacccggtggcataatagtggcattacccttatgggagtaaccaaacactttctggttggatttgaatcctgcgccacaaagctggactcaagcccagtactattcactgggccgacaatctgtggctggctaggccagagccctaagggagaacctagtactagtaccttgttaagtgaacagctttaacggcctcctaagtacttatctttgtatccatagattcacacatctctcaggcctcgtcagagaggcttgcctgcctgcttgcttgcttgcttatttattcatttattcatttatttatttatttatttgtttatttatttatttatttacaggagatggcaattaatacagagagccaagatgtcgatacccctcacccaagggtcagggatcatttgggaagagctggaaatcctataagagccagacagagcagatgtccatagcaaaacaacttgccagacatgacagggccattgcacacacgaattcacagtggctggggtagcatgcgtaagaattcacagtggctggggtagcatgcgtaagaattcacagtggctggggtagcatgcgtaagaattcacagtggctggggtagcatgcgtaagaactgcacaagaacaagccagaaagactgcagcatggcatcacacccctagctaaggagctactggcaactgatggctgccagaggaggagagtctgtcctcggcagagatgctgtcccctcagactctagcctgaacatcccgtcctgtgttgatggcactgtttatggacataagcttatgtgacctttaggagatacacacggctttgctggaggaagtgcatcactgggctttgagggtttatagcattggtcaacttcctgttctcactctcaacttcctgtctgtggctgaggagcagtctctcagcttcctgttctggcctctgactgccaagcctcctaggccattatggacttttgccgtggaaccataacctcaaataaactcttccctccatatcttacattggcttgtatggttttatcacagcaacagaaaagcagctcacacactgcacacgctccagtagatgttcctaccctcaggtaaacacagacagtgctaagtggacccggcaggttttcaaaaagagcagaggacactgggaaggacaagacgggaagaattggaggcgaagggaagaggatggggttgagcaaacactataggcatgtaagaaattctcaaacaggggctggtgagatggctcagtgagtaagagcacccgactgctcttccgaaggtcaggagttcaaatcccagcaaccacatggtgactcacaaccatccgtaatgagatctgactccctcttctggagtgtctgaagacagctacagtgtacttacatataataaataaataaatctttaaaaaaaaaagaaattctcaaacaatacaaaaagagattaaagagcaaaaccggaactggtgtcgtagacagcttggtt

SEQ ID NO: 1410 - DNA, 1200 bp, mus musculus
aaaggcacaacccttcttggcagggagtcgccacaagctagagcttgaagcagctcattacctccgatccactagaaacagatggatgatcagttatgctcagctcattgtctcctctgtatacccaacatccaaagcaaggaatggtgctgcccacagtgggcaggtcttcccacctgttgggtaacagatgctctttaaacaggaaggtaaacatccccaaatagcttcaggaagtccctaaaattgaccagatgcactaggcccttccctgccagaggaagctgtactaagttgacagtcctgatctcacagaaggaagctgagctgctgtgggtttgtgttggacgtgggagtggagatgcctgaggcattgtctgagctgagatgcagacccctggtcatctgcaggtaggacctacccagagcctcaggagtctgcaaaaccttggaacttaagccgatgctgctgggagtgtgggaacttagactggctggggaattatgacgggtcatcctggagcatctgactccatgacattgtagctgtctttgaagtacaggtgtctttctgtatgtttgttcaattatatgacactgaggtagcccattgtattacatcttacactgcaaagtgaccaccatcatcttctggctccaggtcagggattaattaattaattaattaattttctggactaagatgctatatctcttatcacttggccgaaaggatcgggcaagaagacagggagagagagagtagagtaacccaggcccaggaaggaaagctgggtctagagaatgcttgaatgagactgggcagaccctcagaacaccagtcattaaacaggcctgagaggtgtgagttgggttctcctccagtgagcctccaccaggagcatcatcttcagcacctcattccacacctggaaccttccccaccccacccccatcggtcacccccacaggccaagctgtgacccctgtatcctctcatcagctgtcaggcgcttttcttactttatttgtacttatttagtttgatgttttgagacagggtctctgggctgaccttgaactcatggcaatcctcctgcctcagcctttgaagtgataggattatggtaaagagccaccatactctttggttttttgtttttatctgagagatgtccttgtagctcaatctggcctcaa

SEQ ID NO: 1411 - DNA, 1000 bp, mus musculus
gattaaaggcgtgcgccaccacgcatggctaacctggcacatcttttaccagcaaccatttagagaatttcttgaagccctggaggtagatgttatgtctcctttggagctcaccctgggggttttggcttaatctgaccaactggcatggcctcagtttcaccctgaatggagaagggatggggagcatgccaggcaggcaggcctggcattgctcagctttgaggtgttcccgggagccaggcccagtggcacacacagccgtaaacatagcactcaagtgaggggagtgggagaccatgggtttgtggctagcctgggctacatagcaaggtcactgcctcaaaaaaaaagtggggttctctcaggaggatacacagctgttccctggcatatacaaagaaagatggccaccatgggagagaacccctgcttagagggatccccatgtccccagcattgcaccagtcccataagcaaagccttggcatccatcaagaccagtcacccctgtcgagagccacggcataaagctgtggctctccactaattatctgtagccggttctcagcctttcctgtctagacacactttatgaaccaagtcatttgctcagacagtggtgttgcctggtaacacggcccacatcccaccttccttgggtctgggggggcggggcaggcctggactttgaccactgagaagtgattgatcagtatttactcggcttttgtgataagccaccaggaagcagaggatcctgggagtaaggacttcccagaccccacagttgttctgagggagaggggctggacctgtgcctctgcagaggggaacagaacatggtggtctcaacccaaccccatgcctttgcccaccctagccaggtgctccccaacccatgcgtgtcttggatatgacacaaatgccacatttgtcacggtagataaaggatttcatggacttacagataacgcatgggggaagccgaggcaggagg

SEQ ID NO: 1412 - DNA, 1600 bp, mus musculus
aaatcacacattggcgacagtttagttaggtggttaggagcctgggcttcagtccgcaaggatcggggtggggcagggatggggtactcaaaaaaaaacgtgtcatggggggagagcacagcagggtccatctttgtcagtagagtggtgtgaatatgggaaccttcttgctgtgaggatgagacagaacagtaacttaggaaccctaaagtctgaggaaggaaagagagcccagaggggagagatgttgcagagaaagcagtaacagtgtgccatttccccaaacactacgtgactcttgaatgtaccacctgccaggctgaggttgcctctgaaagggcttccccaacctgccctcaccccatggggcaattgggcatcttccccactgatcttcataggccacatggctactttccccagtccccagtagaatgcttcccagacctgccacccctgcacctgagctcctcggaaggcagataccacctttgaattccaggaccttcccaaagttcagtgagccctggctttcaatgaagtccctgagaaaatggcagcaactcttggctctgggagcaacggagccttccatgacttcacgctcagctctcgtcacatcctgactctgatactttccagtctcctgtgactttgagaggttgacttaagctgcgcgaggaccagcagtctggctctgcatctctaggataaacagcacaatgcccagcacacagtaggtgctcaatacctggtaatgggtgtttacaaactctaccattggcctccatctagcagtgagaaacatcttggatagtctgtccccaggtgtctcagtcacttccctgttgctgtgataacatgaccaaggcagcttataaaagaaagtgtttaattatagtttcagtctcagagggttagcattctcaattgcaacgcagagacaggatggcaagaacagctgggagcccacatctcagagctgcgttcaggaggcagagagcacacaggggctgtcaggaggctctgagacctcaccgtccacccccaacagcacacctcctccatcaaggccatgccccctaatccttccccagacgccaccaaccggggaccaagtattcagatagatgcccaagggacatctcattcaaaccacctcaccaggcaagcccctatccatctcccagagaggtcagtgcaacactttctctgtccctaacttgtacctagcctgggaagtcaccatctttctgaaagctcccctaaacagataagctgggtaccccactaccacctcataagctgagtgcatcctgagaaggacctgatgagcccgaccgctgttctgacactgctaggaggataccagggatgtgatttctgtcccatgtcctgcggtattctcctcgggctccctggttcctcacctcagtttcctgtgctgtgtgccagtcactacccatctgaattttaaggcagaacacatttaaaaaaacaaaacaaacaaaacaaaaaaaacctctgtctttttaactcccagatagactgctgttggtttccattatctttgcagaacagttggtggccatttttgtcc

SEQ ID NO: 1413 - DNA, 1000 bp, mus musculus
agcagccaccggtggagcatcctgtctgctacccacttccctcaactgttcagggaagtgaggcgcccttcatttgggaatcaggtgagtggaaaaggaggctcagacaaactgtgtggcaggctgcgtctgctctgtcactagcccaggttccatgtaaattggctagccaggccctctatcagggctctcttatttgtgtatgtggtagctctcagtctctgaatggggaagtgctacttgctgtctctctggaagtctggcagaaggaatccagagggaacaaaccatggttcacaaggcatgtgcactgttagggtcaaaagaaaagatcttctggtaaatcagagagtggcggcctcagcagagaccagcaacccacttcagccaccagggggtgcagggtaacggctgccactgcttgtggatgaccagggagcccaggtggtcattgccaaggtggtttggttctgatctgaggctgggatggaagggccagagcaaatgtcctgggctgactacaaacttgacaagaaggcctgagtgagtggagcctttggtgaggaggcagggagaggacagccaggggggtgggacaggtaggaggatctgatagaagctgagctcagtgcccagcttgtgtggggcccttgcagggctataggagtgtgtacatgacatgatgcccctttaggaagcccctctggatgctgggtggacatggaaggatgctgcacatgagggaccatgatgcccagggagagaactgcaaagaaacccacagcctttgcccaggcattggaaagcctggcctgcggtccggctccatcacaggtcacccggcctctctggttctctggtcttggctgaaggtatcatttgcaatgacagcagctttattcaaggctcaccatcctcaggcccttgtctctatatggacacctggggtgagtttttcctcaacttacccatgcatgaacacctagctacctacctacac

SEQ ID NO: 1414 - DNA, 1000 bp, mus musculus
gggcagagtccagctgcactgactacaccagacagcttctggccacccttaaatgacacaggaagcaggctgtggcccagccaccaggctgaggaactccagcctcagaggcagcaagcgtgtctggcttctgggtgccagaaaaacaaacaaacaaacaaacaaacaacaaagcctggcttctggatgccagaaaaacaaacaaacaaacaacaaagccagtggaggtggagaccggaagggcgggtagcaaggagctagggctggggccactgtcctcaagtgtctctagcttccagctctcatcagataggtacttggctaactggtctcccacctcaggaaccccagtgactctcccacagcttgacaacgctggtcagctgcttcctcatccaggccctaaacaaggccctcccacattagcccttacctgtcccctccagtctcaggtctcagtggctcttggcctgtcctggaattccgctgcccgtgacagcagggacccgattcagacctctgggccttggttcagatggtttgttctctccagatggaatcctctctcaatcggcaaactcctactaaaccttcaaaaccccactcccactttctccattgagacccttcctttgattcacatagtagcttctgggccctggctgcggagctttctaaaaaagacacatggaggttctgacttggggtgtggccactcctaagccaagaggttattttcgaaacagcacaggacacacacaaggttggtgacacagcccctattacaggggtcttgctcactagaccagaagctctgggacacactggctgcacttcatctccaggaagggtggtcagagtgtggcctagagcaagtgcctaacagctgcccaactaaatacagagcatgtccccgcttgggggtaagggcacagagctggggcagctgtagggacaggcttcaggtagaaggagggaagcatgcactaaaatcctttca

SEQ ID NO: 1415 - DNA, 1000 bp, mus musculus; identical to SEQ ID NO: 1414

SEQ ID NO: 1416 - DNA, 1000 bp, mus musculus
ccagcaccgttttgaaatggaaaccccaagtatgtgccctagtcaaggataaaatagggaggtcaagacaggagggttctctgtgagtttgaaaccagcctgaactacacaccaaactccaggccagccagagctacataatgagatccggtctcagaaaaaaaaaaaaaaaaaaaaaaggtctccatgctaataaaaaaacaaggcccactttaaagtcccaatgtgggctcactctccgcatgaactacagtgctgagtatccaacagcagggggcaggcgagtgccgcacagtccataggcatgtgccccggccagggggctcctgtgggggacagtgcactgccgaggttctgagtattgccaagaaaacagcagtctgtgatgtagccgcagatctgtggcagggaggttctgagtattgccaagaaaacagcagtctgtgatgtagccgcagatctgtggcaggcaggctcacataaacacaggacagcaaaagccagactatgggaatccctgaggacagccagctgttcctgaacagacagagactcaagagacccaaaggaaaaaagtttagccaggaatggtggaagacacagacctgtagccccagcacttggaagaacaagatccaagcacgaggctggggcctcactcatgcagagccccaggttcagtccccagccgtacataatcccggcatgctagcacacgcctgtaattccagcactcaagtggaaacaggacgatgggaagtttaaggccatcatccgctgtaccgtgaggatctgacagcctggaatacataagacttgaactaaaaaaaaagattcaaaaatttaaaactctggtgggcatggtaatgtctgcctttaatcccagcaatcagaaggcagaggcaggtggatctctgaatttaaggctagccagagctgcatggtgagatgatatctcaaaaattttttgtgaatatctacagctcctgatccaaacaag

SEQ ID NO: 1417 - DNA, 1000 bp, mus musculus; identical to SEQ ID NO: 1416

SEQ ID NO: 1418 - DNA, 1400 bp, mus musculus
ctccaggactactccagacagcatggtcttcagctctgggagtccagaccctggggcaagggaaaggcagtgtatacactctctcattctccccccaatgcactcccttctccagtcccactctgcttagcaagatcagagaaagtcaggcacatctccagtatggtttctctctctctctctctctctctctctctctctctctctctctctctttctctctctctcctcactgtgggggcccagactggaactggcagccagtcccctgcttctacttcccaagaactgctattccaagtgagtacacccagtacagacgaaaacacatactctctggcaccccccaccccccaacctcacacaccctgagaggaagatttcataacttcagctgttaggagagagagctgagggcctgggggtggggctcaaaggtggcagcagcagggtgggaacccagggattatcggaccaccgcttgagatacctgggagatcttcctgggctgaggctaaaggctactcttgggcctgggagccactgcttccctcagcccagccctgcctgacattttgagctgtgctcctgcaggtaaccagccaccaattgttttactagcccagaggaggctggggaagtcccctgctgcccctctccctttgtgactttgggtacatggtttgtctcttccaagcctggttccctactcatgtcactctttcctgccaccctcatgagaagcccccatgggatgtagaaagatttggacccatggggagtgcaggacaaggcaggttggctagggaggaggtgaccatgactcacctccagagaagggcgtaatgctctgtgagaagccggaggagaaggacagaagagctacggggtacacggtccaggagaggtaccggagcaggtggccgtccccaacttctctgtacagccacttgtgtgctggagatgaccagcagtcaggagccacccagagcctcagtgcagggggcagacactatggtgcccatttatagaccagaaaagggccaggccacccactgagaggacggtgaccaggttcctagctttgtacttgtgggacttcaggtcagtgacttgattgtgcctcagtttcccatctgtgcagtagccagtgatggcacctccccaaattccccaaccctgggcccctgaaagacccaaagggggacctagtgaggcagccaggtgtccagagaaagtgagtgttcactaagtaggcagcatggagggagaggagaaagacagggatggacagtagtcataagtaaagcctcccagaggcatgcaggatctctcccattgtgcagattggatgactgaggcccagaaaggagaaggaactttgccaggatcacaaagct

SEQ ID NO: 1419 - DNA, 1400 bp, mus musculus; identical to SEQ ID NO: 1418

SEQ ID NO: 1420 - DNA, 1000 bp, mus musculus
tgcagaaggcattcaaaagggatggggggtctggggcgtggctactcattccctccctgtaagcggggaaagtgctcaattctaccctctgctggccattggatgcactgcatctccgttcataactagtttttccaaattagatgttagacaggatgggcatgttcatacacgtttataatgtattcagaacacgcccactcctcgctacccctccttctctctcccacatcggtccctttctcttcctgtcccacttccctggggaccatggctctaacctgtattagaggttggggtacacctttaaaggaaggtgtttcatgctgaagcagactcacgagcctcttattggggtctggagaggagtgtgccacaaatacacaccccaaacccttcagcactttgtccagagccctgtggggcagcgaagagcccctcacactcaggctgcctgagaagtccgctttggtttttattgctcgccctgaaggtcctcccagctctaaggagggagggacttcaatgtctggccttgggcctgctccgccctggttcccagcccaaagcctcagagtcagcctcagccacagccacagccacagctccaccctggccctcaagtgtcctgcctgccctgtccttctgtcattgccacagagaagagatgcttaggagtggattcagccctcagaggtccctaccctggattagacctcagactgggcactggtaaccttgggtctccttgcctcagatctatttccttctagaacattcttgatggtaccgctgagacccactcagacatgagcaacagggtctgaatcagcttcctctcataaggcctagatggccaaagtctgggctgcctgctgactggccctgtgtggatgtatgtgacaagtgcttagggacactgggttttaaatttacatcctggctcagtggaggaggtggattttcagttgaatttaaaaataccattttatttttaaat

SEQ ID NO: 1421 - DNA, 1200 bp, mus musculus
ggagtttgatggatggctatgtgtgagtggatggagagataagggggtggatggatggatggatgagtggattgataagtaaatgaattgaaggttaaatggagagaaaatggacgaattagtgattcaatcagctgaatgaataaatactttggtaagaggacagatgagtggatggatgaatgggtggatggatggaagaaagaaaagatggatggattgatgaatggatgagtagatggaagaaaggatagatggattgatgaatggatggatgaatggatgatggttatgtggattaattgaggtaaagtagatagactggacaaattagtgattaagtgggctggatgaatagatacactgataaaaggatggataggtggatggatggatattaggagtggaggagtgtatggataggtcggtgggtgcatgaatgggtggatagatgagttggtgggtgtaaaagtgctcatgatgccctggaagaaaccaagagacagaagcaagtgagaagcacaatgtcaacatggtatttgatggttacaagtggtggtaggcacagaaggaccaatgatgctctacggaacgtttgatttaaatgatcccacaatccctgggcgaatcaccagctataccttcacttcatcaaactccatgcataagtgagggacggaagagctggcccctgaggaagcagagaaagcaaacaattttctccacaagagacacaagaaggctcctgtttctgagatgacaagttgtagtctgctaacacaggatcggaccatccagctccaaagccatattctatggttttccaatcctgtagacttgtcatgtacagagtctgatgccacagctagcctctaacatcacctaaacgcaagggtttgctttctgcagtggtgtgctgagggaaccagctcttgccagcctgaagcattatgctttcaggacactgagagtcagtcccttggtggaataattattataaattaaactatagaaacttgcaatgtaatcatattaaggacaaagttaataagtgcccaaatatatcctctgccaattattttactatgttttaccatcatcttcactctcaaggaatttatatccatttcatttgtgtggagggaaatactgtgtttcccaagtccatgtacagtatagccacattggtactttgtaact

SEQ ID NO: 1422 - DNA, 1400 bp, mus musculus
gaagaattggggagaggcatacagagtaaatacaatcgagatacattgtatgggtgtgtgaagttatctgaaaagaataaagatacaataattttaaaaatagtaacattcaaaatgtcacaaattatatttaacataaaatttactagctaaggctatttaagtgtgcactccagtgacatcagggacatttgtttttttgtttttttttttttaattcttacagccacccagctccagaaatgttttcatcttatataagtgataccctgcactcatgaagtgacagtttccagttccctctgccaggccatggcaaccacccacaattctgccttctgtctttgtgaatctgagagttccagtcatctctgagcatctgtcttttggagattgcagagctttgagtccacccagacaggtagtgtccaacaaagcagttcacctcgtggtatccatctaagagaaagagagtaccacactgcacgccttctcctctctctctctctctcctgccccatctaagtctcaccctggcctattggggcgggtcctgtgtcccagaagtgtcccccatcaaatggctaaactagaataaccattggaggtccctcacacgtgtcatcccagcactcaggaagcagaggcaggtggatctctgtaaatccaaagccagcctggtctacacagccagttctgggccagccagggctactgttaggaccttgttgcaaaaacaaacaaaaccagaagaaaatcaatgagttggatccaggagagcattgccattttgattatataaatggtatcctcttaatctggttatctttaaagctgagcacttgcaagtgaacttgacctctgtactaagatctggaagggctgtgcccagcaaacctgaagaggcagcactgcaaaggagcctctgctgagaagactgaagcttcacggcctggtactgtggggactggatcttaaaatagtccttcactcaaggtgcactaggactggagagagatagcccctagccaggggtgtctcgtactggaaaaagtcgtggcaggcatggcaaggcaaaaactggatgcgtagaacaccctctctatatatatattcttctccaggagcagctgtcaaaacaatttaggggcaagattgacagctcattagaatcccctcagccgagtggaattcagactactttccagcagacagagcgaaagagaggaagcagccgccctgggccaggaggctcaagcttccagacgtagttaacattaacataggcatgacgatggacggggtcagtgttcacagtgggcttgtcatcacaagtcacagatcctcaactgcttcttataattgactgtgatgaaatattacaattgtcctcacaggag

SEQ ID NO: 1423 - DNA, 1000 bp, mus musculus
ctggaggcacttaccccacctccccctctgggggaactccacttggccatggaccccaaaaacctctgaattcatttatttagacttttggacatctgcgtgtttccctctgaaaatgttaagagccgtgtcccgcccaccccacagcctgtcagtccagcctgcagagagattccttgtaattccgaaataaatagaattggtagcaagtgagtgctgagtgatgtcagggtggccccagcagtctctagaagagcactgtgggacagtctcaaggtgtcttctgatgggtgggcactgtgcagcgtgtggcagtgtgaggctgcctacagtttgtccaggaagttgtccagcgctgggatgtcctctttcaggcccttgcgcttgcgggtctcagctaccgcttggctggggcggctgctgttgtcaaaaggatccccaagcaggatctgccagtggtcaaacacgcactgggggaaggcctggccgccagtgttggatcacagatcagcggtgaagccaaaagactcattgacaggcaggtatgccttgaccacaaacatgtgggtaccagccacctgggactcctcaaacacatggccacgcttcctgttcaggacaccgtagatgccacccaccacttgctcaggacactggatctcctccagatagataggctccatgaggcagggctgtgcggtcagcacactggcatagaggcagcggcgtgctgtggggatgatctggccacctccctggtgaatggcatcagcatgcagggtcacaacatgaacatcaaaccgcacaccacgcatgttctcctcacagagagcgccctccttagtagcccactggtagccagccaccacactgtccttgatctcattcaggtactgcacgcccttggtgatgtcggtgagaatgttggggccagtgccatcagggccaaagcaccagatcttgcgggcttcagcaacgtcccactcatacttttcgacca

SEQ ID NO: 1424 - DNA, 1800 bp, mus musculus
aagcatcaataattttgtgtcaccttaagtagggtatcatccctgaagattgccttcagggatgtagactcagtggtgactgcttggggtaacaaaatcttcaggaatttaagcagttgactctaggttctaggattctgacattctccattccctactctgagatttattttcatttgcttaactgcttgattttatgtgtatagttttgatataagacaggctatcaagttcccaaagctatcaattaacactgtagcagagcatgaccttgaacttaaggatcctgctgcctttcccacccaaatgcaggaatttcagttacagtgcactatgactcatctgtatcacaatatctaagaacctttagacttcacacacccttttctaaaagtggcttccagtcatgaccagattcctgaatccccacccagctcatcttccaggggtcctagatagtctgggaattgattgcatcaaatgtcattcaaaggtgccaagaactagggatgagatgaagacaaaaggccatacatgtcgtgccccatgagcactgactgctgatactggtccacagtatcagaatttgggagaagaaagacctgcctggcctctatgagatcacgtttctcctttgagtgaagagcaagatcagctgttattagacgcgttctcacgaccggccaggaagaacaccacagaccaaaatcttctgcggcaaaactttattgcttacatcttcaggagcaggagtgtaagcagcaagagagcaagaagcaagagagctattgcttacatcttcaggagccagagtgcaggaagcaagagagcaagaagcaagagagccgaaaagggagaatggcgggaaccccgtcccctttaaggaggagttatccttcacttaggacgtgtcactccctgattggctgcagcccatcggccgagttgacgtcacggggaaagcagagcacaagtagtcataagatacccttggcacatgcgcagattatttgtttaccacttagaacacaggatgtcagcgccatcttgtaacggcgaatgtgggggcggctcccaacatctccccctttttcttttaataagagcaaataggccacccatattaatgagagtggagatagaggtcaaatccccagtgtgtaggtaaaggagccatgtacaggattagctcttaggcttacaggcttttacccagagcaaccctgacctgctcccgtgtcgttttgcctgggggaagggaactaggacactgaaccttcatgaaagatgacatgtctccctagaataggctcatatatgccgcagagcctttccattgcagtgcttagccttgcaactctctcgggctgctgaagcacactcactctatcccgtgcaatgagtctagcctcatgggatataagagctgagtggccagcgacctattgcctaagcatagataaccatatatcagggggagttccatgttctagtcctgcaagcgcctgggcaataaccaccttgtctctcctagtttaggccttaagcttacagaccaatcaaagaagcaacactaatccacagcaaagtgtatctccaaataatattaatcccacccattttttaaagaaagaaaatgctgaggagatccaattgggtaatcctttggtcagcgacaggtccaagcgcgtggagttgacctgaagtctcaattctcgaaggatctgttcaaattcagccatccaattctgtaacatatactgaaaaagactttttgacaatttagctgccctagtaaat

SEQ ID NO: 1425 - DNA, 1200 bp, mus musculus
tctctctccaggtattcctacctaaccttaacttttcctcgggttcaagacccttggaaaggcctgtatacttattttgtgtaccatatttcctctttgttcctactctctctccccgctttacttctgatagcttgtcctgaatttcctctagaattttcagccctatcttaatcacttgataacatgtaaaaaggaacaaaagggctcctaacaacagaaaaaattcaaggccaaacatatcttgaaaagccattttccactttacttctgatagactgtcttgaatttccttagaaagttcaagatcagacttatcttgtaaagctatacttacgggttaccgccgttccccagctgaaaagttctgaattcacgcagttgaatccttcttaacagtctgctttacgggaacctttattaccgcaatccgcagttctggttctggaatgagggatcttccttgcgctagtcccgagttttttctcgtcccggaattcggcaccaattgttattagacgcgttctcacgaccggccaggaagaacaccacagaccaaaatcttctgcggcaaaactttattgcttacatcttcaggagcaggagtgtaagcagcaagagagcaagaagcaagagagctattgcttacatcttcaggagccagagtgcaggaagcaagagagcaagaagcaagagagccgaaaagggagaatggcgggaaccccgtcccctttaaggaggagttatccttcacttaggacgtgtcactccctgattggctgcagcccatcggccgagttgacgtcacggggaaagcagagcacaagtagtcataagatacccttggcacatgcgcagattatttgtttaccacttagaacacaggatgtcagcgccatcttgtaacggcgaatgtgggggcggctcccaacaatcagcagctacaatcagctgagcaaagatgctctatggctcagatccaggggcttcagcccaagctggatctggtagagatgaaacagatgtggaagaggacatgatctcctctgatgagaatgtccttgtgaccaagttctacttagccactctattatcctttagaacctcagcatcataggaagctgggctcccaagtgagagcttgccaggaagacctggttagagtgtcaatgtctttctccatgtgaactaccccagaaa

SEQ ID NO: 1426 - DNA, 1200 bp, mus musculus
tattctgcaccatttccctctttttgcctaccaaagaagctaaacaagaaggaaggtacaagtgaggattcttgaatctcacttagaaaggggaatgaaatagtcctaagaggcagatggagggagagacctgggaggtagtggggaatgaggaagggaattgggggatggtggtgttatatcaggattatgtgtggagaaggacaggagagataactagatggccatgaaaatgaatggaaatctgtaactgaccaaggtgaggaggtaggggctatctccaggagaagacagagacctgggataaaggaggcacccaagagtcaatggggtgaccttatctatgactcacaacattgggaatatggaacctgaagaggccacctcctgtaatcaggcaggaaccccagtggaacaatagagacaccagcccaaccacaaaactttcaacccaaaatttaccctggctcaagaaatgcagacatgggggatagaacagagactgagggaatggccaaccagtaaccagcccaacttgagacccatcccatgggcaaacaccctgacactattaataacaatatgttatgcttgcagacaggagcacgctgtcctctgagaggttccacctagcagctgactcagacagatacagatacccacagtcaaacagcttgggaactcttggggaagaataggatctgaaaggattttgggcctcaaaagggatagacactccacaggagtaccaacatagtcaactaacttagaacccctggggctctcagaatctgaaccaccaaccaaagaacatacatgggctggacctaggcctccctgcacatatgtagcagctgttgcctgtatatgggatctgttcttctagctaggttgcattgtctggcccctgtgggagaggaagcacctagcctcatagagacttgaagtgccagggtgggagaatgccaccctgctcagaggagaaaggaaagggtgatggggaaggattgtgggagggggtgactgggagggggtcagtgagcaggatataaagtaaataaaaagtaaatacaaattcttggattttctagaaaaaatatttctcccccttttgtctaaataagagtctcttcctctaacattaagaaactataaactatctggtaagaattgcatgcacaatgtctagtttatttgtat

SEQ ID NO: 1427 - DNA, 1400 bp, mus musculus
tttcaaatgatcataggtattttctgcagattgcttcaacagggatgttgaaactcacacaccaggcaaatgaaaattaggtggcttgagtagctcttaccagtctggaaattgcaatcagctggacagtccctcttgattctcattgcacatgttcagtagatttaggactcagtgcttaatgacttagaggtcattacccaaatctgaagtgacttccaggttcatggaaaaatttctagaagtacacaatgaagacacatcttaccttgtacccctcacacaatgattgtcttcattctataactatttatacacacacttcttgtctatggtacaacaagcatatggtgatggttgacaaaatatgtccaggtaaaatcactgtttgagttatgtggaagacagcatgtgtatattgataaagatgcaagtccttggctcaggataattaaccataccatgtttgaagaacatggagactgaagctcactggatttggaacattaactgtttgtggaagagcatcgtaagataaataataagagccacactataggagcctgatgggcatttctagaagaacttcaagtggctagattttaaggaacccactaggtctatgtcagtaccttgcagggaaaggacaattctcagctgcagggcaactgatgggacagcgtggggattggatacacatggagtaggtggaaagtgttattccttggttgtaattggttttgttacaggagaactctgaagaggaactgagggcctgaaggaagagagtgggatcaacagcccatccttgccagtaggagtctggagctgcatggtttggaactaggactagagaacactgcctggggactcacagtattgtccccaagttaagccttgtggaaattttcagtcaccagagcagtggcaggaactgcaaacaagaagacttggaaactccaaggtcacagtaactacaaggctagtggatggacaggcagtggaccatgattgaaaccccttactctgctgctcataagaacactgatcttcaaattctattgtgcatttcataactgtgtaattaaattgctgactatgtaaatgtgacttatcctgatttttttaattcatcttattgttgccagaatacttacataataatttttgagagaatgggattgtttgttggaaacatggttatatttctctggtggcaggttcaaagctcatacaattcgcattcatccatgttttttaacgctgctatttaatcactgtgctagtcaagatctttgccattggagattatgcatccactgggaggtttaaaaattagtcccataaggatcactggagttttcattgaattttaagcaatatttatcaatttaaaaaaa

SEQ ID NO: 1428 - DNA, 1400 bp, mus musculus
cttattttgttcgtcctgaaatgtcatgatattcccgataggaagccaggtgatgttaattcttttaactgttatcatcccaagggctgcaatggcttttcttaatgaagaaaaataagtttcattattttttgtcccaattccatgaaccaaattaataggaggatgattagtataatccaaaatattccaatcacacagggtggtattagagcaaaggcatgaaattgtaatatatgtccatcagaatactctcctaaatatttggtttgattgacataaacagtaatatctacagtctcatcccaagtgacaggatgaattataggtggatttggaacatatgcccaataaacttatgcagagctgcctcgatgtaacatccagataatgctaatcaatagggcaatcagctgtattcgatcctgtgctgtcatagacgttatcattcgaggttcctggcggtggcgttgaaaagaaagacgaaacatctgtctttaatattcccatcttggttttcagcatggcgtacacactgggttggcaaccacctaggggaaggtgtgtctgttgggaaaacataaacatacccacggccccataaaagtacaggatctgggctgtgtaatgagccgtccatcggatctttccaataaactaaaggttttgctttgtcttcgggatgccagtgcctgtcagctgcagacaacccatcagcatccaaagttaaaaaatttaaagtaaacaacgtatgagttagaaagatgaattttatagtaaccacatttagccaaaacaataggatccaaaactaaagcttctcctaccaaagcttggccaatacaatcattgcctgcagttgaaggtctgggaagatcagaatgaacttttatatgaccaatttatatagaattttttttcaagcaagaatggtgtttgttccacaccacctccagtaggatctttgtgacaagttccacagactgagtgaggcaattgacgtcaaaaggccctgtaggtgtatgagtcatattaaaaatcaacaaatgtggactggtgagatggctcagtgggtaagagcatccgactgctcttccgaaggtccagagttcaaatcccagcaaccacatggtggctcacaaccatccgtaacgagatctgactccctcttctggagtgtctgaagacagctacagtgtacttacatataataaataaatctttaaaaaaaaatcaacaaatgtaaacgcaaagaatcatctatataagtaacaaactgtttttcagtagctcttttctacttgtaaggccaacaagttaaaactcaaagagaggtaggatcagcactccccctaagaatatcaaataagagtttcaattctcctgtagtaagctttaaa

SEQ ID NO: 1429 - DNA, 1200 bp, mus musculus
atatattgcagctcactattatacctgacttcagactccaaggtttggtgcagaactcaatgttttagggagataatgtgcaattctatacacataaaaacagccagatgaacatgtatatacctacagaaaatagtattgcaataaaaaatagaaacattgccacagccctcagctttccctatgtaatgcattgcttggctgaagaggaataacatagggtatgtcaacttgtcttccctctaaagaaaaggaaacaaaaaatagaaaggacattcacttacacttgaaaattgatggtttatgcacagcaccaaggctatcctctctagataaatgtttcaaatgtatttcatgtgatgaaatacaaaagtgaagaccccaggacctacactactaaggactggtacaaaaacaaaaggaaaataaacatgtcacagggacagcatctctcttgagtccaattttggatgtcaacactaaaatgattactgtgtgacttaaaatgttaaaaagaattgtcagaatactgaaatctgcatcagctcaaattacatcaatggaaaaagaaagacaattttcttccatcatctgtgtttctagggagctaattcatttactattaagattcaatggggctggtgagatggctcagtgggtaagagcacccgactgctcttctgaaggtccagagttcaaatcccagcaaccacatggtggctcataaccatctgtaatgagatctgacgccctcttctggtgtgtctgaagacagctacagtgtacttacatgtaataaataaataaatctttaaaaaaaaaaaaaaaaaaaaaagattcaagacagccggacttggtggcggaggcctttaatcccagcgctcgggaggcagaggcaggcagatctctgagtacgaggccagcctggtctatggagtgagttccaggacagccagggcaatacagaaaacccctgtcttgaaaaaaaaaaaaaggaaaagaaaaattcaagacggtgggcctcatataattttatgtgactacaaattctactcttccatatattgcttagtgatgtgagtttctacatatttacatatccacattcataagctgtgtctgaaaatctgaccattcctgtattgcaatttatgtgggacaagagactttacttccagactaatattactttatccaaca

SEQ ID NO: 1430 - DNA, 1000 bp, mus musculus
acttgctaaaacagttttgaatctctgtcatgaaatcaagttgagtttactttctgcatctattagagagaaactttttaaaagttgccctgtagcacccatacttttattattttctgtgtgcatgtttttgtggtcatttgcttttggacccaggtaaggtcagctttgtgtgatggctgtaccatattcccttactttctgtgttctgcactgttttctgggcattttttttgtgggatttttcagaagaaatttgtgaatttggtgcagcatttgattattcctgagaaagtgttagaaggaacactgagggtctgggtttctgcacttgattattccctggcctagtgtttattgttcctaggaaatcaatatttccctcgtcaattctcattcattttctgacattccatggtacttgataatctgctttttctcattgtcaatccatacttctgaggccagggcgttgaaagagatcattcatatacctgttaaatgccaagagaaatatctgacatgagagaaatataaggtcaaagaaatacataaaaagcactgaatatttgctgatatcatgtgtccctgtgtctctgaatcttgccggcaagaacacacacacaggacaaactcggatccttctgcagcaaagctttaatgcatctcgagagatagatgatcagcttctggggaggaggagacccagagcaccggaaaatcggtccttttatagaccacgaagagcggttggagacgtgccttgccctgattggctgctcaccatcagcccagatgacgccatgggacaggcagggcacaaggaatggaaaaataccccagcacatgcgcagactacttgtttaccagttagaacaccgaatgtcagcactatcttgtaatggtgactgcaagggcggctcctcacaatcatggtcatgacaactttcttcagcaatagtatcaccatgttcagaatgaattcttatgtttttattta

SEQ ID NO: 1431 - DNA, 1000 bp, mus musculus; identical to SEQ ID NO: 1430

SEQ ID NO: 1432 - DNA, 1400 bp, mus musculus
tctttggataatgcaatgctgtgtgacagtaattgctaaatgacttattttgttcgtcctgaaatgtcatgatattccctataggaagccaggtgatgttaattcttttaactgttatcatcccaagggctgcaatggcttttcttaatgaagaaaaataagtttcattattttttgtcccaattccatgaaccaaattaataggaggatgattagtataatccaaaatattccaatcacacagggtggtattagagcaaaggcatgaaattgtaatatatgtccatcagaatactctcctaaatatttggtttgattgacataaacagtaatatctacagtctcatcccaagtgacaggatgaattataggtggatttggaacatatgcccaataaacttatgcagagctgcctcgatgtaacatccagataatgctaatcaatagggcaatcagctgtattcgatcctgtgctgtcatagacgttatcattcgaggttcctggcggtggcgttgaaaagaaagacgaaacatctgtctttaatattcccatcttggttttcagcatggcgtacacactgggttggcaaccacctaggggaaggtgtgtctgttgggaaaacataaacatacccacggccccataaaagtacaggatctgggctgtgtaatgagccgtccatcggatctttccaataaactaaaggttttgctttgtcttcgggatgccagtgcctgtcagctgcagacaacccatcagcatccaaagttaaaaaatttaaagtaaacaacgtatgagttagaaagatgaattttatagtaaccacatttagccaaaacaataggatccaaaactaaagcttctcctaccaaagcttggccaatacaatcattgcctgcagttgaaggtctgggaagatcagaatgaacttttatatgaccaatttatatagaattttttttcaagcaagaatggtgtttgttccacaccacctccagtaggatctttgtgacaagttccacagactgagtgaggcaattgacgtcaaaaggccctgtaggtgtatgagtcatattaaaaatcaacaaatgtggactggtgagatggctcagtgggtaagagcatccgactgctcttccgaaggtccagagttcaaatcccagcaaccacatggtggctcacaaccatccgtaacgagatctgactccctcttctggagtgtctgaagacagctacagtgtacttacatataataaataaataaatctttaaaaaaaatcaacaaatgtaaacgcaaagaatcatctatataagtaacaaactgtttttcagtagctcttttctacttgtaaggccaacaagttaaaactcaaagagaggtaggatcagcactccccct

SEQ ID NO: 1433 - DNA, 1400 bp, mus musculus; identical to SEQ ID NO: 1432

SEQ ID NO: 1434 - DNA, 1200 bp, mus musculus
cctgcttcctgacctgcttgagttccagacctgacttcctttggtgatgaacagcagcatggaagtgtaagctgaataaaccctttcctccccaacttgcttcttggtcatgatgtttgtgcaggaatagagaccctgactaagacaatggctgactgtcagctacctcaactactacaagaagaacatgtggtgtctggagccacaacagctctaggctaccagaacacttcctgagaagtcctttcatccagccagacttaagttgctccctctccaggccaggcttgtgtacagtgcacagcttggccttcgtacctgcaaaccacagcagtgaaactttatccagtacaatggtgtgtgtgtggtggtggtggtggtgggaggtccaccagcaccatgttatcattctcggtggttatcccgtggtaggtgggctctagccatggcttgtgcttgttaactgcattgggagaaaaagggaaaaaaacagtaagattcagatcactgcttcagtgttctgctgtctttgaagatgatcatgtgttatctggcttctgcgcaagtgaacacacttacaggaaagcaaagccaggcacataaatggaggagagcaaagagactgatcatctgaaaagggcaaactgtggtttgattatgggagtgccccatgtaaaatctaacccagatcatgaagacagaaattgactcgttccctccacaagacactcctgggacatgagctctgacagagcagcctcaggagggacagcactctcacccttagtccccacaggggcagcatggggtgacacaatagcagggatgactgtgggcattgacagaatctggtaaagctcacagcagcaagggccggtcttcatcaaagggttcatggaacaaaaggcacctcaactatgccatgggagatgggcaactcatccactgctgagaccccaatatattttatatgaaccacactaagaaggaagctgtgacaactcagggaattagcccgaggcaaactgctcacaaacaatgaagtctcagacacatctcaccatgctctagttttagggttctctctgtctctgtctgtttgtctctatccctttctctgtgtgtgtctctgtctttctgtctctttctctctgtctctctctgtgtttctgtctctgtctctctccctctctctcttta

SEQ ID NO: 1435 - DNA, 1000 bp, mus musculus
tacagggtcacactcctcctcagcttctttcagtctttccctaaatcaacaacagggatcaggtgcttctgttcactggttgggtgcaactatcatcctctgattctttcagctgcttcttggatcttctggagtgcagttattcgaggtccctctttttgagtgttccacagtctcagtaatagtgtcaggccttgggacttgcccttgagctagatccctctttgggtctgtcacaggaccttcttttttttttttttttcctcaggctcctctccattattaaccctgtcattctttcatacaggaacaattacaggtcagagttataactgagggatgcacccgcttcctcatttgatgccctgtcttcctgctggaggtgggctctgtaagtccccgccccccactgtccacttttcctcccaggtccctcccttactcccccccttgtggttgctttcttctctcccaagtgtgactgagacttcctcacttggccacttcagcttgttgacctttttgagttctgtggagtgtaacatggaaattctgtactttttttttctaatgtccacttattagtgagtacataccatgcatgtcattttaggtctaaggtacctcactcaggatgatattttctggttccatccatttgcctgcagaaatcaggatatcctcattcttaatagctgagtagtattccattgtgtaaatgaatgacactttctgtatccattcttctgtcaggggacatctaggttgttttaaggttctggctatcatacaaaaggccattataaacatagtggaacacaggcccctgtgatatggtggggcatcttttgggtatatgcccaagattggtgtagctgagtcttcaggtggatctatttccaattttctgaggaagccccagattgatttccagagtggttgtaccaattttcaattccactagcaatggaggagggtcttctttctcgacatcctctcc

SEQ ID NO: 1436 - DNA, 1000 bp, mus musculus
caccaccctagattctcaaagtttattcacaacacctcatatggaaatccctgtcacctgacctaaatgacacacagcaaaagaaaattgagaggctgtagctaaagcaatttgaaaatgttaataaaatttccctaccccaaatcactaatgcaataccaattctcatgacaaaatgaattatgaaacaaactcaaaatataatatgaacaccattcaatgtggacaaatgtcataaagagggaacaagcacaggaattcaaagaaggcagaaacaaacttaatgaaattccagagaattccttcaagtgggtaagagaataattatacatgtgcaggatgtgaacatcttatccagagatataaaaatctaaggaatgctcactctgaaataaattctgtaagcctggtggtaactcaatggccaatatgtgaagatacaccattcaaacaaacaaacaaacaaacaaacaaacaaaaaatcagctcgtcaaagaaaggtctttcatcctagctgtcagggatgtaacctaaaagccattctggtctctatataaggacatgtgaaagttagaaatagagtgtgggaccctgttttacaaacaaacaaacacacaaacaaacaaacaggaaacccatacaaaaaattagagctttgtcttctacattgatatcaaaatcaattttaaaagtacaaggatattagaaggctgattctcctattggataatacttttatcttttaaagttgggtcctcagtgggtcacaatcgtttgaggaatttagctgttggaacattactgaataaagtatgacactgggggttggctatgagaaaaaagaatagatagatccaagccatcttaattctttcttcctctttagtgactggggttgaagatgtgatctttcacctttctacttcaacaacatggcaatgttctatgtgtcctccctgtcatggttgatggctatcctctggaagcattacccaaagta

SEQ ID NO: 1437 - DNA, 1000 bp, mus musculus
aggagaagaaagaaggagagagtttaaggttgatgccccaggtcacacaaccaaggaaagctatattgccaggctacaagcccagtccgcctgacctagtgatttagggacacagcctgctgcccacttccactcggcccagactcactgagatcctcagaggtcttacgccagctcacagggctgggccctcgagcggagccccccagggtagctcccactcacctggttgtgaatgaagagccgcatctgtttctgagggtatcgtaggcgcagcagccgcaggaaaaacaaggatagaaatggtgtgggctgctcaatgaacacaccgaccaggacagtggggagagcttcatcctgcagagggagggacaacacaagagtcaagcagggtctaggtactgcctgctaccaagccccaggaaaactgaggtggaggcgcatgccctcaggaggctagatgcccgggtcacagaggaaagcaggccatgcaggcatggggctgacagaacacacggtgaggcctgtttaggaaacgtacaggaggtcccagggtcctaccaaggccaatggatagcatgacaccaggtcctggctggtgtggtgttcaagctgggccatacataacagcaagtaagggctcacagcataggaagaggctatggggcacaaagggctagggagaagaaagcagacttggacatcaggaggaaagctgggcttgggtgacccacagacagacaaacaccttttcacctctccccaaagcaccattctactcaagatcacctcctcctctcccccatctcatggcactgccctcaactgcccccctcagctcacgccaggcctcaccccaatgcccttgaggctccgtaggccctcgtcacacacggtgcagcccgtctcgaaggtccagaatcgaggaatgtagttgcccaggtagttcagctgcagctgttgggagtgaggtgcaaggttgaagaggagccaagagggc

SEQ ID NO: 1438 - DNA, 1400 bp, mus musculus
tgtttctctctcatccaggcctgaatctgctcctttagctctggcactgagggagaaagcacaggggatgaatgacccggatgacaggctcttccactgcagttctatctgcgtggacacagagtccacggtgctcactccctgtgggcgctgaagactgcagaaggaacagccatggacagggaaacatttacagccaaagtgagcggagtgctctgtggcttttgggtactttctggatccaatgtcccttttcctggtggtggtgctggggactgagcctgggaatgtacacagttgggcaagggctctgtgcaggcccagccatcttttcctttttgtttgagacagtgttgtaattacactgtcggaacttacttgccatgaacaggctctccccttctgcttcatccaccccggtagctgggactacaggcctcgcggcaccggccagctctcagtctcccgcacggtctggctgcactcactggcctcctacctggctccagcatgctctcagtcagcatctggcggttgaaggggtcggtgggggagttgagcagatgccgcaggatgatagaacggtccatgacggtgccagagggcagtctcacgggatcggtcatcagggtgtccatcagagggtctgtggagacagagcagaacacactaaccctcaagaacaaaagcagatggttcctaccagcgagacagtctcagggagagctgtggagcgagcagcccctcaagcccctcagtaaaggaaggcagcaaatgatgaaggccttgccctgccttctgtcactgctgctgggaggagaaaagagcaaagaggacagccaggcagcaggcccagggcagaaccctttgccttagaatccagactccttcctgatagtggcagagctgcctttaaagtcttcctgggtacctgatgaaaccgcactggggatggtcaatgtaggacggacactgctgctgtcctcagacacaccagcagagggtgccagactccattttggatgtttgtgagccaccatgtgggtgctgggaattgaactcaggacttttggatgagcagtcagtgctcttaaccactgagccatctctccagcctcggatgttcaacattttaatctacaatattcactacaatttgtacgcataattttcgacaaatctcaagaatcagctatagcatcagacaatcaagaagcagagccagcggccacccttgtggtgatctagatgagaacgactcgccagaggctcaaatgtttgaattcgtggtccccagttaacagaccagtttcaaaaggattaggaggtatggccttgttggaatggctgtggtcttgatggagatttgtcactggaagtggactctaaggtttccacac

SEQ ID NO: 1439 - DNA, 1000 bp, mus musculus
atattccaggaagagggaggggttcattgcttaacctggagcagagcccccatggcagcagccaggcccacactccacccttgctcttgcctgggagactaaggaaaagccctaaggcacggggctctgtgtccacactcagcacacacagcaccctggctgcaccccatcacagaccatggcaccatggctcacccagaaagtgattgacacagagattgcgcagcgccttgggcatattgtagatggtggaacagagatgccgcagagacagtggctgctccgactgctcgctggagcccgtcagctcgctctcatatttcacaccgttcaggagaatgtttgcgacctgtaacagagccacagacaccaagtcagagccgttaggcccacatcccacggaggtgtgtgacagggtatgtatgtatcgtatgtatgtattatatgtgtgtacgagagaaagtgagagagagagagagagcaagagagagagggagagagagagaggaagatacaacacataaaatagataaaaatagataaaataaatacaggtcattggagagggacagctggtaaatgcttgccgtgaagacatgagacatgagtcacagcctcagaacctaggttgaaaaggaaccaaacccatatttgcaaccccgtactgaggaggcagagacagacccctggacttgctggtcagctagcctagcctactcatcaagtcacaggccaccgagagaccctgcctcaagaaagcaaggaggatggcatctgaagcaggccaaagttgacctctgacctccacatatatgtgcacatgggtgtacatgcacacacatgtgacatgcaggtcagctttagcccagccagccctcaccgtttttcccatgaagaaaggctgtgacgactttcttcagggtggccagcacaaagtcctctctgcgcgggtggctctcctgccacatggaggccagccagccacgtcagaggacacctc

SEQ ID NO: 1440 - DNA, 1000 bp, mus musculus
ccgtgggaggagacacacctcaacacccaggagttggctccagagcaaatttcaactcagggacatttccagaacaatgtccaagtcaatgaaaggtaggtgctcctggcgacattcctggttagttccatccacaaggaaccgctctgagcacagtagagattaggactggccaggtgacctgcagttccggttttgatggaaagagaggataaaagtaggaaggaagcaggccacccacccctgtcttatctgggctgggacagagtgtgcccctggagaggaggaacaagtgctgttttgctttctgtgtttttatttaagcaattagtcacaggtaacgtgaagcaacttttgaaggaaagctctccacatgccggaattctcaacccagtggtgttgggtgtcgaggttcgggaaacataaataagtgaatttcaaagcattaaagcggaggagggaaaagcaacgtccacctcatccttgcattggttagcattgatctcacaggacctggaaagggaataaatataagaatagcagacaggcaaacgtgtgaagctctgcagacagcaagccctgaacagtctcctgacagcggcaggctacttcagccacctctttggtgactataattacacaggacaatgtagctttgaggaaccctggcattggtgtctgggatttgtaaactctgctcagaggcccggcctcactctctaaagctggaaaagcctctgttttccacaagtcaccattgagagtgcagccagatctaaagtgtgtttgcccctgaacaaaggagcagccgttcccaaaggccagtccaacctgaaataccagatttctaatgagccctggccttgtctgcagctcactctgcacctggcttaaccccttcctgcctgcaggtcctcagagtccaccttcagtggaaaatcaccctgactaactgctgtagataaccctgcacgccatccatcaatttgggccgaatcat

SEQ ID NO: 1441 - DNA, 1000 bp, mus musculus
ttgttccccgcatctggcttggcatagggcccagagtcaggctgagtaaatatttgctgagtaagtaaactggcccaggaacactttaatgttgaatgaggctctctattgaagtagagattcaatctctcttcagaaggcaaacttctgcacgtagagatcagatcaccagaaagggctgcttctcaaagcgagggagccacacaagatgaacccagttcaccctgcaggaagtcaccaagctcccattgtttaaggcttgctctgcaagaataatctatctgtcagtgggctgtagaatggaggaaagatggctgggttccaagtagtcagtcgcttcccgtaacgatgctaattctggaatccaaagctggtaagggagcagggctctgtcattgtccagcttgctgctgcatgatggaagggccaggtgtggagctgaccttggcacatgtctcccttgagccactctaaacgttgcgactttgggaaagttgcttaatgtctcttgctcctcccacccccgccacctcatccccccagcagggcgatcaccgtgtctcctcggagctccatggtgagagttatggtgggtgtcaactttcctgttttttttttttttataacttcataactccttattggacagcagtttttagaaagccaaaagctgggtgcaattacagtgtcacctgaggtcacccagagaagatgtgtcaccctgtctttagaggcaactaaagggaagctatgatatggaagagctcagctagtgcccactgttcttcagtcaaccttgaccagattaaatcaaatcgtcttctcaaagcacgggtactggggctggtctctgctgggcatccttgctctaccaaagggtgcacaggcctttccaaccctcatctagtaagctttccagatggttgcccatcctctctcattgtaatgtaggctggtgatgaagggtgttggctggcgttgccaggcggaggcaccgggg

SEQ ID NO: 1442 - DNA, 1200 bp, mus musculus
ttgtcaccctgtccctgagcttgaactggaatgcatcagttctgtgctgcgcagacgttgcaggttctatccggagcctctgagcatccctccaaaaacggagaggtcctcgaaatgcttaaggagagtgcactgcctctggctgcctgggacctccgtgttacacagtgcagggacccggttccttggatgggtgtgctccgtcgggtctctgacgtgactgggccgaccgtgacccttgtgtccactgtaggacaggcgtttacgggcatccagagtagtgggagtcacccctgctcgccggagccgactcccaaggagacagcgttaaggatgctccctggggcaggtgggcagggaaggtgattccaagccaaaggaagaagcctagtgtagcctcgggtggctgggtgggatccaatgaagacgccaggctgcactctgggctctgtccagcagggggctctgtgctcactgtagagtgatttgtggttgcttctctgaaagggaactggaaaagcagagagagaacacagccagcgacatcctgcagaagaagcaagaggcagaggccgctgtgagtgtcccactgctcatatgcagggcacagggcaaacctccacacagggcccatcccactgaagctggggctgtgactccagacagcccaggggctctgcttcaccgacaacctcgttccctcctgaactgctgtgtctggagtctgcagtctgtgccctgagtcccagcacggctctgtagcgtggcacacaccgccctgctctcctcctttttgtgagagcaaaggagcagaaggccatgcttaggagcagggtgccatggggttctcgtgacacaggtgagggaccatttgagcccacatatgttcctaggcagatgtgcccgtttgtggggcagcacacagccctacacagctgaacggcttcacaaacaatactggtcctcttcaagaaaagtaggaggtccagctgctcacgtcaagtgtctgttttgaggcaggatctcacagtgtgttctagatgacaccatacttactatgtagcccaggttagcctttaagttcatcactatgtatctctttactccttttttttttttaagatttatttatttattatatgtaagtgcactgtagctgtcctcagacactccagaagagggcgtcagatctccttacgg

SEQ ID NO: 1443 - DNA, 1000 bp, mus musculus
gccacaggcaggtgcaagctcagaatccatcactgatatcccgcagcccccacccaccacgcttctccatccccagctccaggctaagctgactaagctctagccgatgtacaaccaaatgctctgcagcagcgccacccagtggccagtgaagcagaggtctgaagcctgcctgcatgctctggtcccggctaggcttcttccccgcagtagactctgagtgagggtctgggttttctgtttttaaaccccacccccagctcgcgtctggatttttaataagccttagatcatggtttacaacatgcttgagaacagccgctaaaacacaccctgacaggagagcctgagactccggggtccttcccaggacagacacctctttcccctggttttccgaagacacttgcaatagttcagggtccactcattatctacaaaggcccgaattcccagaatatctaggctgttggggttctatccggccgtcatctttcacgatggtgatgttactttgggcttcctttgccggctctgcagccagtggctcaccagcgccccctacaggaggcctgttgttcagaaaggctggaccacacaaggcgatcaagattgccctgtaagtctggctgttgctggcctttggaaaatgggcaggtgccagtccccaaatgcctgtgagctccttaagagcggcctcccagaggtctctgggtgggataccagagaccactgagtagtgatgtgcacagcgagaacattgctcttgggccctgctgaggggctcaggtagcctcagatgacattgtgtacgtcacaaccctgttaagccctccattgagaccttagtctttccccaggggaaggtggctgcctcagggactcctcctcagaggaggcctgggtgacttacctgtagatcatcccgggggagcctgtctgccgcagggagagtcgagctggggaccccgtggttgattccggatacatggggccggcc

SEQ ID NO: 1444 - DNA, 3000 bp, mus musculus
gacagtggacaagctgcacccttgagagctgccgagcaaagcctcgtccgtaactccaaaccccagctcctgcatgggaggagagaggatgtgggagcgccgtgggcagccctggcagctgcgggatgtcctggtttctgcccgcatccctggtatgcatcatgccctcagtgagtcccagggccagggccaggaaagtcacccagaagtgacctgtagacctcagccaggaatctcacagtctagagacaatgatatcaggtcgatgacactgacgtacgctggagccaacgcacacacacctgaggcctagatggagtgcttttgtgtaacaattgaccacaaactgggtggctctcaatgacagaaatatatatcatttcagatctagaggctaggagcatgacatctagacagcatcaaggtaaaacttcctctaagaggctgttgaaggaggttctttcctgccttgcccagcttctttaggctttagtgagccttggcatggggccactccttcttgtctctaccctgtctgcatgtcaccttctcctgtctgctgtgtcaaacatatctctgctggctttcttcccatcctgatgattgtattgtttggactgccctggggctgcaggacctcacttcaagaccttaactcgcaggcaggagggacagctgggtctgtacagggctaactgtgtgggcctgggagcctaagctcagggctccgagtctactcaaaaagctgggttgtagcacgtgctcatagccccagtgctgggaagtagatcactggagcttgctcccacacagctcggcctgaatggtgagctccaggcaaacagaagacctgctctccaaagcaaggttgacagtgtccacaagaatggcatctgatgctgacctctggcctccacaagcaggcctgtgtgtatacatacataaacacacacataaacacacacagaccttgatgtaatgggcatgcaaagacccttcatctaaatacagtcatttcctgagtccaggtactgggtctcagacaggtcttctgggcgccatgataccatctcttctggagtgtgtgaattggttttggggggcatccagtcttctccaacagcttggaagttgggtggatttgtcgagatgaccacaggacagcctgcctggggacaggaaagccaagactgcagcagtgagtagcagagaaggaggcagagcaagggcagagtctgggggcaggggtgaggtgtggctgaaactaacaagagcaacaacgtcttgtcacccctccgagccgagccgtagaagacttatccagagagaagatgggctcagttttgtgagagcaagaaggaggagggctgaccactgaggggctcaccgtggtgtgacagtgaaggggtgtctccctttcaccattgcctcggtcctggaacccaaccattcacacacacacacacacacacacacacacatgctcacacacacacacacacacacacacacacatgcacacatgctcacacaaacacacacatacacacacgcacacatgctcacacagagagacacagacatgctcacacacagacacacacacatgcacaatgctcacagagagacacacacatgttcacacacagacacacacacatgcacacatgatcacacacacacacacacacacacacacacacacacacacacacgcatgcacatgcatagtttccctactaaggatgagcactgtgtgtctctctccactccctcagttcctcctttcccaggctgaagccagacagagccttagcttattaagactcaagacatggaggggtctggggggcaccagcttcgggtgtgaggaacacgtacccgccttcagtatgcctgctgattcctgcactgctggctacagaagtgttcatctgtaacactgatgggcctggtaagatgggagtagaatttcacagctacggagaggagattagacagacgaaggcagctatgagataggctagggccgggagagccatttccagcgatgagcctgctgacttggggtgctgcgttgtgtgattacagtctgtctcctgactgcggcgggcatcacttttgagcacagcttttgtgggctgcactgaaatgctcacacctacccaggggtgtggagaacagggccagcctccaacgggtgcacacactcgtgtgcacacagagtctgcctggaacactggccgcattgacagttttgcctcctagttctaagtaagcagggtgctgcagacaggtgtggcgcgagctgggtagcaggttcaacgcaacagccgcgctgcgccggttcctcatgggaacctcctcagaggctcatccttgttggtaacaggtgctgatggctacagctactggggcaggagggattgacccaaaatttccccgaggcaggtgctttctggggaggctggaggtcctatcccttgtgcctgcatggtggaggtctccatctcataaccccaccctcccaccagcatttaagaagcccggctcgctgcagcccgcaagtgtctgctcttcaccctgctgatgctgcctcagggcagagttcccagctctgccagagttctcagaaggacacccagggcttgcttactctcatccagtatctagaactcttttctagatactttgatgaaagcctgtctcctaggtgaggcaagtcagtctgtctctcaggcggctgcagactgcacggggagaggtcagtaccaggcaacaaagctcggatcccaaacagacgttagctaccactgtatcataaccactgctgccattgttgttggcacacctctgtcgccatcgccctcatcatcaccgaatcaccatcatcgccattagagtggttgtcaccaacaccactggcatcaccatggttagaatcactatcatcctcctcttccttataatcatcagaatcatccttgttatcccagtggt

SEQ ID NO: 1445 - DNA, 1800 bp, mus musculus
tgaaggcaggtgaggtggccgtggtggccagagcagggcctacccagccagggatggccctcagagagaggcagacataggatagatggatgggtggtggcaagtaaggggacacttttagtacctctggacccatgatgctaccagagagctggtgctgggcccagcaggaccccctcactcactgtgtggttacaggccccgaagggttggttgcaccaagttgtaccccagggcctcccttagagccctagcagctagactccatagactgagaacactttctgttctggcctggggcggggggtacatgggatagggacctgaggttccagatagtgggcaaataaatgtatgtagatccctttgaggaaacagaaatgcagagggatgtgtcactcaggacaaggaaagccacgggaggggtcatggcgctctacccttgccaagaatccaagcagtcagcgtccccagatgtacaggacatcagaggctactgagggaaactaggactggtaacagacagaggacagggaggcaggtaccagggcaccccatcccaggacagcagggagacagtggccagggcgtcccatcccaggacggggacacttagcacacttggattcccgaagcccccctgggacatggagatagcactagaaggctccagggtcagcatcccccagtaccccacatcacaaactaaggaagggacccagagaagtgaatgccaggccatagccccagaaggggacagggtgggaacgagggggctggtcctatcctccctgtggctatgtgaggcccaggaggtaatactcaccttaccactaatgtcactgacagccacatgaacaaagatagaggcctcttccatcccttctaggtacacatgccggtagcctggagcaatagggtcacgagtcatcaaggttccaacatctcctcaccctgccaacccacactttcctcaaaggtgtctgggccttgagtaggaccagggagcctcctgtgcataggaggaagaggctgggcccccttcctgtgtcttaagctagttaggagctcctggggaacacggacggggaacgctggcaaacattgaacctcgcccagcctccttacctggcattatgctgctgaaggctagtgtcctctggccgatgaagtcacgtccaatggggtcatggtcccagaccaggaagcgtacaagcgcaatctctggcatgtgcacggtgaacaccagtgtctcctcccacatggggttgaatcctggagatagcgaagaaaggatcagcaggtccagagacgactggcacctaaggagccgcagagtggacagggcactgggcacccagcagtgcccgtatcctacgagggacttgggcactggctggtgtctgaagccctcacccactttggcgggagccctcaccgttgtcgtccaccactcgggtctgctccttgctgcagtccacggggagcccaatgacctccacctccacgaaggggtcgatgatctagagacagggtgaggggtggcactggaatcccaagccctcccaccacccacctcacccacgcaggcttgcccctacctccccacggtcgcccagcaccgagtcccgtggtttgggcagctgctggccactgatgatcctcagggccagctgcttcttgagctgccccggcaggggatcctccgagttggggttgaagacacctgagaggatgcaggtgtgagccaagtacacagctgacaccacacccctacctgttggtctgtggggctctggt

SEQ ID NO: 1446 - DNA, 1200 bp, mus musculus
acagagcatccagcaaaccagaaactcaggggcagagagtcagtccctggcactccttcagaaccagacacttggcctggaagcctccccatgtcagatacctgtgctgttctgacagctgccacccaggggtaaatgcagtctctgtcccaggcaggccatacaactcactgtgtctagccagccagggtttgcttttgtgtaggatcagcatacattagctgcctttgcactgtgtgctgggctccccagataaagggagcaccccgttttggggaagttggcaatctctcctccccaggtgacatcataggattcccatcatcccttgggtctcgagaacagtcacccagcaggaaaagtaccaggcatgaatgaggttttactcacccacaggcaaaacgttggcactcaggaaaagccatctgctgcctagatccggccctgggtcctcaggcaatgaagcgggaccaatggagctatccattggggggattcaacctagagggatgggcactctctgggatttgggtgcagacagcctggattagcagaggggtctagtcaccagcaggagactgatgtgaggtcccactgctcccagaggctccagtgtcccttgctgagatgaagtctaagcctgtagttcatcacacacctagagaaagcaaaaggagaatgtatgttttggggttgggggaagaggggagttctgcccagctacctgcactgtgggaaggcaatatgcaccacagcgccccctgctggaggatactggattgtagccagcaccacagtaacttttagataaacagactggtagggctagtgctgagctgggtagcaggggagccaaggttgaggaggtggagcaagaagggcccaagggtgtctacagagcctcgacttccatgaggtctaggtggaggcagagtattgtgaccaagctgccagcttcctcgggagttgacggaatgtttgtctgttgtgaagactttaggcaaggctccatcatagtcaagagaaaatgagaaccacttcacaaagtgagccccgtgggaacaaactttgcaagacaaagtacccgcaacacctcaaaacgtgtagcccatggctgtgctaaactcaccagcccttaggcacaatgggacccgggaagacttaaagagccagtgttgagcatcctccatctctgctcct

SEQ ID NO: 1447 - DNA, 1400 bp, mus musculus
cttggtactagaagctgattccaggggtcccgcgtggctggcgctggccgtggtgctgacccgcaccctgtgtgtgatctgtccaaggtgctggcggcgacctggttctctcctacaggctagggctcagctagggatggagaaggctggatgttgcctacctcctgagtgtcctctgcctgatgtctttcttgttctgtcctgatacatacatacatacgtacatacacacacacacacacacacacacacacacacacacacacacatacatgcccagccttctattcctgggacgcctggacagggtgctgagtgagggctcagggctgggcatgttcaggcaagcagtaccttctggtctcccatggtctgcctggggaatttctgaattcaaagtatggctatgaagtcccaaagaaccttttgtgggtcacctgggcaggccttaggtgggcataataggatcaaggataatcttgctttgaaaggataggtgggctcatagggtccatcttgtgcactgcaggccttgggggtttggggaaggggtcactgtgaggctaaggtcagtggagtccaagtctatagttaagtgtctcacgtctcaggctgaggtactattcggggcttgttggcttaggagatttctggtagggctaggttccctaaagggaaggtcacgggtcagtggtcattcattgtgtccctgagctgcctcaccaccgccactgttctcatctgctgctttcttggcattccttcccaggaagaactcctgggtgttgagctttggcagccaaagaagcacatagcacttgggcaggtggaaggtgaccaggatgcccagggcacagactaggatagcacccatctgcacagctggctggtaggccacctgcacattggccaggaggggcacaaaagagacccaggtgatgaaataagctagcatggcgaaggtgagaccacgggcacggttgtagcggccaggctggctctgtaccaggaaagtgcccagaaagcagaggaaagctaacattgcattggtgatgtgcaccaagcccaggctgacccaggaacgcacgtggcagtgctccagtacctctgtgggcagcactgaccagtctgtcaccacctctggtgggaaagcgatcaaataccaggcacatagtgctgcctccacaaaagtggccaacagtaccactagccaggcccagagtccccgaaggtagctgcatagccagtttgcccagctcagtggcagctcagactccacaaaggtctcagctgcttgcaggaagagtgtgctcaggcagcctgtgagagggaggtgagccattggttgttgtgcaaggcagctggcagagcttggccgccctgggaacagaaggacactg

SEQ ID NO: 1448 - DNA, 1200 bp, mus musculus
gatttggctttttaaaactctctggtatattaatgtctgtgtgtcctagttagcttaagttgtcaacattttggagcctacagtcatcttagggagcctcacttgaggttatcttacgcgctcgtgaccggccaggaaagacgcaacaagccagaatcttcttttttttttttttttttttctcttaagactgttttattttgttctattttcaaagaaaacagatttagaagagtgtaagcataaatttttgcaacctactcttaataagagttcaacctctcctctagcctaccacacagcagaggtagtggaagggaaacgttattaggatatgggaaattggatctggtcagcaatagttcttttgaggcgagctcagtctttttggccagcagttcagtcttgtagcaaacaccaaatacaactcagcagctgcagaccagtcctctcgggcaggcagacaccacacacgaaccatcagctgcagtccagtcctttctgcaggtgacaccaggcacaaacccagcaactgtagttcaatcctgaagaaactgcaaggcttgccacctggcctgaggcaaggctgctgcaagggacaagatgctagaggaacctcacaaacagtccttgggtgagtttctctcaataagccagaatcttctgcggcaaagctttattgtttactcaggagcaagagaggaagagcgaggcagagagaggaagagagagagagatgcagagagatgcagagagagaggcagagagaggggcagagagggagagaggcagagagcagaggaaaagacgaagagagacgaagagagggagtgccagaaccctgtcccttttaaggagaattatcctccacctaggacgtgtcactccctgattggctgcagcccatcggcccagttgtcatcacgagaaaggcagagcacatggcgggaaaactgcccctgcacatgtgcagattatttactacttagaacacagctgtcagcaccatcatgtaatggcaaatgtgagtgcggctccccacatctccccctgtccttttaataagagcaataggccacccatattaatgagagtggagatagaggtcaaatccccagtgtgcaggtaaaggagccgtacacataacctcctcccaggctcatcacccagaggggtcctggtctggtcccgtgtcgtttt

SEQ ID NO: 1449 - DNA, 1000 bp, mus musculus
ctgagtcaaagttgccaagcatctgttaagccctaaatcctgttctaggctgttgaacaaaatacaaggtcctcaaaggtcctcgtggagtcagagtctaacctggaatggcagttcattaaagatgagcaaggcgaggctactctatgtaaggaagcttgtggagcaaaagaaccaggcacagcgaataaggagacaggcttttgtatccaattgaagacagggtgggttggccttgctaaggaagagagattacactaatactataagaaacagaaagttctttctcaggctgtcagaattctgtcttgtcagccatgctcagaaaccgtttctccctgcattgcagtttgctcatgggtctgggtgaaagagactgccattttcctctacatcctccacatgcctctgggagcacatgctgtcatcaatgctgccacagcctgaagaccctcgcttgcttttgtctctgtgcttgtatttagttggctggttgtttttgagacagtcttgtcttagatactgctctattgctttgagacaccatgatcaaagcaaagtgttagttgggagcttgcttagagttgcagagggttagtctgtgatcaacacagtggggggcatggaggcagacaagcaggcaggcatggagctatagcagtagctgaggactcacgtgtgatccaaaagatccaggcagagaaaaaatgtgactgggcatgatatgggcttttgaaacctcaaagccaacccccaccccaacctgttcccatcaccccccacccccagaccctcaccctcatctctcatagcacacctccaacaaggccacacctcctaatccctccccaaaaattttactacctggggaccaaatattcaatatatgagcctatggtagccattctcactcaaaccacaagcctcatatatcttaaatttgcctcaaacttgaactcatcatgatgtagacaaggtgatgttgaatttctcatcctcc

SEQ ID NO: 1450 - DNA, 1200 bp, mus musculus
cctgcctgccagaagagggcatcagatcccatgacagatggttgtgagccaccatgtggttgctgggaattgaactcaggtcctctggaagagcagtcagtgctcttaaccactgagccatctcaccagccctgattttttttaagctcatattttggggccaatgagatggctcggtggggaaatgtggtagccataccagcctggtggcctgagtttcattcctggaagccatgtaaaagctggaaggagcgagccaccaccaccaaggttgtcctctgacctcctctgtgcacatgggccacctcttcattgtagtgtgcctgcacacacacctcagagttgttcttgatttccacatgtgtacatgaaccaactcctcattgaaatgtgtgcgggtacacacacacatacactccagagttgtcctatgaccaccacatatgcacatgagccacctatgcattgaaatgcacacacacacacacacacacacacacacacacacagacaccaaaatcatcttctgacttccacatgtgtgctgccgcacctgatccacctagactgtctccttatctcagaaatgtgtttgaggggcttgcccttcagaaacagggcaaatgtaagagccttgagaagaacagtagcgacacaaacacccatagcatatcatcaggcagcttccttctctctcctgtgagcatccgtgttccatgtgtgagaacctggtcatcagggtgtctcaggccatgttctctctcagcgctcagcatctcctttccctgttagcaccgttgatggttcttttttctgggacttgggaagcaaacagaagacaaccttgaaatgtaaaactggcttttccttgctgctgtaggtccttctagagcccatgataaaagaagaacagagtgcggaaatcgactttcttcttccctctttaacgctgagctctttggggtaagaggttttggtcaaatgagtatgttcaccggctgctttgggcagctcctgtaccagtgttaagtggccaggagtgccaacaatgaggagataattgccaaggattatgtctgttctcacacataggttggaagttgaccttgtcgcttaggaaggaggttttattagagactctcctttgagaattgacttgtgagacgaaagctagccgaaatcacctgatgactgtacttg

SEQ ID NO: 1451 - DNA, 1000 bp, mus musculus
aaccagtatttgataccagtttgtcttatggctgtaaaaaaaaagtgatcacataaacatatcagtagcagtgacagtagtgacagaagatactgtcatagtttggtgtaagaacacttccggtggagagaggtgtgagccttgcgataaagaggcggtggctaaagctggatctcggtgcttatccctggcctcagaccttcagagtcctgaggagtcactcagtcacttagcagttctgagtgagctctaggaaacggaggaaagaaggcgtctcaaaggctccttctccaagagtttacagtctagtgagttacaagacatttggaaacaattgacatgatgcaggcatgggaagacagagacttacatcctacctatgagagttgagaaaaaatgctgacctgtactgtgtggtcagtgagtactttcagaggagaatgcaggctgggcctcctgagcaggactgttcatagtaaagtcagaggctgagtgttgggaagtggatagaagacctgtgtccatcaaagaacaagtggttcactgtggctggaagatgggtccctgggtaatgtgggatgttacagaacacaatgataaatagtcagtgactaagtcacagattgattcactaatctcttaagtgtctctcagtccaattgggctggcaagcaggactaaccatgacgttgagttccgttaggcaaagcaactcaccaagcagacatttgataaatgctcagtgagtgacggcttttgtcattcctcctctccccacaaaacttagcccacactttgctgtaggtatttatggaaatctttctcattggccaatgactgtcatttacttgagggtagcactcttttcctaagtttttaaaaaacacttcacacaaaatgtatttattgatccatgaatctgttctatactgtcggtttagagtatagatagcactttcttgtctacagaaagcaaaacttcaccccatcttccctgctt

SEQ ID NO: 1452 - DNA, 1000 bp, mus musculus
ctctcctctcctctcctctcctctcctctcctctcctctccttctttctttttttttcgagacagggtctctctgtgcagccctggctgtcctggaattcactctgtagatcaggctggcctcgaactctgaaattcacctgcctctgcctcccaagtgctgggattaaaggtgtgtgccaccacgctcggcttgagttcctgtcctgacatcagtgatggagtatgaactggggatcacaaaataaaacaaccctttcttcagaagtcactttgatcatgttgccttaacaataggaatctgaactaaggcaggagcaggtaccaggagacagagttcaacagaaaccaaattagatactccatgttccaaatgctgagacatccaggtgggctggcaacacaggcagggtccagagttaaaggacagactggcctgggcatcaaaagttcaatgacaaacactgtaacaactcagaggtagaagctcataggcaaaggtgggagggtgaagtaaggacagagtggcttcaagttgaagttcaggcttcagagtagctatgacaatacagatgggtatgcatcccaacaagctgcaagtcaggaatgtccacagcacagaacattggtgcttgtctgatttcagaagaagtgagacaggttatggccagcccttgtgtgggaaaggtagtgatgtacaattttgcaggtgatcttggccatcacatgagaaaatttccagagctggcagggtcttgaagtaaggctaccttctcagagtccttggttttgagagggcatgttagtttttcttatggcttaatctgaaatccttaggcccctctctctccttcactcttctatccattgaatttcaaattaataattcagcttgaaattgtgaaagtcgcagcatcatctgtggaactcaggcaggttatgcaatcacactccagtgaacattgagtgcgcctgcgaaacatgtcagattggacgtgtaa

SEQ ID NO: 1453 - DNA, 1400 bp, mus musculus
aatataatcaaaacatgtataaaaatttcaaaagactagaattaaaaatcctgatgaatggaactaggaaataccatccggagtattgcaatttagacccaaaaggacatttgtggtatgtactcaccaataagtggatattagcttaaaaagtacagaatacctaggatacaatccgcagaaatcaagaaggttaataagcaggagggcccaagtaatgatgcttcaatgtcacttgggagggagaagaaagtaattaaagagtaggagggggtagggagaggagaggtggagaggagaagaagacatgatcaagtatggggtggggacaggaaaaaagccctgagggccagcagaatgaatggcaatatgcaacctcaaggggtgggggttgaaggaccctctagaaagtaccagagacctgggaggtgagagtttcttaggactcaaaaggagggaccatagtgaaatgcctaacagtggggaaagggaaatgtggcttgccatcctacagtcaaaaaactctgacccagaattgtccttgtctaaaagaacagcagggacaaaaatggagaagagactgagagaaaggtggtccagtgatcagccaaacttgggatccatctcaaggggaggtttcaaggcctgatgctatggtgtgcttacacaggagcctagcatggctgttttccaagaagcacaacaagcagctaacagagacatgcagataatatacccaaccattgaactgaagaaatgaagttggggacccctgtggttgagttagggaaaagctgacagaagctgaggagggaaaccctataggacaaccagcagtctcaactaacccagacccggagatctcccagacactgaggcaccaaccaggcaacatacatgagatgctctgaggtcccagacacaaatacaaaagaggactgcctggtctggcttcagtgggagaagatgcacctgacccttgagagacttgaggtcccagggagtggggatgtctgggggtgggaggaggtatatcattttggagacaaggcaggggcaggggagggggaatgggatcaggacctgtgtgagggcagactggaggtgggataatgactggactaaaaaaatgaaggtaacaaaaaaaattctgataagcagttactcaaaaaatccttcagacattacgcttatactttatatttgtaaaattaatggaaaaatgagcatactaaacttatttaataggagattaaaaatggttctttagaaaaatggaaaacagcatttaagtgtactttttcaagtttgtttatagtaaattgatatttattttttaataaaatatacctgctaatgatacagatcatgactatttaaaatgtgaatacattatggaa

SEQ ID NO: 1454 - DNA, 1200 bp, mus musculus
ggttagcaatttgttaaactggttgtattctcatattccatctgagctatctataattcagatttcaaagtactggaagattccaaaacacttagttcttgtgggtcctcaagaaacaaagacagtatatagtgttcagctccccccacccagtgtgtgtgtgtgtgtgtgtgtgtgtgtgtgtgtgtgtgtgtgtgcacgcacgtgcaagagagtgcatgagcatgtgagcgtgctcgcaggctcatgtgggtgtgtgcgtacaggtactcaagtagtgttgagcatttacatatgtatagaggcagaggtaaacgtagggtgtcttttctatggtttttatcttattttccatgaaaggatttctcattatacccggaactcacaaatttgctagactagctggatatgatgagtgagaaatctccttgtctctgtctattcagcactgggattactgggattacaccaggaagcccaaaattttccttgggtgctagggataaactcagattctcatgcttgcttaaacaaatgatccctttatacctaccaaattcttactggccttggaaataataatcactcaaggttataacattactatagtgttgccggtgccctggacatctctctgctcttgggggttaggggtgagttgacacagagtcaacaacagacaccaggagcatgtgagaaatgctacaacaagctcatctgagcactgctacaagctgctttaataccctctacctgcacccccattggtccaaaggaactatctcttctaaaaagcagttcctgattggctggtaggttttgcactagcaatccttgttttctcaggcaggcctcaattaggtcccctgagggagatccttttacagctgcatgacccttggcttttacatagaggcagccttgctgttcctgttatatatccacccttttgttttcagattttgacagcctggtgggagccagggtgccattgcctcaacattgttgacctcatgaccccacttcagaagattcccagtatactgaactgtgcctgtcttaggttgtgctgtcttccaggatcttacctatcattgactaccagctctaaaagagatatcactttgaaggcatgtcacacaagggagagacgaggaacagcctatgtggtggtctcatggatctctgccatccatactt

SEQ ID NO: 1455 - DNA, 1000 bp, mus musculus
cagaatcctgatctctgaaagtggagcactcaagtttagtgctccaagttctgcctgttacccattcagcatgtgagtcctgccttggaaacagatcctgggcttcctgtacagactgctggcctagggagccccggtcaccacagttctcccaagtcacattcttacagaaactcctctgagatgacacaagctgtgcaggactgtctttagccagacctgagttggtcttcaagcccctgtgtattgtgaacactgcaccaccctcccaggctgcccgtaccatggaacacttaggtctatggggcaggagctgttttcttagcactgactgggataatgtctccttacttaagtcctctggagggaactccttggtctcctgcatggccttcaagtccaggcgctggccttttctcatcttccttttcatcatccagggatcccttccttgttccaacgaggtgatcatatctggcttagaagcacaaagtcccagggatactaggttcctgtagttgtccagcatcaccttccagtacagactcctctgctcagagttgagccattccgacgcctcctgagagaaaactacaaccacatccccaaaggtcaccaagccctgcgacttggctttatgtctagtccctgtaggggcagcttcctgtttgcggtttatctcctggaggaagttggtatctctggaaagcagagctggaggaaaggaaagactagacaccaagtctacatggagactacaccctttgtgcacggtccccgaggtctgctccttggtgatcctgggaggccaggctgttcctggagcgtggcctccttttacaggattttaaagtcaattcaatctgaagataaagataaaagttttctcttccaggttcttgtaaaaatggggtgaagaagagcatcgataattttccaccattcaacagcaattttaagttccatatagcagtaagattaataacaacgtcatggtttt

SEQ ID NO: 1456 - DNA, 1000 bp, mus musculus
tacagatattcccttcccttgtctctgtctctttctccccatgccctgcctaagaaattctgggatgtaaaactacaccagtttggtaaggtagagcaggtcgagacccagagacttggtaatgaggcttatgtgactcccagccccctgccagactcctgacttgaaacacaagccatgcttctcacataagagacctgacctcaggtagactcaagacaaagttctccatgctaatgaggtacctagaggcctggagggcttaactaataagcttcccttcccagacattcctccctgcaaaaggtatataatctcaggcccaccttgttccaccatgacaagaaattgtttacaactatggagtggctctttataccgagatccactgcggggagccatgaagaaggacttcacctacagagccacagcctaacctctcatagaaggcctctctgccctcccagccacaacctgtggcctccaagctaaggacagtcatccctgctgggacaagcagaggctccccattttctcctggccccagactagatgctgtcccccgcatgcaagccttttctgctcttcagttctctgctcttcagtgacttccagcagtgcctggatgtccaagagcctgagcaccccatggttcccagccttgtcacaggctcagggaccctggagccagctccagctttcccacacttaagactgcacttgccatccctgggagtggtgcctcatgcttccctagagccaaacacacccagtggctgtggcggtggctggggaggggggcagttgtgggggataggcaaagtcaaagtcaaactcccccacgctttctgcctcccaaagcagctatgctcagtggaggagcagacacggggcatcaaccctacaagaaatgttttagcaatccagaagagtgactagctgtgtctatggatagagacagacaagaatattaatttgaaattatatttaaactccttga

SEQ ID NO: 1457 - DNA, 1000 bp, mus musculus; identical to SEQ ID NO: 1456

SEQ ID NO: 1458 - DNA, 1000 bp, mus musculus; identical to SEQ ID NO: 1456

SEQ ID NO: 1459 - DNA, 1000 bp, mus musculus
agactcaggaataaaatctggaccctgtctctggacaccaagatgcagaacacctataaaaagcaagttgagccagtcaggtaccatgctacccagtcagacagaccacaccagagaagaccccccagccagtgtcatgcaggcctggctgggtagtccatgccttaggcaatccatgtccagtgaatgggtgggacataacactcctgagatgacaccagaaacacagaggccccaggcatcattatgatgatgagcaagtagtggtggagagacagagagggagagggatgtttgtacagtgaagggaggtagaactgctgagagtgtgaagaacagcctgatgagggtggctggtgatgccacctggggttatggtggggtcctggcccatgctgccagccagggccatgtctaagttcatggacctgcaacagcaggggtctattcccaccaaaggccaggcggatgtccatagtctccaactgcagtactcaggagaaggggccccacatctcacccagggagcagagcaaagctggccctggttgctggggggttgtgagtgagctggtcctggggtgtaagtgtgggagagctggcctggccacttgtctaatgtgtggtgctgtggcaagggagagatgccctcccccacctcaccacctatggaagatgggagagctggcccccaaggtcatgagagcaggagagctgtctccgagcagtactcagcaggccctcctggtcagcacagtagagctgtccttggttgcaaggggtcacatgtaagccagtcccaaagcatgagaacaagagagttggcacagccccttgctgggtgtagtacttgggagagcagcccacacctcaactggacagcagagctggccctgctgggttgggatgaatcggcacgagggcatgagagtagaagagctggctctgcctcttgctggctgcagcattgggtgggctagtcagtgttctgccagagagc

SEQ ID NO: 1460 - DNA, 1000 bp, mus musculus
gctgagggacacaggctatgcctcactactataaagcccaccactgctggagccaggatgcaaactgaggccttggtcctccagttagctaggaatccaagctctgtcacagtggaacatcagttatcaggatgatagaaatgagaggtcaaaatagggcagctcattgacattccaggtaccaagaaacagcagggatcccagcaggtgagagggctgtgatttcctgaagaccaggtgtctgcgagccaggcatcccaatatgtgaaggttgaggaccttccaagacactaaagacactttgtctctgtgtgttcttagacgcgtggctctattttcctctgtactttcagagaaatgctttgtgtggcattagtgtttcccagccaaggtctgtggagttgaacctctggtgaagaggtcctaggaaacagtcattgggaactagctaactctagggtctggccccaaccaaggagtacatactatgccatactttgcaatatgcttcgggtttgggatgcttgagcagatgtgaggtcctgctcatttcctttctttgtggtgtgatgtcagaacatgcagataaatgtaatcctcattgtgcatcaggatgaggagactgcactgtggagtgactgttgtccacaccacacgcaagctcagtgccccaagctcttgcttgtattaggctgtacatgctctgaaccctgcacaagcaaggcactcacttccttagaaaatgaggaatagggaatatttcttgaaaacgtcacactataattgataggtagagctatttgtttacttgtttgttgtttagtatatgttgtatacacatttgtactcactcaccgtagtatgcatgcctatgtgcataccagttgaagccacaggatgacgtctggcagtctgccctatcactctcctccttgtctttgatacaaagttcgtctttatctttaactggacctcgtttgtcatttttgctaagctgatt

SEQ ID NO: 1461 - DNA, 1200 bp, mus musculus
gggagtgctgtgttctgatgatggatagtggtcttggtttcagttagtaagattctttcgtttgccttttgccatctggtaatctctggagttagttgttatagttatctctggttagagcttgttcctcaggtgattatgttagcctctattagcagacctgggagaccagctctctcctgtgtttcagtggtcagagtacactctgcaggcaagctctcctcttgcagggaaggtgcccatatatctggtttttgaacctgcctcctggcagaagttgtgttccattcaccagatgtcctatgatcccgtggagagtcctctggggaccttgggggtgtccacagactccgcgcccaaggtgccccagtgatggtgctggtgccaactggaagggacttgtgaccctggtcaggccaggttttctgcttccctaattaatgcttcctcaggtcccgcaattggattggagcagaagttgtgttccgctcaccagaggtcctaagatcccgtggagagtcctgtgcggaccttgggggtatccgcagactctgtgcccaaggtgagtcattgctggcccaaattagtaacttatggtatgaaggaatgagttaatattcagtcttactctgctctccttttagaaggctaatgaagggcagcccaccagtcacattgagcttgatctaaggaggtttctaacattattttttttttttttatcaaggaggcaaccttccagccttcccatgaacatgtgtactcatgtacacacacacacacacacacacacacacacacacacacacacacacgctccacgtgagccagggagggcaaagcttgtcatcgcctgctgtggctcctcgtcaacatggcttgctcctgttagagttctgggagctcctgtcaactgtgagcattgggacacctgcatgaagagcctccatgactgtctttccctcagttgccaatcaaaggcaaaggagatacttcaaaggggcttagaggatatgtgttttcttttcatggtgaactctccccctcattttcttttttttttttttttccattttttattaggtatttaactcatttacatttccaatgctataccaaaagtcccccatatccacccacccccactcccctgcccacccactccccctttttggccctggtattcccctgtactggggc

SEQ ID NO: 1462 - DNA, 1200 bp, mus musculus
caactggagttacagttatttggatcttgtttaaagcactgtatttctggaattcatggttatggcactgctgtcatgtctagaagttaattttgagaagtagatattctggtcctctgactcttccaatcttccttcttcctctttcttttattttctttcttttttttagtagatattttctttatatacatttcaaatgctatcccaaaattttcctataccctccctccaccctgttcccctacccacccactccagcatcttggcactaatgtaccctgagttttaggagtaagtgttgaactacaggtgttgataattggacagggattctcccaccacctcttcttcaccttcatcagactcctaaaacatacaggtgtgcttcccttcccccacccatattcccagctctctgagtactctgggctatgtcaagttgccctgaccagcctgctaccccagggagacctatattccctcattgcctatccccccaactccatcagatttgagactcctgagccatacaggttatcttgccttcccctacccactttcctactctgtgccaagcccaacttctctgagcaggctgctatcttgggcagacttacattctcccatcaactctccttcacctgaaccacacaggtaagactactacaccaatcaccatagattgagaaagcaagatatttcaacataaaataaaacagttatatacctacaaagccaacaatttcagagaatactagcaggaaaattcccaacacaagaaggataactacatcaaagaaaacaaaggaaataagtagttccataacagcagcaaaaatcaaagaaagtacccccccccacacacacacacaatctaatactgtcaaaatcaaaataacaggaactaataatcactggtctcaaaatcaatggattcaattccccaattaaaaacaaacaaacaacaacaaaaacaaacaaaaagaatcacaggctacgggggaatgccagggccaagaagtgggagtgggtgggtaggaaagtggggggctgggggagggtctgtgggacttttgggataacatttgaaatgtaaatgaagaaaatacctaattaaaaaaataaattaaaaaaagatccatcattctactgcatacaagaaacacccttcaacaataaagatagacattatctcaa

SEQ ID NO: 1463 - DNA, 1600 bp, mus musculus
aaatttcagattgaaaaaaaatattgtttataatgaagtattgttgtctacgttttcattttaaaatgtctccttacctctgacagtatagcttaactttaattatttaaattacccaattctacttgtgaatgtgctattggatataacagggatgctcaatctataatttatgtttgaatataatttagcagtgttatactaccaaatgatttaatctcaataaatcttaaatggccttctaaaagtagaaaccctaataaagaactcaaaacatagaacacattctcattcacactgaaaagaatctagaattaatgaaatgggaaaattagttaccaagaggattgtgagttatttaaaggtttgtaaaatagtttaattacctcatttccaacattaatttttaactctgaaaaatgaattgtgttgtgcgaaatattaaaaacgaaccgacatgttctcacactggtgccagtaactctctgtcattgtggcctggccagctatgcactgatgggcaatggccgacctgtttttatctcacggagacttaatcccaatacgcgggaggcagaggcaggcggatttctgagtttgaggccagcctggtctacaacgtgagttccaggacagccagggctatacagagaaaccctgtctcaaacaaacaaagaaacaaacaaaaacaaacaaacaaacaaacaaacaaaaacatcaaaaaagaggtctaaaatctttccacccagctcgctaggctcccactggcagatcgctaccatgccaacccagtgctccaaacccccacgacctttgtggtgcacctcaggcaaacctatgctttgccaccatatcttactctcttgaacaagccggtgcatgaagaaaacaccacacagatttagttcagaaatgacgataactcattctctgctcagcagctaaaatcctaatcttgtaagccttattatatctaaatcctctggtggcaaatcctgacggatctgccattgaaacccggagacactgttagccacatcttgtcctctgctatccctgtccaatagacctaactttctcctgcttcccctcctcctccatccaacctggaagccctgtctactctcccagtgattggctcctttatacattaggggattgtttcacaagaactcatctgggtacatgactcactccttgtctgcagctcctccctggagagcagaagtagcatcaaaatacaaacagcaccaggcccatccacaacagaattgtactattggaaattcagtcatttttctaggacatatttttgtttccaaattcaactttgtcacgttgtggacattctttatattagactaaaatataaagaatgtgctctattagactaaaattaaaatttaaaagtaagatttattcaattcttttacatgtcatatataccaatgttttgaaagactagtctaacacatgaaaataatatttaacccaattgcttaataatatactgcatcctttgagccatattttaatgaatcgattagtcaaagggagtttataagatgtagatgtggatatgaaaccttgtcaaactcta

SEQ ID NO: 1464 - DNA, 1400 bp, mus musculus
tgagtagagcattgttctgtttttttttttttttttttttttgtgtgtatgtgtgctctccattgtttttgttggtatttaagaccagccttagcctggtgtggtggtgcacacctttaatcccagcacttgggaggcagaggtgggcaaatttctgagttccaggccagcctggtctttagagtgagttccaggacagccagggctacacagagaaaccctgtctcaaaaaaacaacaacaaacaaaaaacaaaaaaaaacaaaaaaacaaaaaaaaaacaaaaaaaccaaacaaacaaacaaacaaaaaaagaccagtcttaatccatgttgatctgataggttgcataggacgattttaatattcttgtatctgtggaggcctgttttgttaacaattatatggttagtttagaaaaatgtacaatgaactgctgaaaagagagtatttgctttttgctttagtgtgaaatgttctataaatatctgatagatacttttggttcataacttctgttagtttcactgcatctctatttagtttcaatttcaatgatctgtccattgctgagagtggggtgttgtttgagctattattgtgtggggttgagtgtgtggtgtgtggtttgagctttagtatagattcttttatgaatgtgggtgcccattcatttggagcatagatgttaagaattgagatttttgagggaagcaaaaaacctggcctgaccagagtcacaagtcccttccggtcggcaccagcaccagagaaccttgggcgggatcttaggacctctggtgagtggaacacaacttctgccaagaggcaggttcgaacgccagatatccggacaccttccttgtaagaggagagcttgcctgcagagagtactctgaccactgaaactcaggagagatatagtctcccaggtctgctgatagaggttaacagaatcacctgaggaacaaggtctaaccaaagacaactataacaactaactccagagattacctgatggcgaaaggcaaacttaagaatcttactaacagaaaccaagaccactcaccatcatcagaatgcagaactcccaccccacccagtcctgggcaccccaacacacccaaaaagatagaccaggatttaaaagcatatctcatggtgatggtagaggacatcaagaaggactttaataactcacttaaagaaatagaggagaacactgctaaatgggtagaagaccttaaagaggaagcacaaaagtcccttaaagaattgcaggacaacacgaacaaacaggtgatggcatttcataaaaccatccaagacctaaaaagggaagtagacacaataaagaaaacccaaagtgaggcaacgctggagatagaaaccctaggaaag

SEQ ID NO: 1465 - DNA, 1000 bp, mus musculus
taagtcccccaaacccttcccccactccccacccactcctacttcttggccctggtgttcccctgtactgagacatataaagtttgcaagaccaatggtcctctctttccactgatggtcaactaggtcatcttctgatacatatgatgctagagacacgagctctcggggttactggttagttcatattgttgttccacctatagggttgcagactcctgtagctccttgggtactctctctagctcctccattgggggccctgtgatccatccaatagctgactatgagtctcaacttacgtgtttggtaggccctggtatagcctcacaagagacagctatatcagggtcctttcagcaacatcttggagtgtgtgcaatggtgtcagcgtttgggggctgattatgggatggatccccaggtagggcaatctctagatggtccatcgtttcgtctcagctccaatctttgtctctgaaactccttccatgggtgttttgttcccaattctaagaaggagcaaagtgtccacactttaatcttcgttcttcttgagtttcatgtgtttcataaattgtatcttgtatcttgggtattctaagtttctgggctaatatccacttatcagtgagtacatattgtgtgagttcttttgtgattgggttacctcactcaggatgatgccctccaggtacaaccatttgcctagaaatttcataaattcattcttttaaatagctgagtactccattgtgtaaatgtaccacattttctgcatctattcctctgttgagggtcctctggctattacaaataaggctgctatgaacatagttgagcatgtgtccttcttaccagttggaacatcttctggatatatgcccaggaggggtattgcggtatcctccggtagtactatgtcccattttccgaggaactgccagactgatttccagagtggttgtacaagtttgcaattccaccacaatggaggagt

SEQ ID NO: 1466 - DNA, 1600 bp, mus musculus
caggactagaatttgtgtatctaaaggaaacctttgcatggtgtttgtctggtttttatcctcagaaacataatagatctatcagacaaaaggcaacagtatctagaaactccagagagagttttgattatgagatgaataaacgaaatgccttctccttctgccctttactaacagtcagtttaaaaaaccgctgagttttcagaaaacaatgtctaacacaggcccaacactctatttaactcacttaacactctttagagagggggaaatttgagctgaagggcaagttttgttttagattgtgatgagtaaaaggaagtggaacatttacattccacaaattgacagtggatttttatgctctttcctcaacatcttgtaagagtgcagtgaccttaatggtcaccaatggcaagcagattacattagggtttcctgtgttttctatttgttggcttgtttgttttctgtgtattgcactactatgatcattcatgaatactaacatatttaaatgaaggtgataggatgtcagaagagagactggcctttaggaataccgagactgagggaatttcttcaggagaaggtttcttcattgttctcccaccctggggcagcctgaaggttaatataaacatttgctcacagacaggcacatggcgtaagcatcacctgggcatcaggctgtggagataacttaatgggtaaagtgcttactttctgtcaagcacaaggacctacgttcagattccagaacaaaggaagtagctgagtaccttctcacagatctacagtgcttcccagaggtaccacatagtttctggaatctcatgagctagccagtgtagctcctgcatcaggaagctatgcaaaaagtaaaggggagaaatgatggggaaggtcattctggtatcaacctctgtccccacatgtgctatcacgcagcgggcacctacaagcagacttgcttatgtgtgcaggcacaagctaggacaaatttaaattaacttcaatttagtcatctgctgtctttgtatcacgaaaccatctggttttagaagaggaacggatgctcattttctgaactaaagttaacatttacattctcatttatatattttgtttgcattttagcattccttccttccgccatctatcatctctaaagacaacttatgcaaaagcaagctagtcctcactaaatgattgtccattatctgagaaaattttaggaatttgtcatggttagctttaattgtcaacttgattaaacctagaatctaccacccagtgaggtattgtctatatagagttgatctgtttgcattactatggggctttgtctcaattaagttaattagtttgagaacccagcccactgtatgtggcactgtttcctaggcagggggtcctgattatatgagactagagaaaccaagcttagaaccaacgagcaagtatgcttcacttctctctgttgttgactgaggatgcgctgtgtccaagtgtcttaagttccagaggcagtgacttcccaccttgataggttattaactaggattgtaaaataattctatactttttaaattataat

SEQ ID NO: 1467 - DNA, 1000 bp, mus musculus
tgggctccagcacggaggaaggcaaggtgccctgccagtggggaaacatttaaccaatccggagactgccggctgccctgtgacaaggacagacagcacaagcataccttctccatctgtcatgagacatctttacgttttcacagtgaaaaacattttctgtaattacacattcagaaagagtttagccagtaattattagaatgatgtggaaagtagtctttatttatgaaagtgtgactcaaaaagccagattttccgcatgacttactttcaaggaaaagttatgtttggaaagtaaatatatgcctatattttaggtggctcaagttggcacttcatgcttgtgttgcttacttgttttgctggatcattttgggacacaatttcacctcatcaaccagtttattattgaatcatatacaagatataagatcaagaaaattgcacaataccattatggaagatgtcagggccccgacaaagatggaagagatgtttaagtcatttgtgttaaatgtgattgtaatactaagaatggcagtgtttcacaaaaagaaaagctaagaatgagaacaaatgaagactctaagcacaagtaagcaattcttatgaagataattctagaatatgaaatctcttcacttaaatattgaagaagaaaatatatggatgctatgttttattccaagtttaaaaattagatgaataacatttctactggtggatataagcaaatgaactaggattaaataataatattttaacatgataaaaagaaataattaaaccaaattgaagttttgaagttttttttttttttttttttttggtttttcgagacagggtttctctgtatagccttggctgtcctggaactcactttgtagaccaggctggcctcgaactcagaaatctgcctgcttctgcctcccaagtgctgggattaaaggcgtgcgccaccacgcccggctcaaattgaagttcttaatgcatggag

SEQ ID NO: 1468 - DNA, 1000 bp, mus musculus
cttgtctaaacatagactttttaattttaacttaaaaatgttaatttctaaaacctacttcaactggtatctaagttcttttacccagaatggcagatcttgtctttctattaaatccgcatgccttcctctgccttttcctgatagatcagaatgggtgatcatatcatcaggacagaacaagggctcctgctccgtagcctgcagaagaaggattcaggcaattacctgtgtcacgctgtggaacacggattcatgcaaactcttcttaaggtaaccctggaagtcattgacacagaacatttggaagaacttcttcataaagatgacgatggagatggctctaagataaaagaaatgtcgagcagcatgacgcccagccagaaagtctggtaccgagacttcatgcagctcattaaccaccccaacctgaacacgatggatgagttctgtgaacaagtgtggaaaagggaccgaaagcaacgccgacaaaggccggggcactctcaagggagcagcaacaagtggaagcacatgcaagagagcaagaaaggtagaaacaggaggacccacgagtttgagcgggcacccagaagtgtctgagctgcgccacctcccaaaacctcaaacaagtacaaacttgcttagataataactggaaaaaatgcaatacacatgaacatttcatggcattatgtggatgtttacaatgatgggaagttcaaccgggttccaccaatttaagtccgtgaggaactttcccagcaggctttcttcagtataccaacgcttgacagagatcacaggtgagcatagatgttcacgtccgctgacttagtgtttcctctgaaagttcattttgcttccttctttgcctgagaaataaaaatgtcatttgccatcgaaaggagaaaaactgcatcagcaaagccattttattgaagcaagagttgaaaataaactgcatggatttagtaagcagatgaatattccaaaacgt

SEQ ID NO: 1469 - DNA, 1000 bp, mus musculus
gaccaatttcccttatgaatatcgatgcacatatactcaataaagatcttggaagccaagtccatgaacacatcaaacctatcaatcagagtgatcaagtaggcttcatccaggaatgcattaaggggagaacaggatgatcatggtagatggaggtagagtgggaaactgggagggaaagtgtagggggaggaaataaggggggcagcattaggtatttggaagggttgggagagaggtacttatggacagaaattcaaacaaaaatatgtagggtttgggggctgaggaacagaggatagcctcctgagggtctcagacatcagggaaacatgaggcttccaagacgcaaaggagatgactttagatgaaatgctcagataaggggaggataaaacctgtagggaccacctccagtgtataggtgtgcttctgcccatccacaccccacccctaccccagccattgtcctctgtcaagggttggttacacctaaccctctcaaagtttttaacccagaaatgttcctgagcaaaggaagaacgtgacaagaaatggggcagagactgaaggaagggccatccagggactgccctacctggggatccatcctgtctgcagtagccaaaccagacactgttcccgtggtcaagaggcacttgtggacaggaatctcaagtgacagttctttgggaggtgtggccagcaactgacagttggaaccaaccattagcctgagctcatggaactccttgggggagcttggggaaaagctggaagtacagagggggactgcaactctattggaagaacaaaatctgctggcaggaccacccacccagtactctgagagactagaccacaaaaccaggagtgtataaggagggatctatagcttcagatacattgtcacagaggatggccttgctgaaagcaatgggagggaaggcccttggtcgtggagagttttgatgtcctagtgtagatagttgttaaagca

SEQ ID NO: 1470 - DNA, 1600 bp, mus musculus
tatatctgctgtgtggttgtcactgatgctgtgttgcaagcaaaactgaggcatatggctctggccttccttgtttattttatattcctttgtgaatatttttatttcctcggaagctttagagtaatgacggtatattactcagtatctggtccacaggatcatgaatggatgtgtgttacagagtactatatgttagaagtaagagaattcatgacaccatggatgcagtatggcagtgattacatcatcaagtgtgtgtccatggggtaagtgacattatccacacacaaaagatgatcattgccttgtatacctcctaggtggctatggctttactatgtagccctggctgcctggaacttacagagatccatcgctggctgtgattctaggtctgcagcaggagacagaacacctgaataaggaagatggtctcaagagtcactacttgcaaatcaatttttattcataagaaatagaatttttaaaaaataggttttaaaagttcaattaatatagagataaaggcaaaaacaaacaatgaaataaaagaacaagaacatataacttctaaataacgtaacaataactcaaagatcaaaaataaaaacttaaaccaaaactctaaaggaaaattattgttcagctgctttcgctttctgcacttttagcagcacagccctccagcctgctgctcctcttggacactaggtatcagtgcagccgcctcagttctctgccaagagacgttgtctgaagagaaaagggaacaacgccctgaatcagccatggcttccttgtaaaggcctattcaccctaagaaaatgaattatatggaagaagattcatccgaggaagattgtgggtgctggagatggtgctcagcaggggcctcctggcctggcaactcattctgcaggatgctgtcttcttcagctgtggccaatcccagctctcttgcagcttctgagacctgggagaggaaggcagttactaagacacaggagtggaggagacaggcatggcagctgtgaggctactgcctcctaccacctcaactgtacttgacagtcaacattaatattttaactgaagttattgatgttaaatctaaagacagggcaaaatattcaacaacagtcacaaaaacatggactgacaaagatcaactcaggcttctatcagttccaaccaaaaacatggcaaaggaagagacctcagtggattacaggaagaaaggagaagggcacaggataccagatcaatgataatgagaagcactcatttgacatttgtacttggctctaatccctccaaggtgcagacacatgggatgtcataagacctctgcctgtctcctgtctaaggacccagatctcactcaaacctctgcatagcattccacctatcatgaggacatgcaagaatgtgacatgttattcacctgtcaccctgtagtgggctgcagattaaagcagagttgaaaggtgcatttgccagtggtaacagtgtctcaaaagaagctaattcagtgtctcacaagaggctaacttccaagaatacttgtgtgaagacagagcagtgaacacctacattc

SEQ ID NO: 1471 - DNA, 1000 bp, mus musculus
acaaacaatgaaatacaagaacaagaacatgtaacttctaaataacataacaataactcaaagaacaaaaataaaaacttaaacgaaaaatctaaaggaaaattattgttcagctgctttcgctttctgcacatttagcagcacagccctccagcctgctgctcctcttggacactaggtatcagtgcagccgcctcagttctctgccaagagacgttgtctgaagagaaaagggaacaacgcactggatcagccatggcttcctagtaaaggcctattcaccctaagaaaatgaattatatggaagaagattcatccgaggaagattgtgggtgctggagatggtgctcagcaggggcctcctggcctggcaactcattctgcaggatgctgtcttcttcagctgtggccaatcccagctctcttgcagtttctgagacctgggagaggaaggcagttactaagacacaggagtggaggagacaggcatggcagctgtgaggctactgcctcctaccacctcaactgtacttgacagtcaacattaatattttaactgaagttattgatgttaaatctaaagacagggcaaaatattcaacaacagtcacaaaaacatggactgacaaagatcaactcagtcttctatcagttccaaccaaaaacatggcaaaggaagagacctcagtggattacaggaagaaaggagaagggcacaggacacccagatcaatgataatgagaagcactcatttgacatttgtacttggctctaatccctccaaggtgcagacacatgggatgtcataagacctctgcctgtctcatgtctaaggacccagatctcactcaaacctctgcatagcattccacctatcatgaggacatgaaagaatgtgacatgttattcacctgtcaccctgtagtgggctgcagattaaagcagagttgaaaggtgcatttgccagtggtaacagtgtctcaaaagaaactaattcag

SEQ ID NO: 1472 - DNA, 1000 bp, mus musculus
attatcatacctcatttgcatgtctcacatctgattggttatactctcagtaccttacagaacctcattatcatacctcatttgcatgtctcatatctgattggttatactctcagtaccttacagaacctcattatcatgcctgggccaggcagtgtctttgcaaaaaactttactgcatatgtacacattggttgtttgtccaatcttatgcgtggtggccagcagtagtcagtgccactcagcaatggcacatgtggcttcccacactccacctggcttagaacctgtgcaggcccctagtgtgctgccatgtttctgtgagttcttctatgcttcagtcctgctgtgtctggaagacactgtttccttggtgtgagccttcctacaggctcctacacacttcctactgcctcttttccagagcttcctaagccccgaggcaagggatctgatgaagacatctcatttagggcccaatgttccaagttctttcactctttgcacatcatccagctgtgggttctgcactagaaccttctgcaagaggaagattctctgatgatggctgagcaagtcattgaaccaaggatgcagcaggattttgttgagtaattttattttactaagttcctttagcagaacattagcatttggttttaccctagctttaactagtctcaggattttggctacccaagcattgtcaggcatggatcctatctcgtagagtgagccttaaattgaatcagatggtggctggttatgcccattccttttgtactatggatccactagcatatcacgcaggctggtcatcactgtagaatgaatggtttgtagctgggttgatgtttgcctttctgctctggtagcaagcagagtaccttacagatcgtgatcaccagtcagcaggggtgaaagctctagttagacaccagcatgacttctccagtatgtaggtgttgtcttcagcgatagggctttaccatctagatta

SEQ ID NO: 1473 - DNA, 1800 bp, mus musculus
ttgtttgtttctgattattaggagttagggaggcatcataatagcagtgaggcttttgtttgtggaagcattggatattaagaaattaaggaggtctttggacaaatacggggaagcaagctagataatggccaaaaaccataagtagacaaacctgaggtaaaagctccgaaggcaatatgaatatagacagcaaggctaagttgagggctgatagaaatgagaacttggtcagagactgggttaggggctactcttgttattcctggcaacacctgtgggtgacatctgacaatggcctgtgactttgttggaggctgtgtttagtggtgacaggctgatttagaagatagagtacacttctaggtctgcagcataaagtcaggctggagaacaattatcattgctgcttttagccaaatttatagcgagaatatgaaacaaggaggagtgaggaaggatttgcaaaatacactgtgtggtcagaaagagtttatgtaaatacatggccaagaacctgatgtaattactgcccataaaagcacacttttcactgacatgtagcttggaggtacttcagtaattatcagtgtgacatcactcatagtctccaagatcaaagaatgtacatttttttcttttcttgtttaaagattttttttattttatgcatgtgagtacactgccactgtactcaccacagacacaccagaagagggcattgaatcccattacagatggttgtggttgctgggatttgaattcaggtcctctggaagaataatcggtgctcttacccactgagccagctcactgtagagcgctaaggtcaaaagcctagagaatgcttagtcagtagaatgtccagcagaaaccagtttcccattcagggaacgtttttcaagttctcgtaaaggaggcactcattggtcacacctggctcctggttccatgttcatagaatggggactactttagcctggccttgacctgtatcccacatatctgcagacgccttggggaaccttagatattttcaaccccagtgacatcattaataaacttttctttctggtactcagtctgctcagaactatccctagtgtaacatattcatagcccactgtgtaactggaagtgccttacggtataagtttaccttatgttggcagtgattgagttgttttaaaatagagcttaggatatggagtttcaaaaatgagaatattttcaaaggtgagtacgagccacactgtgatagcatgagggtgtgtgcatctatcacctcatagcagctggataccagtctagaacacaaaccactcaaatcctttcaataggaaactcattataggatggatatgtatcaaagagttcgggatttctaacctttaattccctcagccacagaggaatagagtattactcttctaacatgcagtatggtagagggggatagcatcaggttatgtatgagataggatgtgaagaacattatcatataatgacacaaattgtaaccatgagtcctgcttatgggcccatagttttttctagggccattgcattgtgcacgtatgactagtggttcctaatgtgctgtatgtctcgctacctcagtgtctgatttactttaaggtattagaaagcatctagaatatggatcagtagagtactggcaaatgttgaatacatactgaggcttaccttagaatttattctagaagtaatttcacacaggagtaagcatttctggttttatctgtagggcattcacagatgtcttatggatgatatttg

SEQ ID NO: 1474 - DNA, 1000 bp, mus musculus
tttgatccagaacaggtgagttgaaccaactggccagagttcagaaagaactagaaagggtgagtttattcagaagtttcatataatttcatataattggaaacatatatactaaagcaatacttaaaaatggcttactcaggagagataaaaggctaaatattttgaagactatagtgagagagaataacaatgtattattgattcttttttttcctattaatcattctattcgcttacatctaaaatgatatctcacttactggttacccctccaccaactccccattccacatcttccctccttcctcccctttgccttttgagggttttcccccacccacactctcccaccacatggctctagcatacccctgcactggggcatcaaacctccccggaaacaagggtctcccctcccattgctgtcagctaaggctatcctctgctacataagtatctggagctatggatcctttcaggtatactccttggttgatgatctagacttgggaaaaactgggtggtcagaccaacctatgttgttcttgcaattggttagtgatccacctcaggccctccagtccttccaccagctcccccaccaggtccactgagttcagcctgatggttggcttcaaacatccacatctgcattggtcagttactggctggacctcccaaggaaccaccacactaggttcctgtcggcaagtacctcttgaccatggcaacagtgttgggtttggtgtctgcagacatgatgaatccccaggtagggcagtccttggttggctcctccttcagtctctgttccatttttatccctattcttcctttctataggcacatttctgggctagaaactttgagataggtgggtggccccagcccttgaccaggggctgtgcctatttacaggaggtggtctcaacaggttctgtcttcctcatctctgagcattacagctaaagtaatccctgttgggtcctgggagcct

SEQ ID NO: 1475 - DNA, 1000 bp, mus musculus
tctacattgttactctcataatacctttagttttatttagtgatggtaggataacattttggtacgtgataaccccatatcttcctacaacacatacttagtatgaatcactaaaagagagaaaattattagaatccaatgtgagtttctcaacaatggtaattaaatctctccaacacatacttcagtagaatgaccatctgatgaagatcaattcatttgtatgaggcacaatttccatcaattttcagagtattcacaaagaggtttttctctcaactaagcctccgtttttttcctgaagtctctttgtctcagcaggaaggctactgaatcagcaattctatgttctcatgaatcaaattctggaacaaataataagactaataatccctctggcccccgaaatatcccccatttccagttgtctctccaagtactctctccatctaccaccatcccaactaattactccttcttgttcctatctcaccctgcccacagtcctctgacaatatctattctatttccccttccaagggaggtcgttgcaccctccatgctacttagcctctctgggtctggagactagcacggttatatgtagctcaattatgttcacaatagctttattcacaatatccagaaactggaaccaaactagacgtcccccagccaaagagtggataaagaaaatgtaatacatagttgagcatagttaatcatagtctttgtgatatgatgaaggatcgcttgagtatgccaaagagtggtatagctgagttgtgaggtagaacaattcctgatgttctgaaaaaaaagtcacatcgatttccaaaatggctgtaaaagttcacactctcactatcaatggaggtgtgttacccttgctcaacaacttcctcaagcataagccatctcttgtgtttttaccttagccattttaacaaggcccaggatttcttaaagcatttgattcatcataaaatgacaattttat

SEQ ID NO: 1476 - DNA, 1200 bp, mus musculus
ttaaaaaatcttagtctttaggaaggttggtaaatgctatcatgggattaataattttcctttaacttttccatctaccactagcatccagaccactgacccagagcagactttattacatagtcaagaaattttaggctgttttccttttgcttctggagttatgaaaatatttaagtgtctgggtcaggttcagatacattctgtcaagtttccgttcttagcactacacgtgaatcaggatgcgatctttgatgaaaaggttagtgttcttgggaatggtgtcaaagatttaggatgatttaacagcattgtgggatttttaggtaggatcagtgtgagtggtcttccaccacaactcctatatggaatataccatttcttgcttcttattagcttccgtttaactggatgagtactgagttgaaatgttggctccaggaagtcttgaagtatgtgccacatgtgtgagcagagcctgaaaatgcctgcttggcaacaccacagaataactgctttctttataactagaggtgttggcagtcactgctcttgaaatggcattctgaatgagctgctgcgccaggaaggctgagttttagggaactctcaaaaatactcatgtaaaatttgatagctgtagaaatgtgtttgagttgggaacagcctaccatcaattgagaactacacatgaaaatactccaaggatgatgtacacatttctctgtcattttggagcagagaaaaagtctctttaaaataagtgggcttttataacaaagggggttactgcttgtcacagtggatctccagagagtaatcaaggcatacttggaaacactcatacatgctcatgaaggtctatatgcatgcacacatgcacactcatctcatatatacacaagacatttatttaagataataaattattctatgggatgatactttactaaaaccaaaatatatttataatcactgaaaataattctttcaaacacagcatatcttcctctatgccattctttggaaatgagttctttgtaaggtagaaaaagtctcataggttatctagacttgcctaaaatatgcactgattaccattgtgtaaagtaaataaattaatattaacctttctgagatatcttattattacaatgatgcttgcttttcccaggcacatgaataattttatttaaccat

SEQ ID NO: 1477 - DNA, 1000 bp, mus musculus
gcgacctctccatttcccttttgaaataacaggccaagtgactaccttataaaagcatcctttattctcgtgaagcaagtgttatttgtaggcttactgcctctgtgggctaacctaggcatcatcctagaagcttctactctccatatggggaagcatcaagctgtgagaagctgcaggacccccactccaggggtggggaagtgcagtctggagtcctgcagaactgcaaggacacagctcttgggtccccaggcctgcatggaggccagggaccgcaggttctagctcttgggcactgcagatgctgctggatgctgtaaaagagctgagaacagaatggggcccagctctagcctagggccaaagggaaaagggtgggaggagagagctccagctgtttgcaggggcttattcagcaggcagcttgacttggtggaaaaagtggcctggagtacagagaggcctcctgtaggagattagatccggctctttagaagggaagacctgctccattgctcgccaaggcagatcccaatgagaagaggcggatcatggttttaaagcagttgtgatgagtgaaatggtaccctactttctcaggcgagcctagagttaattaccttttgcatggaggagtgtctgagaaggagagcttaattgtctaagcccttcaggcctttaggttcctcattaaaatggagatcatgtcctctacctgtggaggggcttggtgtgttgccctccatgcctaatggccacagacctatggaaagctgcagtctcaagtcaggagcctgatgtctaggaacatgtggcaaactaagttgttatgctatcatgtcttcatatattgttaaataaaaccagttaacatgtttatcattttgtacaccagttttctgagaaaagtctgaggcttctaattttttatcagcacacacacacatatatgtgtgtgtgtgtgtgtgtgtgtgtgtgtgtgtatgtgtgtgtgtgt

SEQ ID NO: 1478 - DNA, 1600 bp, mus musculus
accacaaaatttctgctttttacgctttaccaagcaaagtggctgtatcagaaaaataattttattacatgtatcaagataataagcaatgtgtagcatgttgctcatttaagaaaattcttttagatttacattgtggttcatgtttattgaatggtttcattagacaactgatttgtgcctcttctttcaacgatgagagagagaaatacaagtaaagaaaagaaaagaaaagaaaagaaaagaaaagaaaagaaaagaaaagggggaaataattgaatcagtaaagtcttggagaaacatgatgcatgcatgcattcatgcacacatacatcataaatatgtatgcatatgtgtgtatatattttatatatatacacatgtgtgtctctctgtgtgtgtagatatattgaaaccctatatgattgttgggagccgcccccacattcgccgtcacaagatggcgctgacatcctgtgttctaagtggtaaacaaataatctgcgcatgtgccaagggtatttctctaccccatgtactctgcctttcccatgacgtcaactcggccatgggctgcagccaatcagggagtgatgcgtcctaggcgaaggataattctccttaaaggggacggggtttccgccattcgctctcttgcttgcgctcttgcgcttttgctctctggctctggctcttgctcgcttgctcctaaagatgtaaacaatagagctctcgctctggcgctctggcgctctggcgctctggcgctctggctcctaaagatgtaagcaaggggtttgaggcttgcactcttgctcctgaagatgtaagcaataaagttttgccgcagaagattctggtttgttgtgttcttcctggccggtcgtgagaacgcgtttaagagttggtgccgaaacccgggacgagaaaatccgggacgagaaaatccgggacgagaaaatccgggaagaaaaaacccgagacgagaaaatacaagaaaactcgggacgggagttaaccatcaccggcgcaaggaagatccctcattccggaaccaaaactgcaggttatggtaatgaaggttcccataaaacagactgttgagaaggattcaactgcatgaattcagaactcttcagctggggaacaggagtaccagtgagtacagctttacaaggtaagtctggtcttaaactttctaaggaaagtcaagacagtctatcagaagtaaagtgggaaatagctttacaaggtatgtttggccttaaactttttctagtgttaggagcccttttgttctttttcacatgttatcaagtgattaagatagggctaaaaattctggatgaaattcaggacaatctatcagaagtaaagcggggagagagagtaggagcaaagagaaaatatggtacacaaaataagcatacaggcctttccacgggtcttaaacccgaggaaaagttaaggtcaggtaagaatacctggggagagattggaaggaaggagaagaaaaaagaaaagaaaaaagatcaatcagcggaggcttctaggagaaggagcctctactcatcactagatgagctcaaggagccagttt

SEQ ID NO: 1479 - DNA, 1200 bp, mus musculus
gtccacactctgacagttcctcatcccattcccccacccccaccccaccccctgtctccaaaaggatgtccccaacctcatccctaccccactccactgccaggcctctgcactccctggggcttcaagtctttaaagggtcatgtatatcttctctcattgaggccagaccaggcagtcctttgctgtatatgtgtcaggggcctcatatcagcttgtgtatgctggtgtatggtgacttagtgtctgagagatctcaagggtccaagttagttgagactgctggtcttcttattgggtcgtccttctcttcaacttcttccagtcttttcttaattcaaccacaggagtccctggctcctttccattgcttggatataagtatgtacacctgacactttcagctgcttattggacctctcagagggcagccatgctaggctcctgtctgtaagcataatatagcatcagtaatagtgtcaggccttggagcatccccttaagctggattccaatttgggtcagtcactggacctcctttccctcagtcttgtcatttctgtccctgtagttcttctagacaggaaaaattgtgcgtcagagtttttgactgtgggatggtgacctcattcctcaacttgatgccctgtctttctaatggacgtggactctacaagttccctctccccacaagtttcctctccccactggtgaacaccctttcaattttattgcagcctactagcaagagcccgacctcctagcccctccactccctggggaccctgttcctttacccttttccttctgctcctctcagtctttatccctagcccagatccatgcttttctgtctctccctggaccacagaagcactctcactactcaaccaacacatttgccaaagatacatagtaggcaacagcaataaaagaatggaatgcctacccaagagaaaggagaccagatatctacaccaagaaacactgcactcatcataactccagatgcctatgtctgagcacaagaaaccaaaccatgaacaatgtagataacatgtctcctcccaaagccagaaactgtattgtagtaaaccttgagaaatgtactttgcctgaagtgcaaaatttcaaaagaagaattataaatatgatcaaggattacaaagatggtatgaataaataccttaataaacacaa

SEQ ID NO: 1480 - DNA, 1200 bp, mus musculus
tggatctgcagagatctgttccaaaggggtgtgctattactatagtgattgttatatatgtttaatagtaacaggaaaagcataataaaggtgaacctgttgcagattatataataatgtgaagcaggccatctcaggaagactgcttgctagttattagcttgtcccattatgcctcctgacagactttctgcttgagatgggctctataaataccctctccctacttttgaacatttcatctaaggttcctccctttgagtcctgagagtctttcacctcccaaggctctagtgcattctggaaggttgccccaacctcttaccttccgaggttgcctgcttcctttctttttgctggacttcagggcttcagtccttttccctcacctaatatcagatcagggtccccctttcccccctctcccatccactttccctcccaggtccctccctcctcccttgtgaatgctttcttctccctcccaagtgggactgaggtgtcctcacttgagcaccttcatcttgttgaccattttgagttctgtggactgtatcttgggtattctatactctttttttttttttttttttttttgctaatatccacttatcaatgagtacataccatatccttttgggtctgagttaccttactcaatatgatattttctagttccatccatttgcctgcaaaactcaggatgtcctcattcttaatagctgagtagtatttcattgtgcaaatgaaccacattttctgtatccattcttctgtcctgggacatctgggatatttccagctgaggaaaagaaggtctagtgacagacccaaagtggaatccagcgcaaggggaggccccaaggcctgacactattactgaggctgtggagtgctcaaaaaagcgacctataatgactgtcctccaaaagacccagcaagcagctgaaagagtcagatgcagatatttgcacccaaccaatggacagaagctgctgacccctttggttgaattagagaaaacctgaaagaagctgaggaggaggtgatcctgtaggaagaccagcaatctcaattaacctggaccctcaagatctctcagatactggaccaccaaccaggcagcataaagcagctgacatgaggtcctcaacacatgtacagcgaggacttccgggtcagggtccaatcagagaagat

SEQ ID NO: 1481 - DNA, 1000 bp, mus musculus
ggtttggggtttttataattttttttattcacatgacatcccaatcacagccccccttttctcctctcctcccagtcaggtccttacatatgacttcacccacgactctctccccttctcctcggagaagggaaattctgccttaggtaccaccccaccctgggacatctattcccaataagactaaggacctcctctcctactgaggcccaaccaggcagtccatataagggcttcaatggcaggcaacagagtcagagacagccttgcttcaattgttaaggtcccacatgaagaacaagctgtacatctgctagaaattgggggtaggaggggggcagtgtagggttatggggtccgcatccactctgcaacagggcacagtggccaggggaggcaggatgtgagaagtggaccgcacttacctcattccgttgccaggcaagtgttgtgccatagggaagccctgggtaacactgctccaggggtaggaaagtttagtctgaggtatggaacaacaggagatgtctggggggtagggaggaggtggggtggagatcctgagcctgcgatgaggccatagctatatggttcacaggttcttggacatccaggtgcagctgagaatggtgtgggagcccctgctggatggatctagcccagggccagggcatggggagcgaggagggaaagggacctccagctggtacccagagaagagttcttgccttgagggttgtgggcttgggcttgtctttgggttggtagcagccatggctgggagcacagagaaaccttctacaggagattagacagcagctctataggtgaaggccttctcaatgacttcccacggcagatcctgatgaaaagagacagtccatgttttgttgttttttttttttgttttgttttgttttgtttttgacatttattgtcatggtagaaagtggataagtaaatcactaccccacctctcagggtgggaaagaggttaaat

SEQ ID NO: 1482 - DNA, 1000 bp, mus musculus
atggcaatctctgccacagcttccagtccttcaatacttcatatacagacacaggattatggggactctatatggtctgtgaacaagccacggttgctgacatgctgcacgttgtacaaaacgaatggtgagaaaaagctctaaatagttaaaaagtcttaccaagaatatgttgttttagaccattttcctaatggtggtaactttagcttttaaagtggatgtacagttttttttttcttttattggatattttaatttatttacatttcaaatgttatcccctttacaggtctcccctccagaaacccctatcccatccctcctccccctgtctttatgaaggtgctcccccgcctgcccacccacccactcctgcctccctgctctggcatgtgctacactggggcatcaccctcaggcccaagggccactcttcccactgatgtccaactgtggctggatccatgggtccctccatgtatactctttggttggtggtccagtcccccagagttccaaggagtctgaccagttgattgttgttccccacatagggctgaaaaccccttagctccttcagtcccttctccaactcttccactggggactcctcgctcagtccaatggttggcttcgagcaaatgcctctgtatttgtcagactctggcagagcctttcaggaggaagccatatcaggctctgtcaggaagcacttcctggcatctgaaatagcattcggatttgatggctgtatatgggatggatccccaggtggggcagtctctggatggccttcccttcagtttctgctccacactccatatttcctgctgttgagtatttagttcccccgtctaagatgcactaaagcatccacactttgctcttctttctttttgagcttcatatggtctgtgacttgtatcttgggtattccaaactgttaggctaatatccagttatcagtgagtgcatgccatgtgtgttcttttgtaac

SEQ ID NO: 1483 - DNA, 1000 bp, mus musculus
atttcctaagttcagcgggtctcggaccaagatcttaatgtgtcttcaaaaagtttttgtgagagacagaatggtatcattttgatgaagttttcaaatctcttttgttttcttctaaccaattcacagagtaggtaaccaatcagttctcagtaggtaacaatactcaacaccagaactcagttcaaacagaggagaaagctctgtatgtcagcttctagtcttggccttggaataatcctgccagctttaaatagtaaactcatctctactctctcaaacgagccaatgtccttatggttatgccaagtggtgaattcctaagttacctgagacaataacatactgagcacccttccttctaagaagttggtcatatacaggcttgtgtatatgagtcctgggtagggaaccaggctagtgttgtgtccttatttgacgatcttgaaattgattacaaggggagtttgagccactgaaaagcaatgttttgaagtcaacctgggttcctagaaactctccaaactaagaactgaagcctagatgactccatgggagacaattcctgagcttattatgtgtttctttctacatctctgcagagaatcctgggtctgcttgcttaagggctgtgtgaacttctccctccaacctgactcaattaatgaaggatcaaggaagtcaaggctggaagaacatactagtgggaaccataaacaaccaaggtgataaagaaagaaagctccagtctgtacgcatcctcatgggttctggaggttggggttggaaggcacacttcctctacctgacggccaagggctgacacaagccactgtgtctctgaagacctcagctttgcacaatgaataaagaatggagtcaataatacctgctctcttgatagtttgtgagaagttcagtgattcaaagcagttcttttaaaatttccaaatatcaataatatctctgaacatgtgctcttaaaagacatgcactaatg

SEQ ID NO: 1484 - DNA, 1000 bp, mus musculus
tagcgtttgtgcttgggaaccgacaagacagcttgatggcagaggaactgaaagcagaaaacaaaggtaagattactcaaggagctcttattggatgactcaagcacaaaaaaataacctaaaacagaataaagcagccgctctctccctcttgccctgcaagtcccctttttcctgcattctcatgtgcacggctgttaatgctctggattctaagactcctccgcaggttcaagacgcttacaagacttaagtatagcgttacaatttcatctttctgcgcctccttatcttcctgggactctctaagtccactgtgactgtttaagtagttttccttctctaatgccttaactgtcaggagttaatggctaagaggcaacattgggggaggggtatccattggattgaatggaatgtgggtatggctatttttccagggtgaaataaatacctgtgaaccatcacaaccacgcaactcaagctcatctgggagaagggatttggagattatagtagcaccccaattggctggacttttcaatgtgttatctgggtaaccaactccttagatttcctttcaaaaggaaattttctactgaaatacaaggaaactttgagaaagaacaggacactgactgttgattaatacctaagtataacagagtaggtgactaagagttagtttctcattattcaaggtgaatcttgtaatttttcttccacactcctaaacctgttctttaaggtagagatttaatgccaagaatttgttatagccttagatttgtgcaatgaatttaatccttatagtatggggttgggaatttcttggtggtggtggtagtagaggttgatttttgagatagtgtctctctctgtagctcagattgacctcaaactcttgagccttctctcctaatgctgcctcctgagtcctcaaacgcaggcactgcccaccatgcctggccttccctgttatcttcaatctttatgcttt

SEQ ID NO: 1485 - DNA, 1400 bp, mus musculus
tacagttgcctacacaaagacctacacaatgtccataacagtcgacatgccaacatagatatgggaaattgtcacagagtctcatcttttctcgaagatctatagacagtcagtgacttctgagggagggataatcagttttcttcagagataagctccctgatagattatccaattctaaggaattatccctaaacgtgtacatacaggcaacactagttagactcagtaggttttgtgtgtgtgtgtgtgtgtgtgtgtgtgtgtgtgtgtgtgtgtgtgtgtgtaacaataataactataatagcagaagaggtcatgaagtagagaggagtatataagcgaggaaacagatggagttagaagggaagagggcaaggtaggggcgatgtaaataccgtgcattcatataaaaaattctcaacaaaactcattttaaaaaattgtagaaaatggacacccagaggccagcccgcagtcataccacacaggcaggctgtagacacacaaagcatgtgggcagaagatacccaggtggggggaggggagcttgtctaagaacatgagcacaggagagccggccccacccttgtctgccatgaggtgtcatggtcaaaggggagatgtcctccctaccttgctgtcagagcaactgagagatttgacccttcccttcacctgctgcagcacttggaaaaggcttgcacctagactgggcagcacagtagagctggccctggtggtgtgggtgcaagtaagccagcccaagggtgctaagtggaagatctgaccctgccccttgcctacggcagagttgggtgagctagtcagggcagtgctagagagctcttcctggtggtgctggtggcgctgatccacggctttgagttgtcccacctcaatacctatctcatctgtgagctgctgaagggcaacaaagggataactgacaggagttccagtgaggatccagtattgatccagtactgatagtgtagcaaaaaccagaggcctcaaaccagactcactgcagtgaacgtttgcaagtgaagatgtgtgaacagagggtacactgtgggatgtcacgagatgtgtgaacagagggaaactgtgggatgtcacgagatgtgtgaacagagggaaactgtgggatgtcacgagatgtgtgaacagagggaaactgtgggatgtcacgagatgtgtgaacagagggaaactgtgggatgtcacgagatgtgtgaacagagggaaactgtgggatgtcacgagatgtgtgaacagagggtacactgtgggatgtcacgagatgtgtgaacagagggaaactgtgggatgtcacgagatgtgtgaacagagggaaactgtgggatgtcacaagatgtgtgaacagagggaaactg

SEQ ID NO: 1486 - DNA, 1000 bp, mus musculus
ctggtagggaagagaacacagggaagcccaggtggtggcctgtctgaaggtgggtcgaaatggcaacatcagaagccgagagctgctcatctcacggatggaggcttctctgccgctggctaacttcccacccaacatccaaggcccagagtatgggcctcactcccgccaggatgcagggctggttagcccgccctgattttgctaggggcgagatgtcgatctctggagctgcgtctctgtctctgccagcgatggacgaagacctcgttctcgctgctttccttatctcttggagttagcacatcacctaaaacagggaggacagtgcgggaaggtagaagggttgagaaagtcatcttcccggagcttcgtctccagaactgggaaaacaaaacaaaaagcccgcgaggctggatgcaaccaggcatcggtatctgcggcagcggcagcggctttcaattgcaaccctcttcagagttactaagtccacttatgtggacgccgctttcccctttgtgacctcggaggcctctctttgtcctctagcttcggacacacagagcagagttccatggaggcgggtgatttgcgggcccactgctggtccctggtacacgcacagaagggaaacggtgttctgaggccagagccgccaaaagcgctccgagagggacagatggccgctgctggttcctctgatagaggaccgaggtctgcggccaagggacactgaaagccgagtagagcctgcaagcgctatgtctgagcagaagctaggacgctactagcatctcacacatttcaggcccggggtggagcagatctggcaaaccaagaaaacaataccaccctattccagaaagtgcaagaggccagattgaacccccaaaactagaagcctcctgaaagccagaacgctgtctgtgatacttaaaatttccccagccccagtgcatcaggtgtaaaagtaccttcacctaggcttcgccttttggaa

SEQ ID NO: 1487 - DNA, 1000 bp, mus musculus
ttgtatgtcacaatcagaaggttctggctggctcaggtcctccagtgctaacttctatggtggcagcaagggctctgactgccatggggtcctgctactgtagggaggttcagccctgttcaggtgtggcactatcatcagattttctctttaggggctgtctgcagcccattgatgtaactatatctgccatgctgtcaaagaggaaatcttaactctgttcacaactaaatatacaaagggcaggaactccacttggcaaatggccctgtttacttggggctgccttccctgaactcagacaaagttcaggtgtagttgcttgcagatatgggggttttgagcccccagagcacttcacagcctgcataactcagctttgatctataccagcagggcttcccagacagcagcaactcagttgagaactggaggcctcctgctacaagctatttcctcccaggtgtatgccccatgactactctgtcccttttcttatcaaacaaaaagaatttattggaggttgtgaccagctatccacagggagatcttggcctctaccttgaatgcaagtatgtttctgccaggttcaggcaggcccaaacagggctgtcaacagggcatggctatctggaggtgtatttgttcctcacaacgattggtaatgaagtacccgtgttagtcagctttccatccatgtgccaaaaaaaaactgagaaaaatgctttagagatgggaaacctggttttggcttatggctttagatgtttcagtccattggtgacatagtggcaatgtgcaagggaaaggaagtggctttcactgaggcaaagagagcaagacacagagagcgtgaaagtgagctagtgcagtcaggcttacaatgatgtcactttcactcgggtgtcacctcctaaaggccccatgtcttgggaaccctgttaattgagacacaaatggccattacatggccatttgaggccatttaaggtttggagcc

SEQ ID NO: 1488 - DNA, 1200 bp, mus musculus
caggactcggtatggtgggatagtttgcttctgatgatgccaagtaaccttggtttctgttgcttctgttattacgcttgcctcctgccatctgattatctcaagtgcttgctgccctcaatatatctgattgcagcctgtccttcctataatcctagttgattcaggactcctcagagtccagctttctctgtgatcctttgattgtggactcctgtgaacctgagattctgggtgtgtcagagttcttggcagtcaagctcctctgagaccctgaaatatttgtgtgatccagctcctgttatcctgggatcctgttatcctaagatcctgggcatgtttcagtgcctagaagtggtgtctcctttgaggaccgtggagctgtctgctctgttcaaaaccaaggtaaaccagaactgaccaaaaggtacctgagcccctggtcaggaagggctccagtgtccttgttcctgctgtcacaggcccgtcacaattggattggaactgatgttgtgttctgctcaccagttatcctaagatcgcatggagagtcatctagggaccatgggggtgtctgctgactctgagcccaaggtgtgtcgttgttggcgctgaccagaagggacttgtgcccctggtcaggccagttttctgcttccttaatgctgtctcaggtcctgcgcaattggattggaactgatgttgtgttctgctcaccagtgaacctaagattgtgtggagagtcttcgagggaccatgggggtgtccgctgattccgcacccaatgtgacccagtgctggtgctgaccggaagggacttgtgcctcctcacaattattaaattggaaaataaacataaacacatgtgttgaatttcaacattcatttatagaccaagataatactctaaacctgaaagagacaatcactttcttcagagcacctaccatcctagaaggagaaagacagagggtctgtgtccttgaaaatactacaggttgtgtcctgtcacttaaagaggaaggaaaggtctaattgtggggatgctggcgatttctataaagtcggtgcattttaactgagccataaaagtctaatagtctgactaacagttcaaggatcagatggaaaagggttgaacaaagcctttctgtaagagggcagtgatccatgcaaagaccataaatgtagggaactgga

SEQ ID NO: 1489 - DNA, 1200 bp, mus musculus
gcaggaacaaggctgcaggagctgctgcaggctcccgtaaacctaggaatagccagcctcagaatcaaggctaccccaggagaaggctgctcagaagagaaatctgctttctcctgacccctgactttagatctggggaaactatgggggcaggagccattggcagaaaggtgttcacttgggtggagtctccccttgcagctggcccaggggctggggatagaccctgagttaggtgactgtggagtctgactccgtgtgcatttgctctctagtttctgcagagacaagctgcccaactcctggcacagagactcggtcgggcctgcttctggcagaggaagcaggtgagaaccagtgtagcacttcttgcctactggcaagatttcagcttagagccatctcagccccacatctagttcagtctttaacactgtctttgtcccagggctccatccctgtgtgtgcctcacccccacccccgcactatcagcttccttcatatgccatttgtagaaggctagtctcttcgattcaggtttctcttaaagtgtcatcttaaacacactggaataatacccaaaaattaatgtgaagtgaatttcaagtctttgttggggtcttgataaaaaaccagaaggccacagtctgctcagcacagccaagtttacagtctgttcttgctctaggctggagagccttccctttcggctctgctcccagttccccagcattgctctgtccattcactgtccagtcagaggtgtctgtgcgttcttccttttgtactgtccttttcctcttcacagtccctgaatatattaactatctcaagatcaggaggaggccaggtcctgaacccttcccagtagaaggagggtagatgcttgagctggtgggctgagagtggccattgccatgttgcctgtgtattcctctgagtaacccaatctttcgggcccacagctggcagtccggaagcaagaacagtggggcacagccgggccctgtggctctgggccttctcactacaagcaaaggtaatggttctaattccctgggcactcctgccttcaggggctgctctgtaggctgggtcgtgggatccatcatggaagcctgagtcttatctcttgtcctctcttctgcaaggtgtggactgcatggctgggcttcatacttgagaggaggaggaaggcc

SEQ ID NO: 1490 - DNA, 1400 bp, mus musculus
gcaggctgagcaagccaggggaggcaagccagtaaagaacattcctccatggcctctgcatcagctcctgctccctgacctgtttgagttccagtcctgacttcctttggtgatgaacagcagcatggaagtgtaagccgaataaaccctttcctccccaacttgtttcttggtcatgatgtttgtgcaggaatagaaaccctgactaagacagagggtcttctgataggaaagaacacataccgtcagcttgctgtgaaggtcaaaagaaacaggtgcagctccagcacccaggaatcagtcaggaaggctgtaagggtcatgttgagttgtctaggctcagacctaccctgtgcacatgctggccttcagtctccctgtaaaatgccaaggactgaaccttcgcgagatcttaggtccccccacagaccttgtcagtccaaggaacagactatttctctccagcaatgcagcccgctcatcacggaaacagccccgacgtccatccttcctgcttgagcgtttggggagccaggtccccagagtggtacacccttgggaacagcagtaagttgaatggttgtgagtccaaaggcactgaaaactctgtgttcctatattttattggatgtctggtccctttaattcaggggaaggttccatggtgtgagcagcttctgcttctgcttgggttagagaagcccccggaggaggaaagcacggccccgctgggaggcccttccctgaaaagacccttcctacctggggtcctgccgaatgttcctgatccgaagctgcctcctatggcaggcctggagctgctgcctccctcctccatcatgccccgtgcggcaggaggcactgccagggtgagttctcgactgcgctgtcactcactctcctttggtgctcattctccaacccttactactcttatttctagaataccttggtcacttgacaagcttgggtgccctgcacaccaggcctaaaacacagcagtggctagtcttctaacaccccagcccttgagcaatgactgatgtctggacaaccagaagaatcttataggtgggctcccagcagggcctctggtcttgggggacaggaagaaattgaggggctgttgtagggcaccacatctggcctggactcagagcactaagtgctagggcagccatgagccgtggtatgatcagacagacatgctagtgctctggctgtagcctctcactggtgtgtgtgtgacagtctgttggggactgtctttggtgggacttgctatgctaggtatggtgaggacggaagaggaatccagggtcactaagaaagaattcttttactaaaagatggaatctggggtagggtccagtgtctggtgaggcagtcggtccccattc

SEQ ID NO: 1491 - DNA, 3800 bp, mus musculus
ggcccagggcctctaatgcccacccctgggcagacctgggaagtggcgccgatgtgagatggtccagtcagtgggggagtggaagcagtggtagtctcctggggccaggtagatgacacagtggtacagctcattcccttcccgggtgaccagctggtttctgaaggagtcactggaggaagctattgggtaggacagaaagaaggcctggcttttggacaagctccaggtgccattcatcccacagtgagcacctgtacatggcctgcatgtagccaataatgacttttggctacatagcagcctgctgccccaaagccttcccagcctttattccctcagccccctatgccttttcttgctagcctttgctccagctaccaatcctgctactaccacagctccaatcctgactaagcgatgacccacctggagggaagggcaggtcctctgtattggctcgagggcccaggaaggactccaaggagtaggttacgccctttacctgctccacctcagagttcttcacctgcccaaaggtgaggatcttgccatctgatgggctggtctggaggagacagagttttgaaggtaaggagggggtagtcctcaccttcagtggctccccaaactctaccacctgccaagtcctcagggagctccagtccaggtcaggagggagcctcccggagtgccacggccatgcagtgctgctaagcctggcttaaaggcagacaaggatttcatttcctaatgaagaatggagacaagggccaggccttaccacacagtgcaagccacatacgggccgtgcctgaggcttcagcttacgccggaagaactcgctgaggttgcggtagtggtgcaggtcctccactgcagcctcagtcatgttcaccccaaaggtccagatatacaggctgtagactggcctccggagccagtaaggaagttctacttggttgaggcgaccacaggcacgtgacagcaaacgcgttggcacagatttatacagggacacctgtaggccacagtgcaggaggctgagttggtcacaaatctgagtactttcatacactccaaccccccatccccacatgagtgagagagaaagaaactctacagacaccaccacgaagacccaagtgttcaggttggtttgtgaggtggctgtttctcagaaggaaccagactgctcaccaaatactcaaaacaaggctggatataaatgtaccatttttttttttttttttttgctattgcacaaaaaggtcaaagagcagctgccttaatcccagaggtggagactgggctgtatagccttggttcttacaaatggaagatgaggacctggtgcaagcctgaaagatcactgagaggcatgctgcccttgtgccagctcactgcccacattccagacaactcaagaaggcatcaggctcccaagagcaaagggctacagtcctgagcatcctcttcaaaaggaagcaaggatggtgttttcactcccagatctacatcaccctgcccctggggtctccacagaggcaggaggaagctctctgtcacccctctagtacagagcaccaggaggcaggtaccagtcccactttcaggccagagggtcctgcagagcacttgagcgtctgccaccactgctgtggtagcagtagcaactcccttaggagtgaagtaattttaccaagtttcaacagtccttccacactaagtcaatgtcttctgactgatgtttagtgacttggacagagcaataccatcaagtgtccctaggctacgctctagtgtctagtatacttccttgggcttttatggtgcctacctagactaccagtgtcctagaagcagggcttcctttttggagtcagtctgtcaagaagctgagagagagagagaacctgctggccagggcctgcctgagatgctgcctgtgcagtcctgagctcaattatgtactccaactaacaggcccagcctggctacagcttcctaaaccaccctctgctggctagactctgcttggctttttcttacaatcacctgttttctgtggaaaccagtgacattgttttctgatttacaaatgtaagttccttccaaaaccagcgcattctgaacagggctgccaaccaaacaaccttctcacacatatttactcatgagtgcggtctctgataagttgtttccttctctgtgcctcgccttcaggactgtctagggagggtcatggccagtaggcctatttacacttaccctgctcatgggcctccatcccacctggctgaggggcccgagcgcacggaagggcaggaggtagtggaggatggtcagcggccaggagcgcagtttcagagctggtctggacatgcagctcagctggcctagcctccgccgtagggccagctggggaaagtacaacctgcaggacacatgtccacacgtggcctgggtcagtgcctaagtctggaggaacctgaggagcaacctctcagccagtgccggtcctgctccctacccctacccccccactcacccccagcaagctgcctctctctccaatggaaccaaagagttccagcaggcattgcagtgcccattcaattctaaccaactgtagttgtgaggcaggggcttggctgcctgactactgggcttatttcccagtgtctcccacctgccggccggctgagtgggcggcagctcaggaacgactcctaggagcctctaagtacagcagcagcccgagcaaaggccttggagccctgaatgggaaggaagagaatctgccgtatacccacaacctcccatgcttaggagggttgggacccaaagacagttctgccctcacaggtgccagaaagacgagacacagtgccatgagcctagacagttgggcgacacctgccaagtcttttgttacttcattgtggcacctgggaaaaccttcagtcttttgcttcctcttctgccaaatggtagcagtggctccatccacaggctcaggaggctctccacctagctccaaagccgcctccctgctctgctacaaccacatgggtgacccactagttttacaaggtcattgtcttctattcagccagctttccaaaggcacagagaggccttttcactgtaagctcagcttcctgaatgcaactaggttccctgtcacacagtgggcatcatgagactatactgccacccactctgagaatgtttgaaaaagcacagttgattaaacaagctaaggctgccatctgagccttgctcaagagaagctgagtcctgtgtctcctagaaactgagcaaagcaaagaacaaaaggggattgcagcagagaactggtgaacggcgcaggcgccaagacaacagcacaccaactgtcctgctctcctcctttctcttccacaggaccctactatgtctctaaaaaaccagaggaggtggcagggaccaagcaaagacaaatcagtgctctcctgtgggctgccctgcccaagtcactgcagaagagtggacgccagtccagaagagcttgggggaggatcaggtgtaggaagcaggggtctagggaggaaaaagggggcctcagtgtccttgccaaagaccaagacacaggatagaagcccactgcttcccctgccttaccccctgcccccagccagagccatgggtacctgaagtgagtctcctactcagggcacagaggactccctctccagacccctttagccagccccctactgccactcccccaaaggccactggacttggtgtctgac

SEQ ID NO: 1492 - DNA, 1600 bp, mus musculus
cacacacacagcagaaataaacgtcccaggcccctgggatgtcttgcccgacgctgtgtgggcaggcaccccagagattctaggtaacaatttatttttgaagaatcaacctgaaaacaattaaatgcaatttatgaaaacagtggggaaaagtgagcgacaagcccaattagaaacgttattttaaaagtgtcagcatcccagcatcttcacacatgctggcatgctggagtttagcttctgtttagcagttgtagaaagacagtcaccctggaccaggctgaggagggtcagagggaggagatgtataagagatgctgccctgggatggattctttttaggaaaggaaacagacacagagaaccaaaggcatctgcaaaaacccacacatcctcgctcactcagaacagcccctcgccatggccacaggctacagagagcttgacaagtgtcccccagggaaggacaggacacttcaaatcctcttgattctggccatgctagtggtggcaggagacgtcctttgaggtgacccactgaggtgagccccagggctggctctgcaagtgggatggaggtctttggtaggctgagttcagcctccactgtctctccaaactcttgcttcatcccagaaggaaaccccaccccgtgccgagtgtttcaatgaggaggaagacattggtacacacagcagaagtgaaggggccaagagagaaaaagaacagatgtcaggttcatcaccagaaaccagcaccttaagtttctctttacaggacaagcagcatcgtcattcttgctctaccaagactagttgaacaacttcccacctagaaaaagactggctctatacttatggaaccaagtaaggacccatagtcctaacccatgatattatcctgaatttatgggaggccagtgtgatctgccctcccccacctccgggctcagaacattccctctgggtgagttaatctggctggctcagccccacgatgctttgtggctgtccaagaaattttgggggagccattgggtctcagagatgttctcttctatacatcacagtggacccaatacaggcccctttcagaggcctgctccttaagggtcacaggaacaaagatgtcctttccttagcaagttgttcccaagacataaggagtgaggacagctcacctgctggagcaccttcttctccaaggagtgaaagtcatgtttgccaccaaaagctcccactgctcctcttccagtaatagctctaggcagggctcaaggtagagctggccgaaatcattgtgctgtgcagagcctggggacacagagcacctcctggggacacagagcacctcctggggacatttcagctagctcatgaccaagaggagtgggcacaacccacctttcttccaagctgatcctgccttccccaccaactgagcaggcaggccagactggggcagaagacacgtgccttttctctgtagccttaccccttggcaagggccccgtgctgtaggtcatcaactgcagtgtgattcctctccacgccttgacttacccagggattggacgcctggggcaggacaggtctcctca

SEQ ID NO: 1493 - DNA, 1200 bp, mus musculus
catgatctaagcttcttttccagtcagtgagttccttgaggctttatattttgcaaaataatagtgtgtgcagggtgattggtccataaacaattaaaacaggcacaaaataggtactctgtgccttggtatttttcatgccacttcagttcagtcaacttagggattagttttagttagtatatcatgaggtctctgacctgggtagtactaagagccagagaacaataatacaagaatggaaagaagataaaattaccttctgtcttgtatatcatggggaaagagtcctaatgtctcagatactcaatctagcctgattctggctacaccaaaagtgactgttggttttatgcaagttacttctctatatagctctttctatcaatctatatcagacatattagtaaaccaggaggtatactttgaaaatagctcatgaaaacagctgcatgcaataagaaagatattctagaagtaacgatattaaagtgaaggtctgctgaagctagaatgcttgggtccacatagagatgattagatggtaaaatttactcccccagattctacagttgtcacattggcccaagcatcctgttagatagatgaaagaaaaccagaagttgaatagaaatcccatcatccataaactccaagtaagcaaggtgttctacacagtgcagatggagaatgtatcaggtttttctagttaccatgactgtgacatctcaaattatacaggaaaactgtcccccacaattctgaagggaaacttctagcatccaggtgctgtccttatactctcaccaaagcccttgaggggcaattagcctgtggctcttcagcctttcagcttcttaggtatccctgttgcttgctggtttgtattatgtctcactggcatcaaactttgtcttcatgtggtcttctctctgaatatgtgcagatttccccttcacacaacaacagtgtatattggataagggacctattcttcaccatggcttcattttaatgagttatatcaacaatatcctgacttccagatgaagtcacaccttgaggtactcaaggtgagaacatcattatattttcttggacagaaaggaatgatggtcaacagtcagcaaggattaggaaggttgatctcagccccaggatgagattgtcttgtctcaatcctgaatggaatggaatgta

SEQ ID NO: 1494 - DNA, 1000 bp, mus musculus
ttattcttaatctgtggatcaattcactggcagatgcttacaatgttaacattgttgaaaagagctagaaagtaggtggtcgaacctagttggagatagaatgtcaaagatgccataccctgcaggtttacacctagcttgtagcctgtttcctcctctctgtgtttactgggtattatatgaggaacagattcctttgtgatgattcctctctgttgaaggcctaacggcaatgggggcagccaaccccagacaatgaacccttaagttccagagaggattcctcaggtattggttacagcaacctaccactgattacttcaacacatacatcattgatgattggtaaggctagcttcatcttcattaataaggatagtccactgtgcaatcagaacttgacaatgtttaaacattttcaacatccctttctccatcatatctttccacggagtgagtttcatatgttttcctagtatcataaataaaatatttgaagaattcattatttaaagaaaatatatttgtttactcacatctatgattggagtgaacttgccaagatatagaactttttgttcttaaagtattagaaaactgacttaaattatgctaaaattacaaaaattacaaaaccagggagtatgacttttaatcacttactcagtaacctttaatccctgtggtccttctatcaattccaaggtatccaagtatactgtctgtattctttccctgtgctgtggtgcaaaattacagctatacctgcagccaggtcattctgttctgatgctaacattgtgtatcattgctctacatggcataagaagcaaggacagggattgtagtgcacaggcatggtgaagctgtgggagtctgggactatggctggtattagaggtctaaacatggaagggaatacagattagaccatctctacctgttgattgcattacaacagatccactttattattgtgatttcaaaagtaattttctgc

SEQ ID NO: 1495 - DNA, 1000 bp, mus musculus
ttggaatatccaggacttgctgtggtgggagtactgcgttctgatgatgccaagtagtcttgatctccattggtaagattcttgcatttgactttcaccatctggtaatctctggtgttaggtgttcttgctgtctctggctggagcttgttccttctttgattctgtaagcctgtgtcagcactcctgggagaccagctctctcctagcaaaatcagtgcacagagggctatggaacagtcccatctcctggctgcagatataggcccattgaaccctgtctcatctgctttgtcacttctgcagcctgtgcactcctgagtggacccaccttagatagtcaccagagagaaaatggcaatctcacctgggtcctggggtcagacacttcctggaggcaagctctccactggcagagaaggtacacagagggctgaggatcagccccacctcttgggtgcagatgtaggtacttaggagcctgtaccagaagctctgctgcttctgagacctgtgctctcctgagtggacccccttagagagtcactggagagaaaatggacatatggccaaatcttccagagacattttctcaattaaatttctcccctttaagagaaacttaactgcaactttatgtaaagttgacataacattacgaagcacaggtcttttccagaagaggtcaactcaccagagttactgtcttagttagggtttttattgctgtgcacagacaccatgaccaagaactcttctttaaaacaaaacaacaaaaacaaaacaaaacaaaaacacacaaacaaaaaaactgtatttaattgaggctgtcttacaggtttggaggtttagtcacttatcatcaaggcaggaacatgccagcatctaggcaggcctagtgtaggaggagctgagagttcaatatcttcatctgaaggctattagcagaatactggcttccagacagctaagaggagggtcttaaagcccatgcccatag

SEQ ID NO: 1496 - DNA, 1200 bp, mus musculus
acacatacatacatacactcacacacacacacacacacacacacacacacacacacacacacacacacaaacccaagggcatgtcccatgcccccagtcctggagtgactaaagagagagaccaagtgcctacccccctgcagtgggcaccagtatgatgagcaaatatgtgctggatggatagataggtcagagagggtacagggcagaaagatgggagagaagtgaagctgagcagttcaggcaatgtggagagaagtggaaccagagtcgcaatagcagtgagaaacaggcggatatgaggagcctatacaactgcctctggccatggagaggtcctggctcaggctgctgccaaggaacatgacttggtgggttcagcgccgtactgcagtcagggtctgtgctgatgtttgttggcaatctggatgtcagtggtctgggctgctgcctgagaccaatgtctgggactatactgtcaccagcagctaaactgatctgagtcctatccagggctgctgctgagggccatgtttgggtccattgtcctgctgtgtcaatgtctgaagcctgagttaccaccaaaggtcatgtggatgtcagtgggctgccatctgagaccatgtggatgtctagagtacatacagtctgagtggcctgtgctaccactcaaggctatagtgacatccaggcccaactgcatacttgtgtggggagggggtctgcttctgcagtcctattacagctagagtctaagctgatgtccaaggcctgtattaacagcaaagtccatgcagatgttgctagtctgggctgacacctgacattttgatagtgacatgagtgtgggagagaagttcccacacacacacacacaaaatacaccacagatggggtggatagtccatctatgaaatgctggggtgcattaagggtccaaagctataggaccaacataacacaggtcaacaacaggatatcctggaggagtccctatgaggatccagtattgatagtatagcagaagtcagagatctcaaacgagaccaatgatgcattgtaatgaacatctgcaagtatagctatttgggcaaaagagtgtactatggtgaaaccctgtgacacacagcagcagcttccatggagagatggttttggggggagggggtattttttatttatatatttttttcttttgga

SEQ ID NO: 1497 - DNA, 1000 bp, mus musculus
tttataggtttctttcaagactctattcatttcctgtactatgttcataaggggtattttaacatccctgtcttgtgcgtcaagtacatttctcagggcctgtgtagtagagatgctgggctgtagtggagggatattgtcctgactgttactatgtagtagagatgctgggctgtagcggaggagggatttgtcctgactgttactgattctgcttttatgctgtgtctggtcatctgagattgggaagattgaaagtttaggtgctgatatctgggcttgtcttggttgggtggggtgttttttccccatgatttctgttgttttctctaatttttataggggtatggtagttgtttgttgccctgggaatgaaatcagagagtggggagaggccatagtaggtagtctgctacagagttggaggtgagactgggaaaaggtgagaaaggtaaagatccacagttagattgtctactattctgggtagggtcctaggtaatgcctgctgtatttagggactgggataaagagatgtgtacggagaaggaaggctggcgtgggagatttgtggggtctactggagttgtgggcagggagggaggaaaggctgcagcaagaagtctgctacagagctggagacgaggctggaggatatgtagaggtgaagatcatgatcagtctccatgctactctcgcaggaaagctggctggtactcagagaatgcatgttggtgtttggagctggaataatgtgacgggttggaggaaggaagttggaggctaaggtctaactgatctgttggaaatggggggcagagaagaaggcaaggctgcaggagatggtctgccacagagctggaaatgagactggggattggatttaaaggagatgaaggacagacatgtgaagatgtgcagttggtctatttgcttccctgctgtgcttcatttataacgggattaatcttgtttgtgatatttgcaccattagcatatc

SEQ ID NO: 1498 - DNA, 1000 bp, mus musculus
gtttctaacctggacaactggaaacgcccaaagactgaaccaccaatcaatgagaactcaagggataagcctaggctacccgtacagatgttcagcttggtcttcatgcaggtctcccaacaactggagcagggacttaccctgactctgttacttgcctgtggaccctgttcccctaactgggctgccttgtctgacctcagtggaagaggatgtgcctacttctgctgtggcttgaggtgccagggtgggatgaaacctaaagaggacctgaaaaggaggtgaaataggggccatacaggggtgaatgggaggagaggggatctgtgatcagaacataaagcgaatcaataagtaaattgattgaaaaatagaatttttggatggagagaactagagcaaagaaggcagttgaaggtaagagaagaaagaattcctcctctgctttgagtattattctgcatctttatttctcatcaacttaatgtagtatctgatacttccacactgcagcccttagaagtcctctgccaggtaagaagcaggagtacatatcattccttgaagtgcccaagctttgtaccaaggccaagaaacatctgggcacctgatgtccgaatgacaatatcactaggcttccagatctgtcacacttatcagtggcaggatcctctgtcccaaccccactgctgtggttcatggagattctaaacaagacctgcccagtcaacccaaggcatccttcaagtcacagtcatttaaaatttttctaacatgctgtaattaagaatgggtaagaatatatcagtagagtggtagggtaaatggttcagcaggtatagcatttgatatgccagcatgaggagcagagttctggttccagcatccatgaataagccaggcaacatgcctgtaatcccagtgtgatgggggccggaggaggaaatcactgtagcaaccagactagctgaaaaggttttcaccatgtttaggtcaaaaa

SEQ ID NO: 1499 - DNA, 1000 bp, mus musculus
tgtctaatataaagagtattcaacaaaagttgtaatgtttctttgtttgcttttcttctgacaaattctttagcctcttagtgtctgcaataacatcgtagttacagtaacagtgattgaaattgaacctaacttaagtagtttccaaatttatctcacttaatatttactaacatccctcttctctgctttaaaggtaaagaaaatggaagttaaaatgtcaaataaaatgtttcattaaaatatggattccatttcactgaagagagttccagtctactgctttgagctctccttacaaaatactggaaactggagttgatttccttgacatgacaggagatccacacacctgatcaagctcaatgcagctcagagctctaagcatgtcctttgaaaactcaggagaatcactggaaagaatgatgttttatatctcagtaagttgcaagttgcccatatgctgttttggtatgaatttgaagtgtccccccacgaggtcatgtgctgaagagctcatagtttccagctgtttggggaggttgttgaacctttaggggatagagactttctggacagtatgttagagggacaaggacttgaggttttgacggtcagccccactttctgctctctgcttcctgtatagccgaaataaggattgaccttacgtgcacctcccatgactcctgtgcaatgatggacagtagctcactggagctgtaagcttgctcctctaagctgctaactgttaagagtgttctgtcataaaaacaaaacaagtagctaagacaaccaataaggattactctcttgccataacgttctcctgaagagtccaggttcatgcagtcatgggtgtttcagctcatcaaaaggctcataaataaggagcccaaaggttgtccaaaccagagagcataacagatgctgaaagcatattgaaagcacagaagacacagaagcaggaatattgagagctccacagtgctaatagtca

SEQ ID NO: 1500 - DNA, 1000 bp, mus musculus
acagtcatcaaaaccaaacactattgtgggtgccaataagtacttgctgacaggagcctgatagagctgtctcctaagaggatctgccagtgcctgacacattcagaggtggatgttctcatccaaccattggactgagcacaaggtacccaatgaaggagctagagaaaggaacaaaggagctgaaagagcttgcagccccataggaggagcaacaatataaaccaaccagtacccccagaactcctagggactaaaccatgaaccacagtatacacatggaggaacccatagctccagctgcatatgtaacagaggatggccttgttgaacatcaatgggaggagaggcccttggtcctgagaaagctagatgccccagtgtaggtgaatgccaggacatggaagcagtagtgtgtgggttggtgagcagggagaggggggaggggatagcgggtttttggaggggaaaccaggaaaggggataaaatttgaaataaagaaaatatctaataaattaaaaatagaaatttacctgaaacctgggattctgaaacttaggtttatgtatgacctcaaaaatcactgtacaaacattgtgaatgtgtgggttttgtgtgtgtgtgtgtgtgtgtgtgtgtgtgtgtgtgtgtgtgtgtgagtgtttgtgtgtgtatttgtggccgtgtttcccctgccccctgcaaatgtacatggagaacgagtgtgtgattctgttttcttttttctttctatagagatgatgtccttctcaatgtctttaataagttaggatggctcctgacatacaaaagaattaaagtcctgctttacagaattaaacattacctctactttttatgcactattccatcatccacagatcattttgcctacctgcttttcagactcaaaccataagtatgctcagagccaattaaaaaaaaaaaagccaaaaaacttttttactttgaaaattttatttgatcaacagtctccag

SEQ ID NO: 1501 - DNA, 1200 bp, mus musculus
atcaggcagaaggacaagagtcaggagacaggcatgaactgagagaagcagggaggtaaagggatagctgcatggaggagatgcagtggcagagaaattgggtaaagttagaagctagctgagagactctctcagcacaaaggccaatagccttaaactatatagatttgtccacatctttattattaaaccaaaagtctacaggcctgcattagtggtaaattcctaagtcactgaatttcataatgtttctatgaggctacgttctactgtataatctacattcataaaagtatatttcaactttaactttattcaacatcttttatatatgatattcaatagataatacatgtgtattatgtttaatttctgtgagtacattggttgtatataaaggtaataataagtaataattgagacacctatttatgtatcaattaagcagcatttttaacattctaagtgttatttcttctggtctactcttgtaagattttgtttggttatgctttttcaagaacttcaagaatatcattaaattatttgtgatctctaaatttttttttactctttttttaattaatttttttttacttatttactttccatcctgttcactgcccccctcctggtcacctcctctcacatttattcccacaaacccctgtttttctcctctgagcaggtgggcccccctggatataacccctacctgccctgcccagcctgccacttcaagtatttgcaaggctgaatgcttcctctctcactgaggccagacaaggcagttcagctagaagaacatatcccacagacagataatggtttttgggatagctcccattccagttgtttgggatgcacatgaagacaaagctgtacatctgttacatatgggttggaaggcatatgtccagcccatgtatgttctctggatggtagttcagaatctgagaaccataagggtccatgttagttgactctgttggtcctcctctccctcaagatctagctataccactcctgagcatataccaaaaagatgctctaacatcccacaaagatacttgctcaaccatgtttatagcagctttattcataataagcagaaacaattggtatctactctctagtaagtggatatcagccataaaatacaagtagcattctatattccacagacccaaagaagataaa

SEQ ID NO: 1502 - DNA, 1200 bp, mus musculus
ttaacttgcattaacctttcctctgaggctgacaaattgtgcatctgtggcttcttcagtctaatttctcatgtcactgccttgcaaagcatacagattcataatgtcactgtgtgatggatgcagactcctcctttgccttggggaagtgtctcaacccacttagattatctctcttttatttatttatttccagcaccacctagcacctacttttaaatgccttctgcgaatttctttcccagaggctcataattttaggatgaacggaagggtacccctgtcatgaatcattagcatgctgctatacaagagccaatgctgtcctctggcctgtcacacacagactagccttcatctgtgtgtccactttgtcactaacaatttgatgactgaatataaggactagtacagaaaaatcaggtcagaatgatatgtgggaagcaaactgacagtttttgtactttttacctgtggccatcagaccatccagttacattttccttaggatgtgaacagatggaaaagaaactcaattctttttgtctttttctttctttctttctttttattatataatctacatctattctatacaaacttgagtataaaatctaagcaattgtccaagaattcccatttctacttcttagagagagtgttatagggatattaacttagggaactctcttcctgatggtattcacccaccctacaggtacccaggatttgtttctaccatgggcttacatatagatcaagaaggatgttatgatggctattcctggttgtcatcttgactatatctgaaatgaactaacaatccagaaattgagggcacactgtgatgcagatcttgaggctggaagacactagcttctaacctggatattgacatggggatcttgaggcatggtggccataaaaaagcttaggcccaagcaaggtagtacacacctttaatcccaggacactgaggcaggcagatctctgagttcaaggtcagcctgggataaagcaagtttttttttttttttcattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctt

SEQ ID NO: 1503 - DNA, 1000 bp, mus musculus
acaaggttaattagaccaattgtatttaatttaaaaccactggatgcagtgcaataacattttaaaaggttatataactctacaagtgagaaactttgtaggaactaaaagggggtgaagggaacgagcaaggggggagggaggatagcccatgcccggccagagttcctcctatgctctggacatgtggacacggaagagctgtcagaagttttccacttggccccaggtggacatctaagccactgacccctctcaatgggggtgggaggggagagggagtggacaaggggcatctcccaactgagggctctggggcgacatcctgtaaccccagggttatgggagagagggcataagaagagaggttcgcacacaggcgagtgtaagtgcagtgggacttgatgaacatagacagtcaatggttttataactttattgtagaaaggcagggaggaagaagagaaggagagagagagaaagagagagagagagagagagagagagagagacagagagagagagagagagagagacagagacagagacagagacagagacagagacagagagataccagccatggccaagaggagagagaggggaaaaggagagagagagaagaaaggctagaaagtaagaaggagagagaggaagagaatgagaagaagagaaagtaagaagagcttaaggggagtaagagcaagagagtgaggaggggacaaacagcccctcttatggtatgctgttatctttggtgttgctaggtaactggggaggagtttagcctgaaggtcagaagcttgggacattgcttacatgactaaaagccacacttctcctgtgggggcagtggggtggtaacttcgacaggagccttggtccaggagacatgagagaactccttctgtcccatgtaggtgaattatcccggggttcaacatctcagctcaactggagaccagactgtctgtgtagagccgaatgttcaacaaaactt

SEQ ID NO: 1504 - DNA, 1400 bp, mus musculus
gaagaatttaataaaataagcctgtatttttacatggattttacataaagaaaagtatatataccgtctaaatacataactatatagtttggggggaaagagtggttgtttattgctatcaaacaccaagaggagaggcagactcaattattgcatcagggtttcaagtctgtaagggaggtgctgatactaaggtctagttccctaattggttcttgattttgtcaataaagaaggccagaagccagttgctgggtggaaggtacatgtgggtcttccgggagccaggaggaaaagatagatggaaagaaagagagacaggattattttgccaggctttggaacaagaagcacacagcaatcatgtatgatctcagggcagccagggcctgtggctctgctaacgggttgccagagatgtttctcaggggctgattggacaagccactgactttaggacagaatgagagacagagatggtggtttggtaaggcacaccaaaccaggagggaggtagctgtgcccaacaacagtgcaatgaaaggcaagctgtaaaatgacaaactgcgtgtgtgtcatttatccttggattcgagaggctcaggtcatgctggtaactcgacccctcctggagcaagggtcttaggagagggctgatggatcagtcgatcctgaagcaaagacaggtaggaaagagaagcctggtcagtgttggcagtggaacaaaagggagctgggaatggacccggtagccaagcaaccccagggaaaggccatagtgtacattgaagctacacacaagtcttctgtatttccctggttgtcattggaggctatttttagttcttatatctaccagctcgccccgtcttggtaagatcatcagcaaacaaattctaaaaagaatagtcacatatgcagtaatagaagacaaaagtttgtatacttaaaattcatgtataataagttgctaacttaactaattctacaagatagagccccatgctttttctagaaacatcttccttcattggaagcgatattcacccttatgcttctgattttataaaagaggaagaacaatgggatctgcaattctaatacataccttataactaaataagttgaatgatattttatttctttctgtggctgaagagattacttttcctataaataccacatttgcttgatccattcatctgttgatagacctcaaagctgattctatgttacatccattgtgattcttgccatgagattatggataacagacacttctatgtcgtcttattctaatgacatgtagaatgagataaataaattatttatgtgcttttaattttaagtcataatatttaaattacagaatgtaaaaataaagactaaataccactgga

SEQ ID NO: 1505 - DNA, 1000 bp, mus musculus
ttcttacaaggacctgagaggtacgtggaatttttcaagtttatgttattataaaagcattagcatttgctggaaaccatattttgaattttccatttgtgacttttcttgatttagtcatatgtggtatacctccgtggtggtgtcaggcagcagcagtggcaactcacaattcccaagctgtacaaggtcctgatgagaggcaactcagaccatgtgatacattgtattactaacctatgatatccagtacactagagatagtaactggatttttcagttgaatattttcatcctagaatagacttatctagaggtaatcccattgcaaactgtaaatgttggacattcaaggagtacctttataggagtcctgcagtcttagcctatgaggaaggaccgcagaccatgacattatgacaaaacataaagtcactgaggccaaagtttctgttgtttctgaagaaacaacagttaacaagaaaggatttgggagagcagctgttaattttttatgatgagctctgtggaaaggttttatcatccttcctcatatcattgtgtatgacaccaaagggaccaaggagtaatgaagaattgtacatgtggagcttattatagaaggggtatttacagattcccctactctagtgcatcaaatatatcatgtagctgcaattctcctttccatttcctgctctctttaagatggtacaagtagtggtttgaatgtgatgtccccataatttcaggcacttcaatacttgtcagttggaggcacaatttgggcaaggtcgtactggaggaagtatgtcactggggtaggatttgaggttgcaaagcttcaagccattatgaatagagtatagtctctctcttcctgcttgtgattcaagatgtgagctctttgcctcttcaccagcagctatgctttcctgcctcttgctgcaacccttccgtaccatgttgggctctggaatcgcctaactagcacagtgga

SEQ ID NO: 1506 - DNA, 1000 bp, mus musculus
ttcttctcttcagatgcttatatcatttggttacaaactagacactataaaagggatcacaccagaaagttcattgtcataagagagacttttctgtgctctgcaagaacattagtggcttcctaatcttctactgttgtgaaaatcagaaacacttctagatattgccaatggttccaatggtttgtgaatgtgcataagtacccacagctctgagtttggcccttcttccaagcatagtaagcatcataatgttaaactccacaattaagaactctacatcttgactctcaagtttattccatctaatgtctaattaaataccctgaggttcatgtgtctgtataattttccttagggtctacacactgcaaacaaacaaaagaagaacaaaattttttattattaattaatttatgcttttacactccatatttcattccttgcccactgatcgaccctccatctgttccacatcctacaccacctccccatccctccaccctgacctctaaacttcctggggcctccagtctcttaagggttaagtgcatcatctctgaaagaacacagacccagaagtcctctactgtatgtgtgttgggggcctcatatcagctgatgtatgctgcctgttttatggtccaatgtttgagagatctcaggggtccagattaattgagactgctggtcctcctacaggattacccttctccttgtgagctctcatagcctcagtaatagtgtcatgccttagaacacccaccctcccctggagctggatcccactttgggcctgttgctggaccttcttttactcagattcctctccatttctatccctgtaattctttcagacgggaacaattatggttcagagttgtgactgtagaatggcaatcccatccctctcacttgatgtcttgtcttcctattagaggcgagctctagaagttccctctccctactgtcaagcatcaggccttgtctaatgttgttt

SEQ ID NO: 1507 - DNA, 1000 bp, mus musculus
tttcttttatatttaaatacaaatacatttgatatattgtgctgcaatataaagtcatataaagagtctctgctccatagattacaccataatacttgccggtaatactcccttgatcagagtcaattctgtcttctttgttatatcattcctgacaaactggaatagggaatttcagatttgatttccttatattgcttgaggtgtagcaactggaatattccaatagggtgacagaaaactcagcagagcttggaaagctgaattgtcaggtatcaccaaactactgaattcaagcatccagctcaaagtaaaagtaaacctgggtcgaaagtcaagaagattgaataggcaaaagctaaaactagagaaaccaccaacaattcctgctccatttttagccttttgaaacatgcgctgtcttagttaggattttactgctgtgaacagacaccatgaccaaggcaagtcttaataaacaacatttaattgacgctggcttacagattcagaggttcagtccattatcatcaaggtggttgcatggcagtatccaggcaggcatggtgcaggtagagctgagagttttatgtcttcatccaaagactgctagtggaagattgacttccaggcaactagggtgaggaccttatgaccacacccacagtgacacacccattccaaccaggtcacacctattccaacgaggccacacctctagatggtgccactccctggtccaatgatatacaaaccatcacaagtgccttggtaaaatttgaatatgaaatcttctttatcagatcatcacttaaatccttggtttccagctggtggtgcaatttcagaatgttttagaaactatctctaggtagtaggtcattgaaagtgacatctgcctcctgcctttgtggaggagaaggtggactcccaccactcaccagatactgctgtcactctgtgatctgtccaggtgcacagaaccaagaaaacatgggct

SEQ ID NO: 1508 - DNA, 1600 bp, mus musculus
attatggtggtggtgttgatggtgatggtgtgtgtgtgttctctcttttaatatataagtttagaactatttattcctgtgttttcttgagtgtgtacaacctgcttacatttcagtttttcttgtaggaccttatgcaggcctagatttgtagtgagatgttgcttaaattttgttttatcatcgaatgtcttaatctctctatctatggtgattaaaagttttgttgcatatacaattttaggctgacattgtggtgtctcagagtttttagacttggttcctttatagtgtcacagatttcctggatgtgttatgccaggactttttagagttaacagcttcattgactaagactgggtacagtatattcagaccactgttatattcataaaggctattttaaggtcttatcttgtgcagagccatattttccatgattgtgctggctggagtattttcagaccactctcatattcataaatgctatttcaaagccttatcttgtggttcagatatgttgcaatacttagggccttctatagtaagagtgctgggttctagtagagactttttttttttttttttggttgatattgatcgccttcttactttggcatctaggtatctaggtatctctttgtggccatgacttacctctgcttccctaatctctccctctctctgccttaaacaccttaaaaccatggattatctcttcttatctggacttgctatgctggagcaatggagcaggtcatcccctaatgagcctcaggtagagtctaatttcctgtgggaagcctctcagcattcccagacggtctctaccaacccaaacttctcatagcccgatgccctcccagcagttctgtgggggtgcgtgcagtcagttttcccacactcagccttgcccagcggccttagccctgagcggacaccatttttatcccacagactacaacaggcagctggctacagactgacagactggggacagggcattagagattggatttgaagtaaacgtgtagaataaagatctgaagctcacctatctgttttctgccctacttgcttcttttacagtaaaaacaaacaaacgaacaaacttactaaatatgtgtgtttccctttagaaaaagacctattaacatattttgcctactttcctatagggatttttaaaaattattcaaataaaatgtgaaatcgccattttggggcagtactgtttttgacgtaagtattttgaaattcttatcggctcatctacttttatcactgttatattctctgcataaactgacctgtataatatcaatgttatacctggtgattcttgactggaaatgtacattgatagtgataacatagttcctcctttcagattaatgataacacagtatgatttttctatcatgtcacctttttcacgcttctctttaaagtgaatgtcctgtgggtaatctaaggttgcattttccattttctttcaacatgatagataattttcccttctcaagtaggttgtatagactcatttttatttaataatactattgacatgattagagaccaattaaacatcatagtattt

SEQ ID NO: 1509 - DNA, 1000 bp, mus musculus
ccatagcagaggtcttgtgacaggtgttgtattaactttttatattgcaatgaacctgtactcatacaaaccaaatctgtgtgcttcctttgatatgcacctgcaacttgttaattcaagggcctttattaagaaggtataaatttagcagcatctgtatagatttgtaaaaccctatcagcttgcttgagaacctaacatcattttgtgtgtgtgtgatatgtaaagaagtcaaaactgatgatggtttgtcccaaacagatgtgcctgcagataacacagctctgaagatacactcatgtttattacagagacttggggttaaaatagtggagtaatttgggacccctctgaggtcaaggacatcatttacctaccaacccttatatctctgaagtctttttctctagtatccttccagcataggggaggtgtcgtccattgctgatgctgtctgcactagtggagttcactggtggcagttagtatctttctttgcaatcctttatgaaagcagcagtgagggcagttcagggacagcctgtcatggaggaaatgccatgctagaggacgaaggaaagagcagaaggaagcatgtaggctacagagagctatccagctagctgccagctgaccagactaaaagacagctcagccacaaggggtccagggattaggaaccaagctctgaggccagtggatcattcttatgcttctgatgtaaaggtcagcggagggtggaggccaaccctatggtctagaaataggtagttcttttcatcctttccaaaggtgaatgcctttgtgatttataaagaaacacacacacacacacacaccacgaatttgtgttctgtaggattatatcagtgaaccagtgaattctcgagtagatattctcctttatacagtataaacatgtttcatttgaatatgtctcccccaaaatgtagcataagaattacccagatgccaataagcatgcattattgaaaggtag

SEQ ID NO: 1510 - DNA, 1000 bp, mus musculus
tgcggcgtcatcagagctcaagggcaggtccattattggtcttgggtcctgcccctgctgccatctttcctctcccatcaaatttcctttgtccttcaagaggtagtgttccagacaattacagtgagaactagatgcttagttgggagccaaacatgagcatctgctgggacccatttctcacatctcagcatgagctcccatgcaggtgcttgctgggagactctcttagaccgtgacgccatagggccagggcaaaccctgagaatttgtacttgctgggtaaatagcccccaacccctgccaaatccatacccatcacaaccctcagaatgtagtcttactagcttctgaattcagataagatagagcatattcagtgtgggatggctgttagcagaacgtggcctgactggaagtaacaactttgcagattattcagtgaagatgggatttgctgacttaggttggggtctaaattcaatatgactggagtctttataagaaaaataaatgcagatcacagatccagagagagacatagtagaaatagatgtgatgacccaggcaaagtccagagtgatgagcctgcagaccaggagacaccaaacattgttaggaacaccagaaatgaaggagaggcaagaaaaaattcttcctcagacctccaagtgtgtgtggccccgctgacaactccattatagccttctggtctctggcgctgtgagagaaagatttccaatgtggtaagcactctggtaatgtgttcagcaactctaggaagcagatgcatcgtgcagtgctgatactgttggcatgggaaccataacttgagaaccattgtttcggggcctttctataggaaagaaagcttgaagaattcagatgatgactgtgtgaaaaggggcgttccaacacggatgtcattctcttttatatgagatccgtgatggacatatgttgtttggggatggccacaaagcatcctggattttttttt

SEQ ID NO: 1511 - DNA, 1000 bp, mus musculus
gtgcagcaaaacaaaacaaaacacggtgtctgttttgtgttagccaactttccctgcagctatgctctgaatctgactgatataccagtaagtgatcttcatcattggaaactacagattttttcccccagcatgtgttagttggaaagagcttcttggttaggggcggggctttgcattcacttcccggtatcaatgctgggatttttgtctgacttaaacctacatcgtggtgcaggttctgtgtgtgctgtcacagtttctgtgagtcatattgcatcggtcctgctatgtctagaagattctgtttccttggagtcatcctccacctccagcacttagaatctttccgactcctctgcggcatagacccctgagccttaggggaggggcttgaggaagacctccagtttagaaccagagagctgcccactgcccacttgtggatctttgttttaatttgtgttctgcaagaagcttgtccgatgagagttgagtgacttaattccagcgctgggaggctgaggcagaaacgtcttctgtgaggcttgcctgggtcatatagtgagattgtgtttaaggaaaaatagaaaactaaacaaagaaaccccctcaaaatcttgagcaggcgctagagagattacactgggtgaaagtgcccactgccgagcctgataatataccttggtttctgggatccacatggtggaaggagagagccgacagctgtcctctgatcccacatgtgtgtgtctgcaagacccggctctctcaaaccccataagtaaatacatatgaaaacatggggaggagtttggggctggagagatggcataatgattcagagctctcgttgctcttgtagaggactcaagatcagttcccagtacccacttggaggctcacagctggctgtaactccaatcccaggggatccgatgccaggcatatgtgtagcacaatccctacctgcaggcaaatcattcatacacataaagta

SEQ ID NO: 1512 - DNA, 1200 bp, mus musculus
gattttctgacccgtgctcctctatttttcccctcagctggataaaaaggtcatccaacaaatcgcaatgggtgactcagcggcccagaacaagagcctgatcaagatctggtgtaaaagtataaccaatgtggtaagtgtcaaagtgatggatgagtatgtatgtcaaccaaagggttcaaaggcagcaaatcagaagtcagaaagggagaaaaattaggcaactgggagttctatctgccctctgcctttcaaggagatagacacctttgcatcactgttaagatgcccgctccttgacgtggtataatgcttgaatatctcatggaaggatgactcttgccttttgctttggagaccgtgatctctgtcccacaacacaaatgtaggcagcaggggcatctcaccttccaggctgtttctgaggaggcacacatggcttgcactaggaacttgcccaacctgctgtgcagtgtgggtgcaactcactcttaattctggggtgtagtatgtgtgtgcatgcatgcatgtgatgctaaaagctggtgataaaataaaatgaaacagattttatttgtccccatggttccaagagatttttcaaaaatctttgaagggaaagaaaacaccctatgatttagccaccatacagatccaaggataatgtcccatttggtccccacctttgttatttccccaccatggacgcaccttatgtttgtcattgtcatttagactgagatgaatgtcaccgtcccctcgactgataactgcacctctccttcatattgctggactgatggcatacagacctggaccatccagaacgttacccaaaaggagaacattgctaaatgtgagtgggaattaactggctggctagctgggtgggtagtctaggaatctgaccagtgtgcagcccagtgattacaggaacaaagggaagacaatgctgggccttctggtgactccatgccacctgaagagcttttgatagggattctacagtgctcccttggtgtgcctttggatcccttagtcaataagtcaggggtaattgatggctggtttgattatatggtctgtccacttaatgcatctcttctgatcaaggcactgagcccacctgatactcccatattttaggaaacctttcatcctttcaagccttcctgaatcccactttctcctctatcatac

SEQ ID NO: 1513 - DNA, 1400 bp, mus musculus
ggagaaagcattatgaattttcaagaagaataggtggaaatactattacttagctgcagaatcacacactctttttcttactaatcatgtttctaacatttttaagatcgaatctctaagtttaataaaatcccattatcttctaatatttaaaaattaataatgtagagtcttatatccagctctgtagcagaaaacctgctgtggtctccttttttaaatttttttttatctgaccccatccccaagggatcacaaagattctctctcttgctcttccttcccccaattcatcctattatcccagcttccaacaccagtaggcattcactgagaccttaccaattaagcagaaaaggtaaacaggaaagcaaactgaagatactcatcactctctcctcaccttcaaattcagtctcccagtctcatccccactgctacaagagaacaccagctgcagccttccatcacccctgcccacatttcttgtggaccccacaatgcatcccctcctaacccctacctcattcactcactttatcccaggccctaagcccagtagcagtcaccttctgtcacccaagggcaggttctcccagtataacaagtagtctgaaggcagacccatgcatctcctgcttctcctgagattcacccccaccccaaccccaagtctcaccagctgaacaagccaatgaaacaggaaacatccagccatcgcacctgacttctcaatggagactctaaaagccagaaaggcctggagagatgtgctgtagactctaggatacaaataccagcccagacaacggtacccagtaaaattttcaatcactatagatggagaaataagatattatgataaagccaaaattaaacaatatctatctacaaatatagccctacagaatgtgttagaaggaaaactatcattaacctatcattaactacacccacgaaaatgcagaaaataagtaacctcatgccagcaaaatcaaaacaagggaagcacacacacatcactactaccaccaccatcaccattagcagcagcagcagcagcattaccaccaccaccaaaataacaggacccaataatcattggtcattgatatctctcaatatcagtggtttcaattcccaataaaaaaacacagactaacagaatggatgtgaaaacaggatctatccttctgttgcatccaagaaacatacctcaatatcaaggatagatattaatccagagtaaagggttaaaaaatatattccaagtaaatagacctgagaaacaatgtgatgtaaccattataatatgtaactaaaaagacatcaaagcaagactaatgggagaacactccatatttaccaaaggaaaaacacactaagatgacatttcaatg

SEQ ID NO: 1514 - DNA, 1000 bp, mus musculus
cttccatcaaccccacccacaagcagaaaactcctggcttacaagttgccacccttggccttctcagttctagcaacccacccaaggtttttcactagataaggcaaagaaaaattgagttaaacaactgtgtattgtgagcacaggtgtccttggaattccgagtcactggggggtgttacttgacagtgtgatgggtcagatgcggcagtgctaattttttcttttaacctgtgtagtccacacatgctggttagtagagacataaggtaggggctaatagacttcctttctcttggtgacacaaatagacaccagataagaccagattaaaagcaggtaaatgcagagtgttttcaggtgctgctcccaggcaggctcactgggttcacctgtcccaaagaactgggtctggggatttgggcacctgggctaaggcaagagggttttatatatcttcatcaagggatgatcacgtgtaagtcaggatctgggactgtacccatatatggtcttgccattttttaacaaaaaagcaagataactcatagaaattttgtactaagaagcattgcttttttttttttttgttaaaaaaatcacagtctttgcctttttacccaccccctctcttttgcacaataaacatttaattcaatttctcaatcaaaggattctctttgttcacccactttgctccaagtttcacagtcttattccataccctgtaccaaatttgtttcagggccaagacctggtaatagatgcttggtccttgctccagggcctctcctgctaagggcatcttcggtgagtctgtgcttatttgctgaagttctattttctgtctactcaagggtgctgctcctgattactgggccttggatgtttctagttctataagtttaccctaatttttcatctgcaaacatatgaacagtttgtgaatgcccacgatgaattcaaagattcaattgtactcttcaacttgacctcaagt

SEQ ID NO: 1515 - DNA, 1000 bp, mus musculus
agcagacttaattcattttgtttttcttgtataaagcccctatgtggtaaccagagctggctcctggggcgtctgaacatagattctgctgggggcttcccaagacggtcagtgcatttcgaatgaagagacttggtgaacatggtatctttccagaggttgggactcaagtagctgtagtcttagagatgacatcaaaggtggccttagcaaagttgcccagggtggcattgtggcccccagctgatgtgtggtagtcagcaataccagctatcagcagcaacttcttgggcacgggagcagagacaatggcagcgactgtggtggcagggagaagacacaccaacacacaaccacagtggccgtcacctcgcgtggaacagtgaggaattgccacttttgttcccccagtctctgcgcacagggacggtggaaagcttggccaagatgatggacccttgaatggcagtgactaccttcttggggcacttaacactcagaccagcatgaccattgtaatccccatgtcttagggtttttattgctctgaagagacaccatgaccacagcagcctttaaaaagggaacattatatttggggctggcttacaggtgaaggtttggttcactatcattctgtcgggaagcatggctgcacacaggcaaacactgtgctgatgaagtagctgagagttcttcatcccagtccaacaacagggcaacagaagagtgacagtggaccctgagctgagcatctgaaacttcaaagcccacccccagatacacttcctccaataaggccacaactcctaatagtgccattccctatggcccatgggggccattttcactcaaaccgccacacctcagtagtgacaaaagtctttaacctggtctgctggtctgccccaacctaatcctttggggacattacctggaaaaagtcagcgatctcacgtttcttagtgggctggaagatcaaatgatctcccccagggac

SEQ ID NO: 1516 - DNA, 1200 bp, mus musculus
ttccttgtacccctcccacacccatttcttgagaatagacattgtttagatctggaaatcccctaatctcccccttctccttcccccctgagggcctataaaaactgggaactctttcccctcgaggtcgactcctctacccctgtgtgggatatgagttgtccccaaagctctggctttccctgaataaagcctcctgtggtttgcaacaagctcggtctgttgtgagttcttgggtgtccgctattgtcctgaggcctgagcaaggggctcctctcggagtctttcatttgggggctcatccgggattggcatgaccacccacgtctccgaagacccacttggaggtgaaattttttgtccaaaaatatttctgtaagtcggctaggttctgtgctgaaatttgcagccgcaacgtttcgtgagaaacggagacctttgacttgggatgagtgtgaacagcagatgtcctggaatcaccggctgctgctcgctctgggggatgccctgagcgaggggaaggactctaggagtccgtctggggcggggagtgtactccctcgaccatctgtatttctgaagccctgagcgaggggaaggactctaggagtctgtctgaggtggggagtgtactccctcgaccgtctacatttctgagttggttttgtctgtttgatggaaaacaggcatctgtcagtgtgtgtgtttgttttttgtgtctgttttcaggcatttgtcagtgtgtatttgttttttgtgtctgttttcaggtatttgtcagtgtgtgtatgtgtgttttctgtgtttgtttagtgttttccgtggtactggacagactgtaacgacccccctaagtttgactttagaccactggactgaagttagatcaagggcccataatctttcagcagaaaataagaagggaccttggcagactttctgtgcctctgagtggctgacttttaatgtaaaattgtcactggaagggacttttggtttactctttatctttgaagttaaagccattgtttttcagagtggacctgggtctcacctggatcaacagccttacctcattcagaattcacctccataaatcaaaccatgggttcccccacgcctctcagagccctcccccggctgctcccatgcactcgagtgggtcagcacagtgccctcgctttctgccctaagaagcag

SEQ ID NO: 1517 - DNA, 1000 bp, mus musculus
gggagaaaaaagcataactacacagcgaggatctattgatcactacactgagtttatcatagttccttaacttgtccccaaacccaggaaccttaacttgtcccaaagccaggaaccttaacttgtcccaaagcctgcttcctggcaactttatatttgcctctattttatccgaggtccttcccaaactcctgggttactttgtgcctacttcctggcaactttatgctcacctctattttatccgaggtccttcccaaactcctgggttactttgtgcctacttcctggcaactttatgctcacctctattttatccgaggtccttcccaaagtcctggggtcgcaagtttcactcactgtgaacttaccctgccggcaaccactgactgctgaaagttctgaactcggtgggggagtcggttccccgtacgggccaccaattgtcgcgcccactctcaaccagcaagaacgacgcgaccaccagtccttctaacagcagtttattcagtcttcatctttcttctttctcttcatcagtaccgttccccagctgaagagttctgaatccacgccagatccttctcaacagtctgttttacgggaacactttattaaccccttcttccccgttatgcagttctgaatcctccctgtagcagggggtcttcactcatgcctgaagatgtttcttttcccgggtttcctcgtcccaggtcttctcgtcccaggtcttctcgtcccaggtcttctcgtcccgtcccgagtttttcttcccgggtttcagcaccaactgttacgcgcgttcacgcgaccaggaagaacgacgctgcaacaggatctttctgcacacgtttattcagtcctgtttcttcttgtttatatctcccttgtttatatctcccttgtttatatctcccccaaaccctgggcctctcactcttttatactctcagttcccatccacgcacagcaggccacgccacctcaccaggcacgc

SEQ ID NO: 1518 - DNA, 1200 bp, mus musculus
cggttccccgtacgggccaccaattgtcgcgcccactctcaaccagcaagaacgacgcgaccaccagtccttctaacagcagtttattcagtcttcatctttcttctttctcttcatcagtaccgttccccagctgaagagttctgaatccacgccagatccttctcaacagtctgttttacgggaacactttattaaccccttcttccccgttatgcagttctgaatcctccctgtagcagggggtcttcactcatgcctgaagatgtttcttttcccgggtttcctcgtcccaggtcttctcgtcccaggtcttctcgtcccaggtcttctcgtcccgtcccgagtttttcttcccgggtttcagcaccaactgttacgcgcgttcacgcgaccaggaagaacgacgctgcaacaggatctttctgcacacgtttattcagtcctgtttcttcttgtttatatctcccttgtttatatctcccttgtttatatctcccccgaaccctgggcctctcactcttttatactctcagttcccatccacgcacagcaggccacgccacctcaccaggcacgcagcttcagctaatcagggcagcaggggcaaatctccatcagactggattcacctgtatcctggtacacctgcccagcactcaagatgtttgtgtcttatatgaggaagtcaggtgcaagtcatacgacttagctacagtccctggcgcctttaggactgccgccacacctgctcctaacaagtagtgcataggtaggaactgcacttggagaactggcctaggggggagacaaagatagatctctccaggccacttccttaccatgatggaaaattccttacagtttatccagagttgggctcccatggtgccttttgagtagctgccttgagcggccaggaccactctgtcttcccctgactcagtcatttctgtgacttctgctttcctggggcttgattagtgtgtagaattgtgtgaggggagtacatttatacaacctatttctctttactatctaaatatttcaaaaggttttattattataatgtgcacaaaaggtaattatacaattatcaatcacccagttttagaaatgagttgaacagacaaaattcacgaataatcttatccagagatttatacaagtttttgataaactgcccctatttttgacatg

SEQ ID NO: 1519 - DNA, 1200 bp, mus musculus
aatttcattttctgtaggttaagaaaagtgtgcatttatgtaatacatgcatgttttctgttaaaataaatgtacaattaaataatctataaaattatatatacacatctatttaattgtaagattataatataattacataattttcccttccctttcttcctgcaaaaaacatactccaaaccttcttttctctcttttcaaatttatggctccttttacacacacacacacacacacacacacacacacacacacacacacacacacataccccactcctaaatacaacctgctctgtctgtgcaatagtatgtatattagggctgaccatttggtgttggaagaccaattggtctattctgcctagggaagacagtttttctgtgatatcagcatcactcagttgtctatagttctctgtgtgcaaatatcccaacagcaggcataagaagctggtcagggcttctcaagatatttctaaaacattacaggctatttccattggtggctccttcttcccagaggtggaaggttaggttcttattagtgatggcatcatgcacttcaaattcagggcccagaggccattgagcaggaaatgatctaaaaacctccttcccaactactagttttcatggtataagaaggcatcatgccaacttccaatagagaaaagcaaccagcagttctccagagctaggataccaataaaccacaagtaccagtagagtacaataaccctacaggtggaataataccatacaaccttgacaataatgaacagctctctagcatgacttgagaccctctcaactagatggaaatcatatctaatattgtaaacctcaccaggccatccatctaattaattaaataaataaaataaagaaagaaagaataaaaactaattgccatacaaattcatgctcatcttttagaatgagttttctaaaacatctctagcatatatgtatcaggtactgtgccaatctattgcagtagttcttacgtgtggtatgagacctaatttttctttactatttctatggactgagtatcaggaatgatagtgagttttctctgttaaagcacattccaagaattctttcttgatgcactaggtagtacagttttcttggaggatatttttgaggggagaggtaaataaatacagtagagttgatagacaaaggcaaa

SEQ ID NO: 1520 - DNA, 1400 bp, mus musculus
aattggaaattttatttatttacatttcaaatgttatcccttttctgcgtttcccctctagaaaccccttatcccatcctccctctccacatgaagcgcgagaaaaaggaagaccaaagtatggaaactttggtccttcttagaagggggaacaaaatactcatggaaggaaatatggaggcaaagtgtggagcagagactgaaggaaaagccatccagagacaaccccacctggatatacatcccaaatacagtcaccaaacccaaacactattgcagatgccaagaagtgcttactgacaggagtctgacaagtacagaggcttgtctcctaagaggctctgccagagcctgacaagtacagaggtagatgctcgcagccaccattggactgagcatggggccccaatgaaggatttagagaaaggactgaaggagctgaaagagtttgcagcctcataggatgaacaacatcaacaaaccagagaccccctccccagaggtcccaaggagtaaaccatcaaccagagtgtgcacacagggagatccatggctccagctacatatgtagaagaggatgcccttgctaggcatcaataggaggagaggcccttggtcccgtgaagactccatgatcaagtgtaggggaatgccagagctgggtggctggagtgggtagatgagtgggggaaacacccttatagaagcaggggaaggagggatgggataggggttttccggggagaaaaacagggaaaggggataacatttgaaatttaaataagtaaaatatccaattaaaaatggaatacagagctaaacaatgaattctcaactgaggcatccaaaatggctgagaagctcctaaagaaatgtctaacttccttggtcatcaagaaaacaccaatcaaaacaaccctgagattccacctcacacaagtcagaatatctaagataaaaaattcatatgacagcagttgctggcctggatgtggagaaagaagaacactcctccatcgttggtgggattgcaagcttgtacaaccactctggaaataagtctggtggttcctcagaaaattggacatagtactacctgaggatccagctataccactatttggcatatacccaaaagatgctccaacatataacaagaacacatgtgccactatgttcatagcagtgttatttataatagccagaaactggaaagaacccatatgttcttcaacataggagtggatacaggaaatgtggtacatttacacaatggagtactactcagctattaaaaattatgggtatacttttatatttggagcaaaagttacatttttggtatatgttaaaattctgaattaatacatttcttttgtacttaactctactaaatcatc

SEQ ID NO: 1521 - DNA, 1200 bp, mus musculus
tatagaataagatgccttgtttgcacgtatatgatgacacagatcatgaagagttaagagatgtgataacactatcttctaaaatgggcaaatggaattttggcataagtttctcctttccaaactccacatataatccaatttctgatagaaaaacaattttggattctagggtctgaagatatagatcagagctcaatagaattgctattcttttttttttttggatttgtcttttttatttttaatattggtccatacacagcttttgcaatgaccgtatgttctgttacctgagaacttttccaagctactcaccacagagggcacctttcctcttattttgtctgtttctgtctcccacctctaccaattgctggggaaaaaatattttaaaggcaatcagaggactggagaggtatgtcagctggcttagtacttgttatgcaagaatgaagacctgagtttaatttccagcgcccatggaaaaatgacaagggctgattgacctctctttcatcctagcagtggggaggtggatgcaggaagatcctagggcttgctgccagccagtctagattagttggtgaacacaagaccaagaaaaactctgtcttatgggaggtgggtggtattctagagacaaaattctagcttttgctctggcctgcacctattgacatgataataacaataatgatggtgatgaaactagaaagctctagctgttttcatttttttttcttaaaggggatctaaattctgttcccagcactgcacaggctatcccacaactgaatataactacagctatgatgatctgctgccatcttcttattctatctgtacccctccctcacctagacacatggtataacacagacacacataaacatagattaaaaaactggattctaatttaccaaagttgtatatggagaacacatacttgcattgtatggtgtaattttataggagcataccaagataatctcaattgttttatcagttattattccataattgtgtgtaagacattattatcttaaattaccccatagttgtaaaactttatatctcttttgaagatgagtaagaatacattattcaaggatatatgaaaatattagaagaatccccagtaattagcctaaaatactgttttttctacacgctaaaatgtaagtaaaatgtaattat

SEQ ID NO: 1522 - DNA, 1000 bp, mus musculus
tgactaccctcagaaagatccaacaagcagccaaaagagccagatgcagatatttacacccaaccaatggacaaaagctgctgacccctgtggttaaattaggggaaagctggaagaagctgaggaggagggtaaccctgtagaaggaccagcagtctcagttaacctggaccctgaaatctctcaaacactggaccaccaactaggcagcatagatgcccccaccacatatatagctgaggtctgccaggtccgggttcagtcagagatgttgcacctaaccctcaagagactggaggtcccattgagagaagaggtctggtggggtggatggtggtgtggtgggggcattcttgtagagacaagggtggggaggaggtatgagatgtggaccactcagagggtagacagacatgggaataaaatatggagtgtaaaataaaaagattatggagagaaagtgtggagcagagactgaaagaaaggccataaagagactgccccactcgagaatccatcccatatatagttgccaaatgtggatgctattgctaatggcaggaagtgcttgctgacaggagcctaatatggctgtcttcttagagactctgctagagcctgacaaatacagaggtagatgctctcagccagcctttggattgagcacagggaccccagtggaggagttggagaaggggctaaaggaactgagggggttttcagccccacggggggagcaacagtgtcaactgaccagacaccctggagctcctggggactggaccaccaaccaaagaatacacatggagggatccagggctccagccacatatgttgtagaggatggccttgttggacatcagtgggaggaatggtccttgagcctgagggggttcaatgccccaatgtagggaagtgccaggactggtgaggcaggagtgagtaggttagttggtaggggagcaccctcatagaggcagggtgagggggtatgggatag

SEQ ID NO: 1523 - DNA, 1000 bp, mus musculus
agacagctatatcaggctccgggttcttgttggcatccaccatagtgtctggatttggtgattgtttacaaggtctccagtgaaggatcgagagaaatacccagggagctaaaggggattgaaggcccataggaggaacatcaatatgaactaaccagtaccccaaaagctccttggaactatacacatggtggaacttgtggctctagatatatatgtagtagaagatgacctagttggtcatcaatgggaggagaggcccttggtcctgtgaaggctctaggtcccagtataggggaatgctaggactaggaatggaagtgggtgggttggggagcaggaggaggtagggaggggataaaatattttcagagggtaaactaggaaaggggataacatttgaaatataaataaataaaatagctaataaaaaaggaaaaagacattaaaaaaggaattctataaagatctcagggcattggggctcatcaatggcttttacaagtcagccttttcactgtagaaggctatgcttcaggatgggtgcagatcatgtccattctcccccctccccccaggcacatacatatccatcactgctgaggtaacaatttgtgatgacttaagaacccaaattaagccccagagcatgtttctctctggagcaggaacttgaaaaccaacagtgtaaataggagttgaatggagggagcatctgtgggagacatcttggttcccagatcccactgagactagtctgcacaggtaagagtgtggactacagaagataacagcttctgggataggcaggagccacagagcttctgaggcagaccctattgccggctccagatgttcaggcaccttccctgccagagaagaggtgtccaccctaccctggagagctttgccagagcacgtgatggagccatcttggttcctggatacctctgaaactagtctgcacaggtgagagtgtggactacagaagctaacagct

SEQ ID NO: 1524 - DNA, 1000 bp, mus musculus
tgggaggctagctctctacttagtttcagtggtcagagtattctctgcaggcaagctctcttcttgcagggaagttgcccaaatatctgatgttcaaacctgcttcctggcagaagttgtgttccactcaccagaggtcttaggatcccatggggaatcctgtgagggccctttcgggtgtcaggagactctgctggcaagtcaccccggtgctagagtggaccagaagggatgggctatttctaaaactgctgccttgtgtggcctcagaggaagagcatgcacctaaccccgcagagttgttgcaccagaataggatcatcttttttcatgtcatgtaaaactctaattaatcaaatatatttttccattcttagtttgtcttttcctatatggtggacaactctatgacaacattacaatggttacaacaataaagtaattattttaaattatctatgataaactactaggacaaaagtatggaccatccagagactgcccgacccgggggtccatcccataatcagccaccaaatgcagacacttttgcatatgccagcaatattttgctgacaggaccctaatatagctgtctcctatgaggctttgccagtgcctggcaaatacagaagtggatgctcacagtcatctataggatgcaacacagagtccccaatggaggagatagagaaagtacccaaggagctgaaggggtctgcaaccctataggtgaaacaacaatatgatctaatcagtacccccagcgctcgtgtctctagctgcatatgtagcagaagatggcctaggtggccattattgggaagagaggctgcttggtctagcaaacttcatatgccccagtataggagaaggccagggccaagtagtgagagtaagtgggtaggggagcagggcagggggagggtataggggacttttgggatagcatttgaaatgtaaatgaagaacatagctaataaaaaacaatttttaaact

SEQ ID NO: 1525 - DNA, 1800 bp, mus musculus
tagattaaactttctctctcacttctttcatttttatttataattattttattagcacatgctaagtataaagttaagttatgccatatatatatatatatatatatacatatatatatatgtgtgtgtgtgtatgtgtgtgtgtgtaagagatatcatatagcaaataatataaaatacattacatgtgtgtgtaagagagagatcataatataacagatatattataaaatatattatatatatgtgtgtatatgataaacattaacatatttaaccctattgaactcttatattcccactttcacagatcttctttctattttcatttggtacattatttactttcatgtcttttcttacctatgctccctttaaagttttatttatttttactttatatatgtgaatgcttgcctgcatgcatgtatgtgcagtgtccaaggtcataaaggtttgtcagatcccctggaattggcatttcagacaaatgcaagctacctagtagaaactgaccccttgtgaaccccaggttgagaatcagcattctaattatttataactgtgcgtagcaaatgaagaatacaaacatgccatttggaaagtgaggaaaatttccgttgacctttgaaactgtttcacaatagatagatagatagatagataatccacagaaagtttgcagtgtgtgagacattggataacttaacactaaaagggacacctccatcaaatccctcctttcagggcacaggacacattgaagaagaatactcacagctggtgcaagacacagaggagaagtacaccaaggaaccaggtccttctaggcacagcggggctggcatgcatgtgaactgacagagaatgaggcagccagcacaggggttgcaaaagccaaagccagatgaggtcatacagctaaaagaattggttgcttctgaggcggcgccattttcggctccagacaacagaccaccttcctggtgagagcacaggggtctgcccggcctgagaggtttctgcctcaggctccacgggagccaccttggttccgggactcctcggagggcaggctgcacaggtgagggtgtggaatacagaggccagcagtttctgggacagtctagagccagagaccttctgaggcggcgccactttctgctccagacaaccggccacctccctggccaaagcaacacagcttctgggaaagatcctgttttgggccttcatttcagccaggaggaggtccaaacaccagataactgtgcaccttctctgaaagaggagagcttgcctgcagagactgctctctgacgactgaaactcagaggagagagctagtctcccacatctgctgatagagggtaacaaaatcaacagaggaacaatctctaaacaaagacaactataacaactaactccagagattgccagatggcgaaaggtaaacataagaatcctactacagaaaccaggaccactcaccatcatcagaatccagaaggcccacttcgcccagaccagggcatcctaacacacctgaaaaggtagacctggatttaaaagcatatctcatgatgatggtagaggacataaagaaggactttaataactcacttaaagaaatacaggagaacactgctaaagagttacaagtccttaaagaaaaacaggaaaacacaaccaaacaggtagaattccttatagaaaaacaggaaaacacatccaaacagatgatggaaatgaacaaatccatactagacctaaaaagggaagtagacacaataaagaaaa

SEQ ID NO: 1526 - DNA, 1200 bp, mus musculus
atatctaggtatatactgaaataaaactgagaaataaagttagatgtaatgacgaatacctcacaatgttattttttcttcaagcaatagtaactaatttttaaaaatttatttatttacactctatattttattcctgcccctctccaccctacaaagactgttccacctccctgtctccatgtggatatacctcctccccaccccctatcttcatgtggatgtctacaccccccaaccccatctgacctctaaaccccctggggcttccagtctcttgaatgttaggtgcatcatctcgaaatgtgcacagactagacagtcctttactatatgtgtgttaggggcctcatatcagctgattatgttgcctgtttggtggtccagtgtttgaaagatatcaagcgtacagattaattgagactgctggttctcctatagggtcgccctcctcctcagcttctttcagctttccctaatccaacaacaagggtcagctgcttctgtccattgattggatgcaaatatctgcatctgattcttttagctgcttgttgggtcttctggagtgcgaccatgctaggtccctttttatgagcactccatagcctcagtaatagtgtcagaccttgggacctttccttaagctggttcccactatgggcctatcgctggaccttcttttcctcaggctcctctccatttccatccctgcattctttcagacaggagcaattatgggtcagaggtctgactgtcagatccccaacctcccatttgataatctgtctttcagctggaggtgggctttgtaagttccctctccattctgtcaggcatttcatctaaggtccttccctttgagtcttaaaagtctcttactttctagatctctggtgcactctggagggtccccccaacctcctatcccaggaatttgcctgtttccaaagttccctgtttccatttcttctgctggccctcagatcttcagttgttttccctcatccaataccaagtcaggttctccctcttccccccaccccaagtcccatccactttcccacccactgtctgttacaatactaggggtaaatctgaatgttactgaataggtaacattcttactgaattccaagcccagggtcagctcaaggactgcctaggacattggaacactggtggaggataatctaactt

SEQ ID NO: 1527 - DNA, 1200 bp, mus musculus
atcatttggattctctgttctattttgaactcagacttttgttacatgtgtgtgtgtgtgtgtgtgtgtgtgtgtgtgtgtgtgtgtgtgtgtatttagtctcttagaatacatatatcaatgggcagtggtggcacatgcctttaatcacagcacttggcaggcagaagcaggcagatttctgagttcaaggcaagcctggtcaacagagtgagtgagttccaggacagccagggctacacagagaaaccctgtctcaaaaaagaatacatatatcaagataaccaaatacaaactataggtcaataactgcaccacagaatcttagagaataaacttgtcttttctttctttctttttatttatttttattggatattttatatattcatatttcaaatgtgatcccctttcccagttacccacaggaaaccccctatcccacaacctccccattcttctaagagggtgctaacccaccacctactactgcctccctgccaaagaattctcctacattggtgcatcgagccttcacagggccaagggtctcacctcccactgatgcctgacaaggccatcctctgctacatatgagactggagacatggattactccatgtgtactctgctttgtggttgattcgctggaagttcgggggtactggttcgtttatattggttgttcttcctatggagttgcaaacccctttagctccttcaattctttctctaattcttccactggggacaccaatggaggttggctgtgagtatctgcatctgtatttttcaggctctggcagagcctgtcaggaaacagctatgtcaggctcctgtcagaaagcacttcttggtatccgcaataacgtctgagtttggtgactgtaaatgagatggatccccaggtgggacagtctctggatggcttttccttcagactctgttccacactttgcctccttatttgtttctattttgtggaatactttgatgagtattggtacttggtcttctttgatggtgtgatagaattctgcactaaccctgttttctttttcattctaattctcaccacaattaagaatattctttgatctctaataaaatgatctatagtgaggtctacctttgggaattgccttttttgagatttattttcagttttaattatatgtttacatgtgtgagagagcatgg

SEQ ID NO: 1528 - DNA, 1000 bp, mus musculus
gttgaaagtggggtgttgaagtatcccactattattgtgtagcaggtgggatgtgtctttgagctttagtaaagtttcttttacttatgtgggtgccttcgcatttggagcatagtttttcagagatggatgcttgtagccaatctttggcttgagcaggggtccccagtgaaggagttagagaaaggactgaaggagctgaaagggtttgcaattccataggaagaacaacaagatcaaccaaaccgaccctccagatctcccaggatctaagccatcaaccaaaaagtatacatagctccagctgcatatgtagcagatgatagacttgtcaggcatcaacaggaggagaggtccttggtcctatgaaggctcggtagatgtctcagtgtagaggaattaagggtggggaggtgggagtggatgggcagagaaacaccctcatgggatagggatattccaagagggggagaactgggaaaggggataatattcgaaatgtaaataaagaaaatatccaataaaaattaaaaaaggaagaaggagaattataaaaggaaagataactgaaaactcttcaagagggagtttgagttgacaaagaaatggaaatgagatcatcaggtcaaggaggctaaggacattagtattagtcagggagggagagtgactagctgacaaaggctcaatgcagacattgagacaggcttaggaaatgtgacaagtgtgacaaaacttgaggagattgttgggctagggctcagagtaagagctggggacagaaagggaagcaacctagttgctgtggtagaatcaatagaacctttgaccctcaaggtcagatgcgatgattggggaagccaggcttactgttcatagcaaactggctttgctttaaactacttagaggtttacacagacaagagaactcagatgagtctcttgtgtctgttagatatttaacgtgtttttacctggatacctaaactccctcaggaga

SEQ ID NO: 1529 - DNA, 1000 bp, mus musculus
gaatagcaccaattgatcataaagagcttttatatattaaaaaaaaaaacctaaatgataaatttgagggggaagagaaggggtgattctaagcagagttggtaaaggggagataagatcaaaacacactcaattatttgaaaaataatatacaatgaaatgctttttatcttaagatccttatatcatctgattttgatgccaccttgaccatccatacccaagagataactactaactatttaagaaggaaatggagtgcttgaaatcattcaaagaaaatggtatttttttattatgtttctctttatttttttaaaaaaaatattattagctattttgttcatttatatttcaaatgctatccttaaaaaaaaaaaaaaaaaaaaaaaaggtaaagtgccctataccctcccccccctcccgccctgctcctcaatccacctactcccgcttcctggccctggtattcccctgtactggggcatataatcttctcaagaccaagggcctctcttcccactgatggcctactaggccatcctctgctacatatgcaacaagatacaaaattctgggggatactggttagttcatattgttgatcctcctatagggttgcagacccctttagctccttgtgtactttctctagctcctccactgggggccctgtgttccatccaatagatgactgtgagcatccacttctctatttgccaggcactggcataaacaagattcctacaggaccctgataaagctatctcttgagaaaatggctttggcagatcagttgggaataggttaggttactgctctcatcatctgagaacactcagcaagggtgattctcccaagtgtaggacctaaactatgcttctgttttgaactgatcaaaaaaaaaaaaaaatgaacttaacgtcacacaagaaacgtagttctaagccgggcttggtggcgcatgcctttaatcccagcacttggaaggcagaggcag

SEQ ID NO: 1530 - DNA, 1000 bp, mus musculus
atcctgtgttctaagtggtaaacaaataatctgcacatgtgccaagggtagttctccactccatgtgctctgccttccccgtgacgacaactcgacagatgggctgcagccaatcagggagtgacacgtcctaggcagaggataattctccttaaaagggatggggtttcaccactctctctcttgctcttgctctcttgctctcttgctctcttgctcttgctctctggctcctgaagatgtaagcaataaagctttgccgcagaagattccggtttgttgtgttcttcctggccggtcgtgagaacgcgtgtaagagtggcccttgcttctagggaggtgtgatgcccagaataagcggatgctggtgcagtggggctggagagggtggatgggtaggtgagcactctaataaaggcaaagaggaggggcagagcagatgtaggatggagggttaggggagggataatcaaccaggaagtgagatatcatttgagatgtaaatggaatgattaataaaataaaagtagaattttgatctacaaatttatttactggcttttcctggaaaccaaagtccagaattaacgtcaccttgagaagaacttctatgactgatgaagacacaactcctctccacctgacagaaaaacaaacaaacaaacaaacaaaaaatcaaaacaaaactgcatctcatgaaattgtaagtctggaagcaggatagctaagtactccacttttgctgctttaatcatgacctccctgtgaagtgatagaggctttaatgccctcttttaagtcaagggagatattttccacagcaggtactttccatttatgagaacttaacctgacagttcaaaaaagaaaagaaaaaaaaaaaccaatattttttttgttgctatttaccactaagtggaaaaaaaccaacctgtttcttattttatccaacatgaaaactaagtatgtgatttaatttagcagcacttctttcctaagc

SEQ ID NO: 1531 - DNA, 1200 bp, mus musculus
aatggacatctatgttaataatcatttcctagctattataaccaagacagcaatacttctggatgtgcaaatatctctctcatagtatataaattgcttcgagtaaattcgcaggaatggcgaaagtgttttcatggtaatactttttttaaaaaaattagatattttctttatgtatatttcaaatgttatcccctttcctggttccccctctaacactcccctattcccacctacctccccctgctcaccaacctacccactcctgcttcctggccctggaattcccctatactggggcatagacccttcacgggacctaagacctttcctcccattgatggctgactaggccatcctcttctacatatacagctagagccatgagtcctaccatgtgttttctttggttggtgctttagtcccagtgagctctggggttactggttagttcatatttttgttcctcctatggggctgcaaaccccttcagatccttgggtcctttctctacctccttcattggggaccttgtgctgaatccaatggatggctatgagcatccagttctgtatttgtcaggcactggcagagcctctcaggaaacagctatatcaggctcctgtcagccagcacttgttggcatccacaatactgtctgggttttgtggttgtatatgggatggatgcccaggtggggcagtctatgggtggtcatttttacccaatcttctctctaagtcatacacatgaaagtcatctcctattttcttccttttttaaaaaaatgttttgttttcggtttcacttttgcttgcttgctttctgttttcccatatattttgacatttattctgatcatttaggattgcaacagattctgtatatgtatttgtgtcagggggtactccactgtgtccatgcatgatgagggagtgtgaatgtgtgtgatagaggagagagagagaaagagagagagagcatatttaaggttttattgtatcagcagatgtgattatttttatactttccttattttattcctttgattcttttgtcttaatattctagataagatgtcaagcaacatattgttatgaaaaaagtggacatgttgtgcttgtatggattttagtgggaatgctttgagttttctcattatcagaatatccattaaactttgtcagatttgccctttat

SEQ ID NO: 1532 - DNA, 1400 bp, mus musculus
tctatctatctatctgaatgattcctaactctgtagtaacacgtactgtgaggcagtgagttgtgcacagatagcctggtccccatcggaacacaggccttgagtctgagtaacctggtaggaggtgacttccccctgagctctctggctcctgttgcagctacagcctctaacagctcctccacagagaggtgtgttaccatcagtcatataggcaacaccccaagctcctggtattctgtctggattccatcctcacagttacctggcaagatccaaatatactcctccccaaaattacctaacaacagccaggtaggcccagcccactataaaattggctgtttgccccctcttctctcttactctcgcttcctgcttgaaccctgtctgcattcccttcctccctccatgtggccatggccagcctctacttttctacttgtctccttctctctgcctttctacaacaaatgccttaaaaccatggaatgcctcatctcatcagatcatcaggatctgacatgctggagcaatggagcaggccttctccctaaagagccacgtgtctaatctctctcaggaagcctctcagctttcttagccaaggctgccggccaaactaagcagcccacccgagcaagccaagctctctccccacaggacccagccagagctctctcttccccctctttccctttggccccaggccagagcctttgcatgggcccaccactcctttctcagctctcctgtggcattcagagttgtctgcagtgcccaaaagtgagaacctgctagtctcggcctccgcgcaggccagaacccccaaaacctccttccagcaggtccacagggaactcagacttcctcacctctggaacggggccctgacacgtctcacagtccaaagcccatgattggccctagccctgtggcaggccggacacagggctcccattttgacccacaatgtactgcaagacaaagaaggaaatgtcagaagtcataatgaggaaggatggcaaaattgattttaaaggccataaattttatagcaaacccactcttttgaaaacacgagtaagtaagtgaagcatggaatcgtcacttatgttagctgacttcacatttgctcatttaattttccctcaaataacttttcttttccagaagacaaagctaatatgagaccatagatacctccccacagtagctatatcagaacatagtgagcagcattgagcctacaaagaggactgctagaggagtctagaaatttgaaaagtttcaacaacacatgaacaaattattgattttgaaattagagaatggccaaagaaaacaccaattcagacattgggtcttatcattagagtgtacgtacaggtgattcaggt

SEQ ID NO: 1533 - DNA, 1200 bp, mus musculus
gagactacagagagtagaagttctccccatgttcataagtggtccttagaccacttatgtcatacaattagccaatttctagctttatgtttgactttgatttggaagattataggatattctactttattaaaaagataagattataggatatcctactttattaagaaaataaaagggaataaaaagcattaattggtcaaggtcttaagtaatgcctaggccaaatttacattaataaaagtacagaaaatatgtaagcagggtcaggtgtacagataagcattgccagagatcagcaaaattactgtgatggtcatatttctattcttttgattgagcccaactggtttgtgtcctcccagacttcattaccttctgaatgttcccctggtgttcgcattgctctttttctcaatggctcaggtcataagaaatactcatcccataaagttttctaatacttttttttcagttcctcagctttcctaaaggtcatccccccacaccctcactcctctattcatcagctgtcttgcctaatcaacagtgctaactgctctgtgagaagacagcagctaattctccaaagggaaggcatctctccattgagtgcattctggtgtagcacatgttcacagagctaatcttgcctatcatagtgaattctttaggttagcaagctcataattaaaagtcttcactaatgacatggtaattgttttaatggatttccaatgaagtgtgaagttccctgctgatatgtcaacacaatatgaggcattgtgaaaggagcagcatagagcttcatagaatttttgagttagaagagaccttaaaattatcaaaggtaacctttccgtatttaaaaaaaaaaaaaaatgaaatcatccctggagctccggagaagggaagtgagttgctgaaggtcaacactctgaatggaaattgtaggtgacctgtacagcaaattgtttccatctcagtggtcattcattttgacctgctttttatttatatggtacctatatttttaaaaattgtttttatatttttcattatatcaacagaaatatttatttattctctaataaaatggtgcatatgaaaacaattttattccattagttctatgagaagattgcaaaggtgactttgaggatcaaaataaactgggctgagcatttcttggtccaatgc

SEQ ID NO: 1534 - DNA, 1000 bp, mus musculus
ataaaacagaatgaatccagagctctgtcatttgttagaaggaaaataaaatttctgacctggaagaatttctgctattactgtgattgcatagatttgatttcaaagggaagaaatactgaaaataagaaagggacacataagcagaacctccaggaagatagagagattacaggttcccctgagtcttcatctgagaagacaactcctttggcattgtgtttacaatgtaacacaatgcttctgtcaggatctgaatttagtgtatttctgtggaatcagactacaagccagactcaagtttcagtctgtaacgaaggaatgacattaactctgaaaaaattgtactacgctattaaatagctgcatgacttccctaactcaagtagacatatgcctaagatacatctgtgagaaaggttgtgaagaaccaaattattaatctcataaaatatatggtttggatctaataaagtagaaatactgaaaatagtgttatagtaataggtgtatatagaaggtttagaaagtaactaagaaattttcttgtgggctggataaaatgtagaacagtatttggtatagcccaaagaggttgaattgccttcactttcttaagacactattgaagttctttttttcttattggatattttatgtatttacctttcaaattttatcccattttcctccccatattccccctctccaattccccctcccactccttttatgaggatgctcctcctcccaccaacccactcccacctcatcccctggcattccctacactgggacattgagccttcacaggagcaaaggcctctcttcccattgatgccaacaaggccacatatgctggagcaataggtccctccatgtgtactctttggttggttgtttagtccctggagctgaagttctttaaagcataagatagagtgtttttttgtttgtttgtttgtttgtttgttttgttttttttttcatttaagcactg

SEQ ID NO: 1535 - DNA, 1600 bp, mus musculus
tttctgaacaaggttgaggagaactcaggtctgttgatataaacataaataattagagagcattcttagaacaggagtacatatcaataacaatactgtgttctaccctcctaccagtgacttcccctacaacagaaacactgctgctttgttgacagtgattaggcatattgccaagtgattttatagctctgataaaacaccaaggttataagcaacatggagaggagaagaagaagaagaagaagaagaagaagaagaagaagaagaagaagaagaagaagaagaagaagatgatgatgatgatttgtattatcattttgcagcccttcatggaactcagtgtatgatctcatggcaggatcatggaggcaggaactgaagcaaacgacacaagtaagttattttctggcatgaccctgtaggatagatttataacagttatcagtgaataaaagacacccaaggtttgcacacagatatatctgatgggggaatttcttcaattaagacttcatatttagaaattcctatagcctaaagcaagttaaaatagaagacgtgactctcacaagtcccttccggtcagcgccagcacctggtcaccttgggcacagagtaggtggacacccccagggtcccctagagtactctccatgcaattttaggaccacctgtaagtggaacacaacttctgttccaatccaatcacactggaccagagacagcattagggaagcagaaaacccagcatgaccagggtcacaaggtccttacggccaatgccagaaccgggtcacctgggcaaagagtctgtagacaaccccaaggtccctagaggacagcttctgaagcagaccccatttcgggctccagacatcggggcaccttccctgccagaggagaggtgtctgccctgcaccaggagggctttgatggagaacctgggggagccatcttggttcccagatacctaaagactagtctgcactgatgagagtatggactacagaagctaacagcttctgtgacaggcctaagcaacacagcttctgggacgggtcctgtttcagaccttcatcttccgccatgaggcatgtccaaacacaagatatctgtgcaccttccctgtaagaggagagcttgcctgcagagagtgctctgaccactgaaactcagaggagagagctagtcttgcaggtctgcagatagaggctaagagaatcatgagaggaacaatctctaaccagagacaactataacaactaactccagagattaccagatagctaaaggcaaacctaaaaatcatacttacagaaactaagaccactcaccatcatcagaatgcagcattcccacctcgctcagtcctgggcaccccaaaacaccagaaaagctagacccggacttaaaagcatatctcatgatgatggtaggggacatcaagaaggactttaataactcacttaaagaaatataggagaacactgctgaagagttacaagtccttatagaaaaacaggaagacaaaaccaaacaggtagaagtccttatagtaaaacaggaaaatatatccaaacaggtgatggaaatgaac

SEQ ID NO: 1536 - DNA, 1000 bp, mus musculus
ttggtgctaatttgcaaatgaatagagtgcatggacatccacatgggcaactttaatccttgaaatacttaaagtatttcaagctggtaggttacctccatgaaggctcaacttcagcaagggcagatggcagtaattcattgatatgaagagaagcattgagtgcatattgttggtctaattgggaaaaagttgtgcagtgagggccagcagccaaggatgggcaacttggtctatgtcttatttcaatctaagacagaggcatgtaccaagaggccatggtttgttcataataacaccatagaggggtgtttgtgcaaataaacacaaaaatgctgcatgtgttctccaggatgtgtaaaaataagtctagttagatttagtcctaagacaggtgtagccaccagccactaaaattcccaggcagaaccatggagcataagtaaattttatgccctactccagctaatatttattaaataatgagggaggaattgtagcctcccccagccttgagcaggctggtgcatacctgctctgccactgtctgctagcccacctagggtagagtcttctaatctagataggtctattgttctgccacctctggggatagatgccactacctgctgaggggctaaacctgtcttccctgaggtgatcctgaataaccaacagcttggagatgagagtgatgagagcctggcagaaaaagcaatgagagcctgggagcaggggcatgggccttcccccttatagcgcagacacttttttttaaagtgcattatttatgatttaaattttggacagcagaaggtgatggtaaaactattctctaaataagaagctaagttcagcaatgtctgaaactattcataatttatttcactatttaggattgtacatttctagggaattaccatcctttatactttattgctttaaggcaattaattgtgttatgactgattatacctctgcattgcttactgttacataa

SEQ ID NO: 1537 - DNA, 1400 bp, mus musculus
ttaaacaaaaaatccctattaattcaatggataatagaaataagtagacatctttcaaacactgtataaagtttgatagggttgtttttaaattgttttttcaattatttatatattataaatattaatatttgaatgtatacatatacacatgtaggtatactcatctccaatggatgcacatacacacacatgtatatattaatatttgctctgcagccagtgatattatctcagtagctgtaacagtacattttttaaagagaaaaaggaaagactatgcaagtatatgttttaaaagtatgtgtatatgcaataaatgttcttagtaaaataggacagaacagtcatcccgttacaatagtcccttctccaatttctcaaatgtccttaactgtgatttatgaccactttctgtatttcaaccatcctcagaaatcatctcagtttgtgtcttagtcagggtttctattactgcacaaacatcatgaccaagaagcaagttggggaggaaagggtttattcagcttacacttccatgttgctgtttatcaccaaggaagtcaggattggaactcaaacgggtcaggaagcaggagctgatgctgaggccatggagggatgttctttactggcttgcttcccctggcttgctcagcctgctctcttatagaacccaagactaccagcccagagatggtcccacccacaagaggcctttcccccttgatcactaattggaaaaatgccttacagttggatctcatggaggcatttcctcaactgaagctcctttctctgtgataactcaagctgtgtcaagctgacacacaaaaccagacagtatagttggtcttggatattttggtgtaacggtgacttatacattcatattttaaaagaattttcttattaatctttctgcattgtgttataatcctcattgatattaatcataagagatgctttaagagttctggtgaactctagacatagtcttccttatttgcatttcaggcaagggaataaatttctctctagtggtctgagtcagacactctttctaacactatcattgatggctaagcttgttgagttatgatagaaggacccaagtggtcaggagaaattcttcttttcatctctttcttctttcttcttcattctgttgttattcttgtaactttcactcctggcaaaagcactgctccttcataaccaaaacttctaggtcatcaggaaacaattccatggtaacagaagaaaaaaatgtttctctagtgagtcagtaatagtgacagtgaatgcaagtcacttttcctttccttaattttcctacaactcctggctaaggggagaagtatagtatgtcacagactcaaagttagtcatcattatgc

SEQ ID NO: 1538 - DNA, 1200 bp, mus musculus
ttaatattatttattttagatgtagaaagcaagtttgaccggcaccactttgtgcacatgctattatttatttacatcccaaatgttgactccattaccctttgagagtccctctgccatccccatcccctttgcctctgacagggtggagcctaccctggtcatcctcccaacattgacacactcaagtctctgcaggatcaggtggatcctctcccactgaggtagaaaaggctgccctctgctaaatatgtaagacagtgcatgctcttggttggtggctcagcatctcagaactcctaggggtccaaattagttgacactgttggtcttcttgtggggttcctaatcccttcagagcattcaattcttcccccaactctttcataagagtcccctacctccatccaatgtttggctgtgggcatctgcatttgtttctgtcagatgctgggtagagcccctcagaagaaaattatgctaggctcttctttgtaaacataacagtacccttaatagtgtcagggattgtgcttgaccttagaatgtgtctccagttggctggttattggatgaccattctttaagtctgtgctccatgtttgtccctgatttttttttaaagaggacaaactttgagttaaagttttgtgggtagattagtgtccttatctctccacatgggatcctatctggctacaggagttagcctctttaggttccatgtcccctctgttaggcatcttggctaaggtaacctgtattgcagtctctgggacatcctaaagatcccagcatattaaagattctcccctccttattgcctcatacatcccccttcccctgcagccacagatttccattcattctgctggacctctgggcctctccctgtctcttcacacacctgattctgcccccttattcacctccctctcccttctccattcaggttcttctttccctctgctgcccatgattattttgttactccttcaaagtgtgaatcaagcatatttatttaggccttccttgtttaacttctttgggtccgtggttatattatgggcgttccgctttatggctgatatccattcatcggtgagtttataccatgcatattcttttgagtctgcattacttcactcaggatgatattttctagttttatctatttgcctgcaatagtcacgatatcct

SEQ ID NO: 1539 - DNA, 1400 bp, mus musculus
tccttagttgtctaaagttctttgcctataataaagttctcaggagatttcaccttttatattatagtattactattggtataatcttatcatgtcttatgtgttcaacgatgatttatgatttctttgaaaacttattacaatgtattttgaatatattcattcctctcccccaacttgctcaataactctcctctcaattccttattacttctgactttattttgagatttttacttccctagccttcaagttccgttcatgtcctgcagtcagtgttgggaatggagcctgaaaacggccaattatgcttttctataccttattaatataattttgcactaagaaaatttttgtttattgcaagttttaatggtttgctctaataacattttctattacttgtgcattgagccttcacaggaccaagggcctctcttcccattgatgtccaacaaggccatcctctgctacatatgcagctggagtcatgggtcccatgggtactctttggatggtggtttaatcccttggagctctggggattactggtgggttcatatcgttgttcctcctatgtgactgcaaactccttcagctccttcagtcctttctctagcttctccattgggaaccctgagctcagtccaatagtaggctgtgagcatccacctctgtatttgtcaggcactggcagaacatttcaggagacagttatatcaggatcctatcaacatgcacttgttggcatccacaatagtgtctaggtttgttgactgtatatgggatggatctttatgtggggcagtttctgtatggcctttccttcaggctttgctccaatgtgtattttgttcccccttctaagaaggatggaagtatacacggttatccattagacagagcacaggatccccaatgaaggagatagagaaagtacccaaagaactgaaggggtttgcagccccctaggatgaacaacaatatgaaataaccagtaaccgtagaactccctgggactaaaccaccaatcaaagaaaacacatggagagactcatggctctagctgcatatgtagctgaggatggcctagtcggtcatcaatgggaggagaggcccttggtactgtgaaggttctatgccccagcataggggaatgcttgggccagaaagtgggagtgggtaggttggggaacaaggtgagggggaagaggatacaggattttttaaggggaaactaggaaaggggataacatttgaaatgtaagtgaagaaaatatctaatttaaaataaaaataattaaaaatatattcttttaagctcaaaatatttacatttctttaacttctccttatatgcactactgtcagcttggtcatgctgtggctgcctctttctt

SEQ ID NO: 1540 - DNA, 1400 bp, mus musculus
caaaacagccagcctagccactgctagctgcattgggaagggcgagctgtgctcaggaagttgccacagttagaattgctcctgacagaggaggcaaaaaggcaaggtctactacatagaccacaggaactgcaccatcagctggattgatgctcgggacaaaccaagaataattctgcattcctgcatccagttccaagttgtgtcaggacagcagtcagtcctcaagctgctgtgtgggaccaagatattaaagtcctcccctaaccccagacggtagagtttgcttagagcacagtccatccaaaggttcataagacaggagctatggacagagatgttgaaagatccatggccgtggtgttcataaacttgacactatactgcttgaaggaagataaacaatcaactgcctctccaaaactatgcctacctgcttgttatcatgtttcctgccatgataatagtccaaacctctgacctaccaaaggcttcagcacagctccaggagagccagaagaaaaacacacccaacggagcaccaaggccgggcagtgaatgccactctgatgaatgaatatgtgatggagagatgtgaaatatggagtatgtgatagggagatgggagggaaagacaaactgagtggatcgtgcactgtggagaggcaagggcagtgacaagcagtgggtctgaggagtctgtgcaatcatttgaggtcatggtgatgtcctggctcaggctgccacgaaaggctagttctgggtcctcagccctactatatgtagcctagtttctgtgctgatgtctgtggcccctgttgccactgaaggccatctggaagtcaatggtcccaggtgctgcctaagaccatgttgatggctggggacatattaaagcttatggccaaactgatttgagtggcctgtgctgccacctgagatcaagctcatgctctggcctcagctgatgctgagggccatgtctgggttcacggagtctgtgtctacatcagaggtctgtattaccactaaagggagcacacgttgtccttggtccctgctgctgccaaaggccatattgatttccaagcacagtgctgagctgtccccacccctcaccagctgtagcactcaggaacaaaaggcaaaaaccttcactgggcagcatagtagagctggcccttgtgacagccttgagtttggaagagctgaccagctcatcctccacccaggcccagctctggggctttgaattggccaacaccaataactacctgatctgtgaactacagaagcatgccaaaaaccagtcctgctgatcacagttacaggatctccatgacacaggaaaatagcagtatatctgaggagagccttgctaaatatccagtattgatagt

SEQ ID NO: 1541 - DNA, 1200 bp, mus musculus
ttggagctgagatgaaaggatgaaccatgtagagactgccttatccagggatccaccccataatcagcatccaaacgctgacaccattgcatacactaggaagattttatcgaaaggacccagatgtagctgtctcttgtgagactatgccggggcctagcaaacacagaagtggatgcccacagtcagctaatggatggatcacagggctcccaatggaggagctagagaaagtacccaaggagctaaagggatctgcaaccctataggtggatcaacattatgaactaaccagtaccccggagctcttgactctagctgcatatgtatcaaaggatggcctagtaggccatcaccggaaagagaggcccattggacacacaaactttatatgccccagaacaggggaacgccagggccaaaaagggggagtgggcgggtaggggagtgggggtgggtgggtatgggggacttatggtacagcattggaaatgtaaatgagctaaatacctaataaaaaatggaaagaaaaaaaaaaaaaagaaaggtcctgagcctagtttcaagcaatgattttttgagggtaagaaagacctatgtagcatgatacacatctgattgggcagtcattatggtctttagcttaattggcttgtgctaggagctaaaccatgaacctaattcctgttttcctactgattggaagtgaagtgtcaagggcatgcttactggagcctggcgatgcagatatgttggagaataaactggaaacgggtgctagccacaggtttgttgggtgctaacatggaaactggtactagacacagggcttggtaaaagcttgtgctatctactggcctgttagttaaattaggtataatcttaggtcatgttttccaagatggagtctgaactcaagatctggtctctcaaaggcataatattattgttgttgccaatttgcaactataattttgctactgttatgaattgtaatgtaaatttttgtgtttcctaatggtctttgtagatcactgtgaaaggattatttgacacagaaaagggttgtgaccctccagttgagaaacactacaatagaacaaaaagtaaacatacctaagagaagcagactgagaagtcatcaaactgaggtttgaaatcaataaaatagaaacaaagaaaaaatacaaataatcaaag

SEQ ID NO: 1542 - DNA, 1000 bp, mus musculus
agaatgccctgggcctaaaccacccaccatagagtacacatggagagacccatggctccaggtgtatatttagcagagaacagccttctgtgacatcaatgagaggaaaggcccttggtcccatgaaggctcaatgctcctgtgtaatggaatgccaagacagggaagtgggagtgggtagattagtgaggggggggggaggatatggaacagggggttttcagagggaaatcaagggaagaagggaagggaataatatttgaaatgtaaacaaagaaattgtctaataaaaatattttttaaaaaactgagaaaaaaagcctattgatctgagaaaactgattctgaatctaaccactttactgaaatggtttctgtgaggtttctggttgcatttttgatatttcttatatataatatctttccgtctaaaatagtgatgacttaccttcttttctaagttgtattcatgtaatagtctcttgttttacagctgcagctactgtttttggaattgtttttgaaaacttttggactaaagagagccctgtctcattgctggacactaatgggactgattccagttttccttctttcagataatattggctgtaggtttgacacatagctttcatatgctgagatatgattccctcattcctaggctctaggacttgtttcataaaggtgtgtagattaaaattcctatacttacacatacatacatacacacatatatacatacatacatatgtacaaacacatgcatatttttaagtattataaagtaaaattctgtgtataagtaaccaaaaatatgcttaagcaaatttattcatttacatttttattatgctaaaagtaattttagagtttatcacatgaataaacaaaaatgtctaagtagtttaagtaacagtttactttctcctttacctggattgacctgtaaagaaataaacaataagaattaaattataaagttaagaaaaactgagcc

SEQ ID NO: 1543 - DNA, 1000 bp, mus musculus
tcttcatgacttagtattattgtttcatgatattgggtattaagaaacaatatgcagccaaccatcagactgagcacagtatgttaatggaggagttaagggaaggactgaaggagctgaaggggtttgaaaccccataggaagaacaacaatatgaaccaaccagataccccagagctccctgggactaaaccaacagcaaaagagtacacatggaaggatccatggctccagctgtatatgtagcataggatgatcttatgtggcatcaatgggaaggaggtccttggtcctgtgaaggttcaatgtccaagaataagggaggtgggagtggataggttggttagcaactaatagaagcaggagggaggaagatgggataggtggtttgctgaggggaaactggaaaggggaaaaacgtttgaaatgtaaataaataaaataaccaataaaaaagaaacagaatatgcagtgatttgaaaatttgtaggatttttaccattgtacaagataataatacaatatgcagattaaattccctgtaatatcacattcatcattcatgcaataatgcaataactgtaatagtttgataatattgaaggaaaaatagaactctgtgacatatatacatatacatatacacatacatacatgcatacatacacccatttatatatatatatatatatatatatatatatatatatatatatatatatatataagtttgaaatttaaataggctccagttgttggtttgatggcttagttctgtttggtagccttatggaaattttgtataccacagctttgttggaaagtctgtgtcactgaagaagacatcgaggttttatagcctgaccatatgtcttgctctttctctgcttcgttgagcttttgtatcataagatgaggaagctttcttccactgtctctatgttcttccctgactgtatatctctgccacattagtggaatctatccttctataactcta

SEQ ID NO: 1544 - DNA, 1200 bp, mus musculus
ttaaataaataataaaaaagaaattttgaagcaacttctagaatttttttttaaattttgtaattatatttaggtacagaaaacttagtgtacatttaacccaatttagtggcgaggtctttagcctttgctttttccagcttggcaatgagagtcacagacttaggacccagaacgttgcctccccagtggcgatggatctcatcatatctgtcattataattggtcctaatagcttccaccagcttagccagagcacccttgtcttccgagttaacctgtgtgaaggcaacagtggtgcatgacttcctgtggaccaggcatcccagcctggcctttccttgatgatgcagtagggcacccccatctttcgacgcaggcaggaaaaccaccaggtcaatggggtctacgtcatgggtagtcaccaccagctgagccttcttgttctccatgaaggtggtgacttaattgactcctgctaggaggacaggtggtctcatagttgggacgtcgcctttgccagcagctttcttctcagcaaggactagtagcctttgcttcttctcttgcttggtctctggcctgtacttgtgggaaagcttaagcagctgaatagctgtctgcctgtccagcgcctgggtgaactggttaatggcaggagtttactttgagccgcttatagaggatggctctttgccgctgcagcctgatgtagcggggccatttgaggaagcacattaaatctcttttgggctggatgtcctgtccaatgcggaagttcttgggccttttctcaaacagagggttgaccactttcttggcctcctgcttcttgacgacggctggggccagggccaccttcttccccttggccttctatcctttgggcaccttgctcggctgctggagagatggaaattttaatagatttaatttcttctcagaatatagatttggaggaactgagttattgatgattaataaaaataggaatttttaaatctgaaattctttaataaaataatttttgcaattaatcataactgtcaattacaattaaaagaatccagttcaatatcaactatgtatctacagacaacagataccaaagttcatgattaaatatgaaaaaatcaaaatgattaataattattattttgaatatatataatgtttgcttccttggacattttgctttct

SEQ ID NO: 1545 - DNA, 1000 bp, mus musculus
agatccatgtcttgcttttctggtgtggtggtgtatccaggacttgctatggtaggagaatttggttctgatgatgccaagtaacctccgtttctgttgctttttttcttatgcttgcctcctgccatctgattatatcaagggcttgccgccttcaatatatctgattggagcctgtccttcctataatcccagttgatttagggctcctcagaatacagctttctctgtgatcctttgattgcaggctcctgggaacctgaaattctgggtgtgtcagagttcttgtcaatcaagcttcctctgagaccctgaaatcctggtgtgaccaagctcctgttatcctctatcctgtaatcctatgatcctaggtgcgttacagtgtctggaagtggtgtctcctttgaggactgtggagctgtctggtctctttgaaaccaatgtaaaccagtactgattagaaggaaccagagtctctggccaggcagggcttccgtgtccttgctcctgctgtcacaggcctgtcacacttggtttggaacagatgttgtgttccactgatcctaagatcttgtggagagtcctctgcagaccgtggggttgtctgtcaacttccgccaaagtgacccagtgctggagctgactggaagggacttgtgtcccagatcaggcaggttttctgatcccctgctgctgactcaggtcttgtgcgattggattggaaccgatgttgtgtttcactcaccagtgatccaaagatggcctggagagtccagtgggagaccttggaggtgtctgcgcacagggtgactcggagctggtgcctaccagaagcagatactttttataaatagaatattttaaatattatttagggaaaaggaaaaaagaacacaggacctactcagtgtaaattatttaaattagatgttgctgtatcacaatattcaacactagaaaaaataaagcacaggttgactttgaggccattgcataacat

SEQ ID NO: 1546 - DNA, 1400 bp, mus musculus
ttctaaaaatggtacaaaaaggagataaaaaatgactgggaaaataggaggaaataccttggcaatgttttgagagataactaacttgcaggttatgtgaaatttccagaacataatacaatcttacttgactctttctcagtataacaatgtgttggagaattatagagcgattaagagaaagaacaattgaaagaaccagatggagggtggtgctgaagagtcagacattctcatgttggaaaaccaggacatcctagaaggcctcattaaatggagaagatgggactatgaacttagatgtggagcattttaagtttagtaatcaatttacttaaaataaatataatatataagagaatgtatcaggtacacagctagtgtatgaacatattgcatagactgtgtattagtcaaggttttctagggtaacagaacttatagaatgatttcccttatatgtataggaaggaggatttattagaatgacttaaaggctgtggtctggctaacgcaataatcgttgcacatttgaaaaaaaaaaatccaggagtttttccagatcatgaggttagaaggaactctaggatttaatatactttctcccactgactccagacaaatcagtccagttaggatagcaggatgcataagcaagcaacagaatcaaggaaattccctgcatcaatttttgaggaacctgcttgaaaccaagctgtacacattctacttatgtgcagtgcagtggtttggataggaggcctatgtccagccctcgtgttctctttggttggtagttcagtttctgggaggccccaactgttggttttttttttttttttttttttggttttttgagtcagggtttctctgtgtagccctggctgtcctggaactcactcggtagaccaggctggcctcgaactcagaaatcctcctgcctctgcctcccaagtgctgggattaaaggaatgcgcctcttgatcttcttatggagaccctatcccctctgagttacacaatccttcccccaattcttccacaagactttcatctaatgtttggctgttggtctctgcatatgtttcattcagttgctggactagagcctataaggggacaagcataattatgtacatttaagagataaaattaaacctcagaaataggagttaaataacttgttcaaatttgtgaaccatttactaagcggatgagtttaaattgtcatttatattaactcacaaatatcttgttacaatatgtatttgcaggtgtttgctacttacaaattatagggaattatatattttctacttttacaaaacttatttgttcatatttcaggagttaaaggctaaatgaagaatcatcataaagagactatatttgtctttcaa

SEQ ID NO: 1547 - DNA, 1200 bp, mus musculus
tcaacttgtcttcagagaagatcatttaccctaaagcttcttggttgcatcttatacccttcttctcatctgcaggaaaattggattacagatcttcagctttataataaggttcgcatctctttccaaagaatgatttttaatcattgccacccttccacaaaatgtatgcaggaatgtgtcccagggattagtcttacattttcattggtaccattgatcagagctaagaatcctatttatttaagagttgtcacatgcttgagaattttgacttaagacagagaagaataataaaaaaactaaactagggcacaaggtatgtataggagatttggagaatagaagtatgtgttgaatcaaaaatgcagcagattaagagctgtaaaggaacattgaatcattatttttccatatttaaaataaggaaaaaacaaattattttaaaatgaatatgtagcaaaaataaaatcaaatctgaaattcttcaaagttgttgctactgtgaacaaattatgaaaaaaatcatggcagatttacttgtttttttaattaggtatttatttcatttacatttccaatgctatcccaaaagttccccacaccctcccccacccactcacccacccacccactcccactttttggccctggtgttcccctgtactgaggcatataaagtttgcatgaccaatgggcctctctttccactgatggccgactaggctatcttctgatatatatgcagctagagacaggagctccgggggtactggttagttcataatgttgttccacctatagggttgcagatccccccagctccttgggtactttctctagctcctccactgggggccctgtgatccatccagtaggtgactgtgagcatccacttctgtgtttgctaggccccagcatagtctcattattaaatccttctagattttttttttacattgtgtatctctatatactgttgcgtaattctttgttgaaactaaaatgtatgaaattttaagtaaagtaagcaagacaccaaaatactctccagtaatgtttgaagcctattatggaaatgtagacgtagggtttaatagagtgagggaagcagaggagggagagagaaggagggagagagagagagagagagagagagagagagagagagagagagatatggatggaaggagggaagca

SEQ ID NO: 1548 - DNA, 1000 bp, mus musculus
cacatattccctccctcctccatctgctcaccaatctacccactcctgcttcctggacttacactggcccataaagccttcacaggaccaaaggcctctcctccctttgatgaccaactaggccatcctctactacatatgcagctggagtcatgagtcccaccatggttggtggtttagtttctggcagctttgggagtactggttcgttaatatttttgttcctcctatggggctgcaaacccctgtagctccttgggatctttctctacctccttcattggggaccatgcactcagtccaatggtaggcttagagcatccacttctgtatttgtcaggtactggcagagcctctctggagacagctataacaggctttggtcagcaagctcttgttggaatacacaatagtgtctaggtttggtgcttgtatatgggatggatcccaaggaggggcagtctttgaatggtctttccatcaatctgtgctccacactttgtctctgtaactccttccatgggtgttttgctcccccttctaagaaggatggaagtatgcacactttgatattccttcttgagtttcatggggtttgtgaattgtttctttggtattctgaacttctgggctaagatctacttatcattgagtgcacatcatatgtgttcttttgtgattgggttacctcactcgggataatatttttgagttccatccatttatctaataatttcatgagttcattgttttaatagctgagaagtactttattgtgcaaatgtaccacattttctgtatccattcttatgttgagggatatctgggttctgtccagctcctggctattataataaggctgaacatagtggaacatggttccttgttacatgttggaacatcttctgagtatatgcccaggagtggtattagtaggtcctcaggtcttatctccaattctgaggaaccgccaaattgatttccagagtggttgtaccag

SEQ ID NO: 1549 - DNA, 1000 bp, mus musculus
atgaatttcagtgggcagaaaattagatatagggtagttcgaggaatgagcttgatattaagtacatttggaatctagtttcagtactaaactacatggaacatactatgcatagaagagtttcttagttgagacttctaaacaaaatggaatcaaaaggcaggaggggtgatttgaattcaggaaacaacatatgacaggaaaaggttacttcccagaaatatagtctgtcacaccctaaactcaggggaaaaaagcctttttgtggagtttacactaaactccagtgtaaaaaaaattataggagctgatcattaatgagcatatgtcactggcaaatatccatctgattcataaaacttattttatattattttattttactgaatgttttatttatttacatttcaaatgttatcccctttccttgtttcccctctggaaacaccctatcccatcctctcccctcctccttctatgagggtgcttcccccaccccccactcctgcctcaccaccctagaattcccctacaagcctaccaaggaccaaggacctctccttcccttgatgttctacaaggccatcctctgctatatatgcagctggagccatggatccctccatgtgtactgtttggttggtgctttagttcctgggagctctgggagttggggggggggtgtctggttggttgatattgttgttcttcctatggggttgaaaatcccttcagctccttcagtctttttgttaactcctccattaaggaccccatgcttattccaatggatggctgtgagcatctgccgctgtatttgacaggctctgccagaggctctcaaatgactcttatcaggctcttatcagaaagcacttcgtggcatccacaagtgtggctgagtttggtgtctggatatggaatggatccccaggtggggcagtctctagaaggtcattccttcagtctctgctccacactttgtctctgtaactccttc

SEQ ID NO: 1550 - DNA, 1400 bp, mus musculus
aacatggcctgcaaagccactgctatagaaaaattagtacattataagactgtccacttataagtgtttgtatctaggacaatgttctaatatatcttatccattgtgacttaagtatttaaatttactgtgctataattatgaagaattaagattttacctcaaatgttacaatttttaaaaaaatgaaaatttagttaattccattaaacttcttaaaataagaaaaagaattgcctatcatatggtcaactaaagacatatttgtgtatggtttataattgtgaggtgagttgtccataacattactagtgacaatagtttaaattattaacaagttttagagcatgaaaacttgttttactataaaggcaaggaatttcatatttaatatagatataaatgtctatatacttcattaagtcatatacatataagttaaaaagtaatgcaattactttatacaaacacacacacacacacacacacacacacacacacacacacaccagaggtgtgcctggtctgacctcagtggtagaagacacttctaaccctccaaagacttgatgccccagggagtgagggggtctggtggggaagggcatcctcttgaagacaggagggggaagaatgtgatgaagaaaagtagaaaggtgcctgggagggggcaatgactgaattgtaaaacaataaaattagcaataaaaagtaaaaaaaaaataaataaataaataaaaaggttaaagcatatacatatatgcatatatattataaacagatatacacttttacaaggagatgctattattcatttctgtatacttttatgatggtggaaaggatatgtgttggtaatcttaataagtttattttatcaatattttaatctggcaacagattgaagcacaatattagaaaaccttaaattgtacaaaatacattgccaatagtcagtttaatgtagcattacaatattggacttgtctctaggcacctgaatttacctatgttaagagcaatagagtgtgcctgtatctgcacatgtgtatgtaggtgtcgagaaatctcaaaagggatggtgttagtagtagtggataaattggtgaggagtagtcaaggtatcatcgcaagtctcaatgtgtgtcataatatttgtggtagatacaaaatgtgtctttaaaatacaaagagacagctttgctattactgccttacaaaaagtaatggaactcaatgatagcccagatggttcaggaagctgttaaagttttaatggaattcccatgtgtgaacatgtgtgtctctgaatctacatgtggtccccatgatgtttttttttttatgtcattttatttcatcttttaaaacaattctttagttatctgattgttttctaa

SEQ ID NO: 1551 - DNA, 1400 bp, mus musculus
cttccccttcttccccttcttccccttcttccccttcttccccttcttccccttcttccccctccccctccccctccccctccccctcccctcccctccctccctcccctcccctccttttcctttccctttccttcccttcccttcccttcccttcccttcccttcccttcccttcccttcccttcccttcccttcccttcccttcccttccctttccttcccttcccttccctttccttctctttccttttctttcctttccttttttcttttttggatattttctttatttacatttcaaatgttattccatttctctacctcttagaaacaccctatcacacacacacacccctgttcctctgacccacacaccctctccctcctcccaagcctccattcccctatactggggtatctatcaagccttcataggaccaaggacctctctttccattgatgcatgtatgtcacccaacttccttattgtcttctgtataaaaagtttgatgctcgatttgacaaaatacattcagattctacacaacctctcctgtgtccatctgtctgtcattcatcccatgttttgcccacccgcgactagagacctgttccacgcagacaaaggggccaagagggtctgcggcaaatatcaacctaaattaaactctaaaagacaaagttagcaacaattcaatatttctgttattaaaactaaatttatgaatcaaaccaataactagaagttcatttcccctgtttataaaaattttcagtttcttcatattgtgacatttgtaaagtttgaaatatctaaaatttctatttaaatattgttacgatcactttgcataaagagggacctttgcaagcagaatagctactctttgctccgtgtgttttaaaaacatattttgctatattttcctgtcacttatccaagtctctgatagtttgctattaatacaggtagaaatgttgtacatagtctttgcttttataatcatttctgagacagaattatgtcatttactgtttgaaacactaataaaaattatcaagatatgtgttgagtttgaacagccttcaagttcttgtcaatgatgaatcttttgttatttcttttattttatcttacattggttaagttaaactagctacttttgtaacattcaaaaattataaattctgacacatttccatttttttcaggtcagttcccttttaaggatagatatgtacaaaaacattgaatgctccttaaggtttctatagcattgtaagatattcagactactatttttttcatggggagtctttgtattgctatgttctttgcacagaatctttcagataaccatcctatatcaattaatacttatctatacatatgtcttc

SEQ ID NO: 1552 - DNA, 1200 bp, mus musculus
agaggaaaagcatttacttggtagataaacttgaacttctcagagccttaatagcacttttggaaaacggcatattataaaccattaggacaagtaatgctaggggaaacagtttaaagggtagcaatgagaaggacagcctaggctttattcaagaaaggtattgtaggacagtgaaaggcagcctggttctggtggagcacaggctggaaaccctgatgaccctaaggaacagatggcagtttgccatgatcctgacacagggtcgttgccctccatagatctgtggccaacagtcatgtaagggcaatgccgtaagcccctccacaagtaaaggatgtgaccacaggtcatgtagcctcaaggcagatctccattctaatgatatctaaaagcctggcttagccagacactcctccatgcaaaaggtatttaactttaagcccaccctgagaaactgggtatggttttattaatctaccttctgccatgacaataaatgtcttaaaaccatagactgcctcttttcaacaggatccaccatggggagcaatggaagaggtcttcacctaaagagctggatacctattctcctgctttcacaaggccggtaccaaccaagccactcttcaaacaagccaagaactctctcttcactgctggacccaacacaagctctcctttcttttctcctttgccccagagctagatcctgttcgcaggtccccactccattctcagcccttctgcagcatccagtggtgcctgggtaaccaagatcctgaaagcaagatggccctggcctctgggcaggttggggaccctcagccagttcaagctgtccctggaacctcagactgcactccctcacccccaaagctgtgtcccgcagcttcccatagcctgcccggtgctgcagtggggtaagcacagtccaactcccaagtctacctcctggagtggcccaagccaagtgacagagcagattctggacaccacaagccctacaaagtatgactggaaaggggccagtagccaattgtctgcttacaggtgggaagttataggacagaaaagaggaagaaggaagggaactaaaacatttcctgtttggatatgttgctggctatttctaggcgtagctttggaatcaagatgagaggtgagctgaaaaatgtcaggtgataataatcaacccca

SEQ ID NO: 1553 - DNA, 1000 bp, mus musculus
aagaaacaggcaacctccggaggtaggaggttggggaaccttctagaatataccagagtcctgggagaagagagactcacaggactcagagggaaggaccttagataaaatgcccaacagtgaggagaggaaacttgttgtgtctcctaccagtagaaaaacagggcatcaagtggaaggatggggttgcagtcccagtcaaaattgctgacccagaattgttcctgtttaaaagaactggagggaaaaaatggagaagaaactgagggaaaggaggtccagtgaccaacccaaatcgggatcaagctcaaggggaacatccaaggcttgacattttactgatgcatacagacaggagcctagtatagctgccctctgagaggcccagcaagcagctgaaagagccaactgcagatacttacaaccaaaaatgaactaagtcagggacccctgtggttgaattatggaaaggctggaagaagatgaggaggaggttgaccccataagaagaccagcaatctcagttaacctgcacccccgtgatctctcagacactgagccaccaaccaggaagaatacactagctgatttgaggctccgacacacatacagcacaggaccacctgctcagtgagaaaagaagcatcttgccatcgagagacttgaggcctgtctgagtatgtactgggaggggaatagagactgataataataataataacaacaacaacaacaataataataatacacagtgtagtggactcgagggcagggacatgggagtaggtgggtgggaggaggaacatcctcataaaagcacggtgagagaggatatgaaagggtatttcttggacagagggaaaccaggaaaggagataacatttgaaatgtaaataaagaaaatatccaataactcaaactcataataataataataataataataataataataaattaaaaatatgaagcaggcatgtgttaaagtaaaaaaagcaaa

SEQ ID NO: 1554 - DNA, 1000 bp, mus musculus
ttgtatttttcaacaggtgaattatgaaatttgtaaataagaggatggatttggaaacatccatcatgaatatggtttcccagaacctaaaagacaagcatcacattttctttattgtatgtgttgtcctagttaggattattattgctgtgcaaaaacacaatgaccaaaaccaagttggaattaaagggataggattttcttacacgtccaggtaacagttgttcatggagaaaagacaggacagaaacttggaggcaggagctgatgcagaagccatggaggggtgatgaatatgggcttgctccacatggcctgctcagcctgctttctcatagaaaccagacctacaaggacagggatggtactacccacaatgggctgtaccttaatcactaatagaggagatgctcaatagactacttacaaacaaatctttttttcttaatatttattttaataactttatacagtccagtcattatccccttccatggctgccctccaacagttcctcaccccattcctcctatctccagtctctaagagggtgttcccactccctcttcccagcttccccactatctccaaccccaccaagcttccctactccctggtgcctcacagttcatggctcttcagggttaggggcatcttctctcattgaggccagaccaggtacatatatgtcaggggcttcagaccagctagtataactgcctgaatggtggctcagtgtctgagagatctcaggggtctgggctagttaagattgctcatcttcctcaacttctttcagaccttccctaattcaaccacaggtgtccctgacattagttcattggttgggtgttaagtatctatatctgtctcgatcagctgcatcttgggcctctcagagtacagcgatgctagctaggctcctgcctataagcacaccatagcacatcagtaataatgtcaggtcttgcagcttccccttgatatggatcccaaagct

SEQ ID NO: 1555 - DNA, 1200 bp, mus musculus
aaacaggaggttattctgtaacatcccttacaatattctataagcatggaaattgggtcctacaaccaggacacaaagaaccaacctataacaggaggtaaggcatcccaagtgtaaacatctttcatattcagcattaaaatatttgaattgatacaatgaaagggtcttcatttcacctagcagtaacaatgactgtgcctacattatcctcaacttaccagagagatcaacttttctctccttaagtctaatttctgtagttcttgtatgttgatagcatttaacggtggttttcatgttcttgaaagcatgtttgttccctagtacaccttatgttgaaattcctttcatatttcctcttatttgtattaattccttaagaatttgctcaatgactgtattttgatcctattctatattagtctttgatgtgtcctctctatcattcagacaatttgatgtcatctgtgtgtttgtgcatgtgttttactggatattttctgaatttacatttcaaatgttatcctctttcctggtttccaaccagaaaacccctatcccattcccccttcccctacttctatgagggtgttccctggcccacccttgcacccacccactcctaactccgcgcactggcattcccctacaatggggcatcaagtcttcataggaccaagggcctctcctctccttgatgcccaacaatactatcctctgcaacataggctgctggagcaatgggtgcttccatgtgtattctttggttggtggtttagtccctacaagctctgggagtccggttggttgatattgttgttcttcctatatggttgcaaaccccttcagctctttcagtcctctctctagcacctccattggggaccctgtgttcactccaatggttggctgaaagcgtccacatctgtatttgtcaggctctggcagagcctctcaagaaacaactatatcaggatcctatctgtaagcacttcttggtatctacaatagtgtcatggttttgtgagtgtatgtgggatggatccccaggtggggcagtcactggatgtcctttccttcagtgataagtagatattagccccaaaacttagaatatccaagttacaatttgcaaaacacatgaaactcaagaaaagtaggtcttctttcttcttgagcttcatgtcatctgtgaat

SEQ ID NO: 1556 - DNA, 1000 bp, mus musculus
gtgctgttaggctaagcacttttaaagtccccatgagaccaccaggagttctaaagaaagtggggtttccactgaacatagggaacctaggaggaaggaagaccaggtgtggatgcttcagttctgtataaggggggaacaggacaatctcgggaggtggaaggagggggaacctgggagagagagagaagggggggggaaggagacaggatcagtactgtggggggagggagggagagaggtatagagggtcaggaaatctcatataaaaatatgtagcagtggagggtgaggaactaggggtagctactagagggtcccagaggccagggaagtgagaggcccccagaaacaaccacgatgacttttagaggagatagaacttgtagggactacctccagtagagaggcacagcccccaagtgaaggattgggccacccacccatctcaaagtgtttaacccagaaatgttcctatccaaaggaagaacagggtcaaaaaatggaacaaattgaagcaagggccgtctagagaccataccacctggtgatccatcctgtatgcagacaccaaaccctgacactgttgctgttgccaagaggtgcttactgacaggaaccttgtatggctgttccctgggaggttctgctagcacctgaccaatgcagatgtggacgctcacagcctcccatcagactgagctcagggactccagagagggagctggtggaaggactggagaaacagaagaattgcaaccccataggaagaagaatgttggctggccagaccacccactgctcccagggactggaccaccaaccaaggagtgtgcagggagggatccatggcctcagatacttgtgtagcagaggatgaccttgtctgacatcagtgggagggaggcccatggtcctgtggaggtttgatgccacagtgtaaggggatgatggagtggtagagggttcggtagggagcaccctcataaaagaaaggggg

SEQ ID NO: 1557 - DNA, 1000 bp, mus musculus
atccttcacaggaccaagggtctttcctctgatttatgtcccaaggccgtcctctgctacatatgtgactggagccatgggtccctccatgtctactctttggtaggtggtttattccctgggagctctgggagtactggttggctcatatcattgttcctactacggcgctgcaaaccccttcagctccttgggtcctttctctagctcttccattgaggaccctgtgctcagtccaatggtaagctgcagtgatccatttctgtatttgtcaggcactggcagagtctctgaggagatagctatattaggatcctatcagcaagaacttgttggcatccacaatagtgtctgggttggtaactgtattgactgaggagtcaatattcaattctgttgggcaaaaggaaattctcgacagtatttaactcaaatgctgcaagtcaagttgtatatactaatgaaaaaaaaaatgtgttcgaatgtatgagttactagggagtccattgtaaactatgtcccacgtactttgatcactctgggctcccagcctatcttctgtgctctggaatgatgcgctggtgtatctgcagcttgctgatctatttctgctgtgttcagctggctgctaacggtcctccacagaatgtaagaatagcacttaacaggatgaggggaaaagagagagttgctctttcttcttagcttcctgttcctgcttttgcttcccactgctcacagcattaccacagtgacactcttcacctggcagtggcatttcatctcaggagcagcagtggctgatttcagtttgcacttttcccaacacttttcagcatcaagcttgtggcactcccaagcttcaactgagtgaacagttactcctcctccagagtctaggcttcagctcctgcagacttcccttcatggtgattccagacagtgaatgtccaagcctcaagggggaccaacttttaatagttaccactagttcattcct

SEQ ID NO: 1558 - DNA, 1000 bp, mus musculus
aggagggaaactaagtctcctatgcaattgtcgaggaaccacaataatgtccaccatggcacaataactgtaaaggtgcaactatcgcatacataccgtgatggttaccaatagttgtctaattgatataaggcctgatcagcagtgacgaaaatcagacctggtactgaaacctggccaactacacaggattagtgaagtcagaaccccccacccccctgtggagagcccagccacgagcaatcacgtgtgtgttgtgagcaatcaccattataagatggtgctggcttccactgagcctaactagtaaacaagccttatgcgcaagtgcaagagtgaactcatgcctagtcactgcccatcttttttttttttaaattgggtattttcctcgtttacattttcaatgctatcccaaaggtcccccatacccaacccccccaatcccttacccccccactccccctttttggccctggcattcccctgtactggggcatataaagtttgcaagtccaatgggcctctctttgcagtgatggccgagtaggccatcttttgatacatatgcagctagagacaagagctccggggtacttcttagttcatattgttgttccacctatagggttgcagttccctttagctccttgggtaattcactgcccatcttgcggcgtagtaatggggtgatgggcgagcaatgaatcaggagctgtcacgccacatcaggtgctgaaacgtcacgctgcgggctatataagcagcgccattttcctggttcggggtcttccctcctgataagaaagcaataaaagcgttgctgcagaagattccggttgttctgagtgtgttcttgccggtggggaaaaaagctcgggatacccccccctttttttttcttttttttttttggtctctttgagacagggtttttctgtatagccctggctgtcctggaactccctctataaaccagactggccttgaactcggaaat

SEQ ID NO: 1559 - DNA, 1000 bp, mus musculus
actccatattttatttccccaccccacctaccctccaactcttgtacatcccataccttctccacacacccttttccccatgtggatatccccaccccccactctacctctaagctccctggggcctccagtcacttgagggttaggtgcatcatctctgaacaaaaacagaccaggaagttctctactgtatgtgttttgggggcctcatatcagctggtgtaggctgtctctttggtgatgctgtgtttgagagatctccggggtccagattaattgagactgctggtccctcctacaggatcgcccttctcctcagcttctttcagccttccctaattcaacaacaggggtcagttgtttctgtccattggttgggtgcaaatatctgcatctaactctttttgctgcttgttgggtctttcagaggccagccatgataggtccttttttgtgagcatgccatagcctcaataatagtgtcaggccttgggacctccccttgagttggatccaactttgagcctgtcgccagaccttcttttcctcaggctcctctccatttccacccctgtaattctttcattcaggaacaattatgggtcagagttgtgagtgtgggatgcatgacagccccatctgtcacttgatgtcctgtcatcgtgctgggattgggctctataatttccctctccctactgttgggcatttcatctaaggtcctgagagtctcccacctctcaagtctctggtgctttctggaggattcccccaatctcctatttactcaggttgcctatttacattctttctgctggccctcagggcttcagtcctttattgcatcacccaataccagatcaggtttctctctcacccccactcccccttcttgtccactttttctctatgatttctccctccctccccatttgtaattgctttttctacttcccaggtgggattgaggcatgctcacttgggcacttcaatttgatga

SEQ ID NO: 1560 - DNA, 1000 bp, mus musculus
agacacccccaaggtccctagaagactctccacacaatcttaggaacactggtgagtggaacacaacttctgttctattccaatcatgcaggacccgagacaccattagggaagcagaaaaactggcctgaccagggtcacaaggcccttttggtcggcttcagcaccaggtcaccttgggtgctgagtccgcagacacccccaaggtccctagaggacagcttctgaggcagatcctatttcgggctccagacatctgggcaccatccctgccagaggagaggtatccacactgccctggagggctttgccagagcacctgggggagccatcttggttcacagatcccgctgagactagtctgtgcaggtgagagtgtgaactacagaagctaacagcttctgggacaggcagaagccacacagcttctgaggcagaccctgctttggctccagacattcaggtgccttccctgccaaaggagaggtgtccaccccggctgggagggctttgccagaacatctgggggcgccatcttggttcccaatccctccgagactagtctgctcaggtgagagtgtggactacagaagctaaaatcttctaggacaggtcgaagcgacacagcttctgggacaggcccagtttcaggccttcatcttctaccaggaggcaagtctgaatgccagatatctgtgcaccttccctgcaagaggagagcttgcctgcagagagtgctctaaccactgaaactcaggagagagctatcctgctgatagaggctaacagaattatgagaggaagaagctctaaccagagaaaactgtaacaactaactccagagattaccagatgtcgaaaggcaaacgtaagaatcttactaacagaaaccaagaccactcaccatcattagaacgcagcaatcccacctcacccagtcctgggcaccccaacacacccgaaaacctagacccagatttaaaagcatatctcatgatga

SEQ ID NO: 1561 - DNA, 1200 bp, mus musculus
atctatctatctatctatctatctatctatctatctatctatttacactgaagatatattcccctctcggtactaactcccaactatttcacatctcatacctcctccctgtccccctatctccatgaggatatccccaccacccacaacccatgacccaacccccaccccaaaagacctctgaactccctgggacctccagtcccttgagggttagatatatcttctctgactgaacccagatccagcagtcctctgatgtatatgtgctgggggcctcctaaaacctggcacatgcttcctggttggtattatagtgtctgagaggtttcaggggtccaggttaatagagactgctagtccacctacagggttgtcctccccctcaacttctttcagctttttcctaattcaaccacagggatcagcagtttttgtccattagttgggtgcaaatatttgcatctgactctttcaactgcttgttgggtctttcagagggcattcatgataggtcccttttgtgagcactttatagcctcagtaattgtgtcaggccttggggcctccccttgagctggatcccactttggccctgtcacttgaccttctttgcctcaggcttctctctatttccatcctcacaattctttcaaacaggaacaattatgggtcagagttttgactgtgtgatggcaaccccatctctcacttgatgccctgtctttctgctgaaggtggcctctacaatttccctctccccactgtagggcaattcaactcccaggtctctggtacactctggatggtccccctaatctcccacctccctaggttgcctgttccattctttctgctgaccctcagggcttcagtcctttgcccccacccaataccagatcatattccctgtccaccttccctggtaaagctctttccttaagtagttaaatcagtttatttggatggctagagatttaaataataattcagtttaaagagcatcatggagactggcaactacagaatgaactgatcacataattctgtgaaacatgaaataacaaaagcataatctttcacatgtcagttggagccacagagaaaaacagaacaagcaacaaaatagccatgttcctgtgttatcatttcaagcttgagttatttacatattagtgcaaattcacagcctcaaggcat

SEQ ID NO: 1562 - DNA, 1000 bp, mus musculus
taatggcaagaagccttttatactgcctttggctacagtggctttatgagttaaacgtttgagtagcactgttaacttggaccaccctggtgatagcagctaacatgagtgcttgtttgtctttgatgaagcttggctgtaactactcagcgtgtactagattcacatgtgctacatgcctttcggtcctgaccaaaactagtgttcaaactgcagaggtgtgcaggaaagcccagtgccctttcttcctgctgttctcagtgcactagctacatgggttgtcactggcaacagaaaactcacagcgacctttaaactagagctagtggacatcaccgcggctggcagtgtgagaaaggggctcgtttggttttggtgatggattttcctaatgcatctcagcccagccggttccgcttccttctctcgggacttagagtccctggactcagcgccttagcatttggttctttactgtgggcatacacatcctttatatgaaacttcgtgtgtggtcataattttatcaagtttcttcatgggagagcggggaatggaggttgtaaggaaaaaggagtttgctgagtgtaatctgacagtatcacgcttgtccatgttctcttgtccttgttagttttgattatgaagatgccggttaccagactgcagaactcgttaaaatggatattctgctgaatggaaatatggtggaagagcttgtaactgtggtccataggtaagccaaggaagagatgaccagctgtgaacacaggcgcttggtgcttttctgtagtgctagtccctcacttagtgcagcagatacactttgtaaaacttgtaaagcttggaaagataattaaaatggactttagtctactcatcttccttctgcctttacatcagaagaatttgacttttattgatgaaaatagagttatgcttaaatatctcttccttttggatgaaattttggtagatttttatgactctgaatcagtct

SEQ ID NO: 1563 - DNA, 1000 bp, mus musculus
actcatagttgtaataatttaaaactttaaattcaatgtccaacactcccagacaactagaaattaagaagactgtctctttaaaaataggcaagccccaaaactccataaaatttctctcacattcatgaataaatcaaactatgcatgcataggcgaatgtctaatgagcacataggagcaaatcagtttgcactctaaagtgctaagctgcgaagatttcctgcacaccataatgttgtcagaattgacatttaaatctttctaatggggatacttaattgaaagctcagaaggactatgacatggaaataatggtagtatcctcaggactaaacgttcatcctaagatgaaggccaaagtaagtccctgtctagaaaattatagaatgaaaaccacacaagttcaagacaatttaaccattctttcctagaaggagatgcacaggtcttggaaggttactgaaacttgttaatgtcaggaagcttggaaggtacaagactcttaaggctcctcctcaaggtcttgaaagatgcagtgagtgtacagcggctgagatgagtcagactgagaacagcttcagagatgtacagagaactagcggatgcagacttcattgtttaccaccaatgttggagtgggctcttgctgaggcagttacctttgagtgacccatacttctgaaaggaaacttccaacaacagtgtagaaaacggctcaagtaaattcaccggttcactaagctagacctgggtagaggtgttggttaagtttctaaccagtgtgctgtctggaatgaatgggcatttgcttaaatccccccaggaaaacactaacctgcaaaaggatgctatggcccataattgtacatgattgacagtgtgtgaatgttaacaaagtactatcgttgtgaaatgaataaaggaaaactggactcacagataaaagcaaaagtaggtaacaggaaaaaacatgcttaagacgactcgaatgttagta

SEQ ID NO: 1564 - DNA, 1000 bp, mus musculus
aaagtccttcttgatgtcctctaccatcatcatgagatatgcttttaaaactggatctagcttttcgggtgttttggggtgccctggactgggcaaggtgggtgtgctgagttctgatgatggtgagttgtcttggtctcttttagtaagattcttacatttgccttttgccatctggtaatctctggagttatttgactttagttgtctctgattctctcttcattctgttagcctctatcagcagacctgggagactagatcaattctctgagtttcagggttcagagcactctctgcagacaagctctcctcttacagggaaggtgtacagatatctggtgttctgacctccctcctggccgaagatgaaggcccaaaacaggacctgtcccagaagctgtgttgcttctgcctgtcacagaagctgttagtgtctgtagtccacactctcacctgcccagactagtcttggagggatcctggaatcaagatggctcccccaggtgctcctgcatagctctcccggctgggcagacacctctcctctggcagggaaggtgcctggatgtctggagcctgaaaagggggctgtctcagaagctctgtggctctggcctgtcccagaagctgttagcttctgtagtccacactctcacctgtgcagactagtcatggtggagtcctggaatcctagatatttcttcatttacaattcaaatgctattccttttcctagtttcctgtccaaaaatccccaataccctccctcctcaccctgctccccagcccattcactcctgcttcctggccctggcattcccctatactggggcatataatctttgtaaaaccaatggttttgacattacacaataacacataagttgcctaaaataagactatatttttccagaaaagaaaggtttattgttggattctttaagtatgtatatatctacattgacatttctagttcactcgatggcacatacaaaaa

SEQ ID NO: 1565 - DNA, 1400 bp, mus musculus
agtgggatatttttgagccagtggacactgtattttccaattcactaaattgaacctagaatgaatgatactagatacttttctttcttctctttctttggcacagggcatccagtactacaaaggtaaatgcattataataaacatttgtactatatagttcagtatgatttgaagttgaacataccttaaacttccttcagttgttcatcagtaaatactggggtttcataaagacacaagacaaggcaatatacatcttttagaattatctaccatgtacatttggcaaaatctttatttgcattttattacatatgaagagaatgtgattttgtgttataaaaagaaaagaaattaaggtttttgtctgtcctacacaaaactaatttgttgagttgctttaaagaccctgttatatgacacagtagagcagctggtttatagtctgagactaaaagaaataatcagaagaaaatataaggaggacattgtgagttttgcagctgttttggggcattgttaactctcttgagaaatatagagtcacctgtccctgaagatagtcatgaatccacaaagatatgtgcttgttgtacattcaaaactcctctaaagtacaaagattgtgtgtctgtgatggtaattatcatctcacaggagtataattagcatcttctaaaagacatagagtggtccccctgtgttattccagatacatattactgcaattgcctggagaaatgtgaagcaatccaccagaattactctcaatgaggctgaaagaaaacagtctcatatgtgcctggagaacactgaaactgaggggaatatgataaagctcaaaactaggtttgatcctttgaagacccgagatcctaacaaatgtcagactataggccacctgcatcagaactctgggggttcagagtaacacagctgctcactgtgaaatcatgagtcaacaccagtccctgcaccaagggctcaggagcgataattaattgtatcttcatgatttatttttctttcattgtgctgtcatcatatttagaaaccaactactcaaaataacaaagctatcatcagatcaaactcagagtcctgatgtgtatcattattgatatgactaactttccttgtttaggcttccaaaaatcactctgaaatgatcccacacattagagtaaatgagtaactgagatatcttctttaaacttacaggaatgttcatgaagtgttttaggggaaaaaataataactgtcaagtttaaagatgtagatcctaaagttgaattgggtttgactcacccagactttagataggggttgatttagaggttgactagatggaatcgtggtacatagtatgaattattatagcagtgagaaaacagaaa

SEQ ID NO: 1566 - DNA, 1200 bp, mus musculus
tcagaactaagagcaaatttgaaatatgcagtaacctttgcattattgcttgaagaatcaacctttgacataattaagagaacatgggggttaagcagaaagtaaataagagatacacagtttgtttcaaattctgataattgtcccaaaaataaatagagaaaacatctactttttcaaaacagttaaacaattcacaagtcttgcatcagatactttgctcacttgtttaaaaaatacaatacctacattaaaagtagcaattcagtgtgcatactgttgtacataatttttaggtttagtaataacgttctttttattggatattttatttatttacatttcaaatgttatcattttctcaatttctgcccccccccaagaagcccactacccatcccccttcctcctgattctatgagggtgtgccccacccacacacttctgcctccccatcctcccatttccctgcactggggaatccagtcttcataggaccaagggcctcttctcccactgatgcctggcaaggccttcctctgcaacatatatgactggagtcatgggtccctccataagttctccttggttggtgatttagaccctgggagctctggggttacctgttggttcatattgtttttcctcctatgtggttgcaaaccccttcagcaaattgggtcctttatctagctccttctttgaggaccccatgctcactccaatggttggctgtgaacatctgtatctgtatttgtcagactctggtagagcctctcaggagacaactgtatcaggctcctgtcagcaagctcttgtttgcatccccaaaagtgtctgggtttggtgagtgtatagggactgaatcgctaggtggggcagtctctgggtgggtatgccatttagtctctgctccacactttgtatttactcctgtgagtattttgttaccccttctaagaaggactgaaacacccacactttgttcttctttcttcttgaggttcatgtggtctgtgaattgtagctttctagtagagactgaagaatacaagggaggatgagttacaaatattaaccatcaaacagtatttaaatgcacttggcattcatgaaagcaaccccttttgaatattactatgaacagtttggctcagtacagtaaatatacagcaaaaatgtacacattcttcataattt

SEQ ID NO: 1567 - DNA, 1200 bp, mus musculus
ttcagtaatggccattttctactcaaatatttaaaggcaatgttcactaatatgaaatttagttaatctaaaaatatgttaaattaatcttacttgagttaaatccctctactcaagatttttttaatagaatagctattagaatatctaaaatttcagtggacaaaggggaaaattcttcaactaaccaaaatagccaacttttgatgtccaaactacagagtcatttgaatgtataatgaataattttttaaaagccatcaactggaaatgcaagtatgtttgagtaagtaagggaaatttttcctttcaatgtgttcccatatcctgatagctttgatcagtgagaaagtggatggttctttttgattgaaggctgcattcttgccaatggttcagcatcagctgaagaatggacagtcctttacaccaaggtttccctctcagtaaacgtagctaatgtaaatatattttgactaagtatgacctactttgattatgtgtgaacatagcattaagtggggtcaatacaatttaaattaacaaccattaatttaataaacaacaaattagaaataggcatttatatctagatttatgtaacctgtatgtatgtctataccttgatacacacttctcaaaggtctgtgcttatttttatccttgccacattttctcaagtaggaagccccagttatagttatctcacggtggtacttgttttggggttgaagtgtcacaatagacattaagatgtctagcatttgttaaactggaaattggaaccattttcttcaaactatattctcacacacacacatacacacacacaaattcagctcttcagaatcctgccagatgaagggcagactcagttggcattgtgttcctgattgcagttgtttattttattgtaggatggtatgcacattgccactttaaaatgacagaaaacacaacttagttactaatgtcattccaaatggcccagctttgttagcaaatgtaaagctggaatcttcttgtgttgcattcagatgggtgagggcgacataactgttcaaaataatgttctgggataaaatggagcttatagagaaaactacttaggatgcagttcaagggcacataaaggttactatgctgttttgtctacaagaataaaatgctgctatgcaccttctgcttctcagtttaaat

SEQ ID NO: 1568 - DNA, 1000 bp, mus musculus
aacttgtaaacaatgcccatgtttttattgatatgggagtctagtaattcaaatattcatgctttcatggataatactttagttaagttctaaactctcacctaaaatgtatagttaagtatttaatctgttaaaagttaaagtcaaataactgttttcagttgtctattatgcttcttcaatgacctagtcatggttacctgaaaattttctacatttctgaatgtctcttgcaaaataacatactcataattcacaatcattttttacacaaaataaactgtatcattattttgtttttgctttgattttgaaataaactaaaagccctgagactgtgtgttggctccagagtaaaagcatttgtgtaaaggccaaagttcaatccacaaagctcttggaaagaagaaaatcaatgtgcaaaaggctttctctgatctccaaactcatgccctgtcacatacatctagtcatgtgtcccatacacacaaatgtacatacacacacaaacagacacttacatatgtacacacatacagaaacacaaacccccacatagacacacacagagaagcaaacatatacaaacacacacacaaacagatacgcaaaacacacagacacagaaatttcacatacacaaaactaccacacacacattcacatgcacataaacaaacacaaatgttcaaacacacagagtagcaagggatgaaattgacatatttgagagtataatataattctttcatttccccttccctttccttaatccaaaccctgccatgtacccacccaacccacactgatctctttgaaatacatgcaatatcaccagcatggcttcctaagcttgaggtgtgtgtgtgtgtgtgtatgtgtgtgtgtgtatgtgtgtgtgtgtgtgtgtgtgtgtgtgtgtgtgtgtgtgtgtgtgtatttcagggttaagaaaaatgatgaatcttggaagtgaaactattttcaaagttaaactaaa

SEQ ID NO: 1569 - DNA, 1200 bp, mus musculus
actgcaaagctatcaagcatcatttttacatgattgtatgatacatgattagctgctaaagaaattaatcttagaaccacagagatagctttaaatcagtaatatccttactttcaaactggagaatgagtttccaaacatgttaattccaaatgtacagccaatgaaattcagcaccacatgaaataatttgtggataaatgaagtccatatacacaggcatatgtagcagaaggggacttacaaaataacttattgtataaattatctcttcttaagcgacactgttgctgatgccaagacatgcttgctgacagaagtctgataaggctgtctcctgagagactgccagagcctgaccaatacagatgtggatgcttgcagccaaccatcgagctgggcaaccaatggagaagttagggaaaggactgtaggagctgaagaggtttgtaaccccataggaagaacaacaatatcaaccaaccatacacccctgagctcccagggattgaaccaccaaccaaaacgtacacatggagggacacatggctccagctgcatatgtagcggaggaaggccttttcaagcatcaatgggaggggaggccccttggtcctgtgaaggattgatggctcggtgtaggggaatgctagggcagtgtggtgagagtgagtgggtggatgggggagcagcctcatagaagcagggggaggggatgggatagggcgctgtggaggggaaactggtaaaggggataacacttgaaatgtaaatgaataaaataatcaataaaaatacatgaaaaaggaataacatcttgcaatatccccaggttggccttgagcttactctataactgaagctagcctttgaacttagatgctcctgacttacccttcacagtgctggtgtgacgagcagatgccacaacacagtgtgtacacaacctctatcctttaaatccattacaatttaaacactgaaacatagtaagttgttcagaaatcacaggttgaattatcatgctaccaaaatgtggtccaaatctactctatctacagttaaatagcatattaagtaggtgtaacaaattcttgtagctccacgacaccgcatagtgcttacactatccagtgcataacccttcaacagcataagtcatttggatcttctccaggaaataatttcacttgtcctagg

SEQ ID NO: 1570 - DNA, 1200 bp, mus musculus
catcaccaccaccaccaccaccaccaccaccaacaacaacaacaacaataaaacaaagcatagaaaacacctgatcgtggaagctgtagtatgtcacggtgtccccacagtatacccctctgtccacacatcttcccttgtaaatgttcattgcaatgagtcattggtctggttagagatatctgtcttttgtgacaccatcaatattggaccctcctaccaggcttcctcctggttatcctgttcttgccctgtgtcatggagatcctgcagttttggattagcaggactggccctttcacgcagcctgactgttcaaaaatgatacagattttggggtgggccaacgcagagccctggatcgggcctaggtgtttttgagctggttagcgtgttggctctcccttatctgcaccactaccagggtgagcttttcagcattgctccagctaggccacccaatgctgccctcctgctcttggggctagctcactcacacctccagaaccagctctactgtgctgcccagtcaaggcatgggagccactctcccaagtgctgcagcctgtgaggggcttctgctcttacaactccttacagctctcagactctcggggctccctcacccgtgcctttgctatcagagccagctctactgtgttgccaaggtgaggtacaggccctgttctccaactgcagctagagaaggagcagggctagctcttctgttctcaagtcctttgggagtccagctttcccatgctctcacccccaaggctagctcacctgcgccccatctaccagggccaacactgctgtgctgcccaggagagatgcagggcccactcccctgtgtgctgcagccagaaaagggcagggccatctcacctgcactcatgaccccagggccatctctcctaactgctgcaggtgacgagaggcaagtctgctttcttatagaacccagggccaccagtccagcagtgacccccactacaatgggctaggccttcccacttgaatcactaattaagaaaatgccctaaaggcttgcttgcaacccaacctcttggaagcattttcttaatttagaatcccatctctcaagtgactctagttcataccaagttgacataaaactaggcagcagagagaccatctttttgctgaatgagatgacttcttttcttttttttttca

SEQ ID NO: 1571 - DNA, 1000 bp, mus musculus
gaacgtgaaggcagagtcctcaggaatggaacagtgtcattaccagagaatcccaagggcaccaccttctgtcttcccaccatgggaggatgatgcaaataggccctcaccaaacacaggacctgccgaagcttcgatccgtgggcttccagccgttttcaaagttcatggctcatgatctcttcagctaggaccttcaacagctgtgcagttcactcaaactctcctctcaacagtctgcaaatcctgccctgcccttccctgcccgtcttcccctcctccttctgttgctgctcactgccctctctgcctcagccctactagctccctctctctcctacctgtgcctcaagacacttgcaccaagtataccagtccctaaaaatctctcccccaacttctctgtagctctcttcctcatttcaagatgttagtacagtgactttctcagtgacgtgtccccacgccatcctatacaaccatcaagttatccacctcctgggatccgtcttctttctctgctccatttttcttcatcattgatacgactgtctatcataagttaccgccctctccgggactttatttgttgtctgtctctagcaaatagagtgacgtttccatggagactgaaggttttgtgtattttagaaaagatggtagcccctaaatccattaataatagctggccttacagtaagtgctaagaaaataaaggaataaatatgttgacccccctaactcttacttgagctctctgtcccacaatcacctctgtttattactataaccttgttcttcataacccactccacagtgcaccatcttggcagctggcatggcatgtgaagaacgttgagcctgggaaagcacagtctgtcttcggagaccttctgggacaacagaggtcactccttagctgctttgtatccaactgtttcctgtcatcattcatacatttggaacagatattggcaaagcaaaggttgacttgggctgt

SEQ ID NO: 1572 - DNA, 1000 bp, mus musculus
ttaggctgactgtccagcttgtttgtccagaaatggttagcttcaggttcattgaaagaactttcattaataaataagacatgtaataactttattcttttcggtataaatagatacaatataaatgaaatgcactatcttatcttcataagataatgcagggctttgggtgtgtgggaaagaggggagtgggagagtgcccatgtccagccagagttccggtgctcttggtgggcagatacagtaggattgagcatgctttccacatggtcccgggtgggcatctggctgtgttaagccactgaccctacactgcaggtcgtggacaagaggcagaccccggtaccaggttctcagctaaaggcatcccacactggatactgcagaggagctgagaacagaatagagaacttggttatgggaggaaggcaggagaggtcagggggagagaggggcacaggcaagagtccttagtccagtccatggctacagcataggaaggctttgtggtgggaggttagacttggcttgttaggagaaagcctattccatctttcaagcatggcaggccttcatgatcagagacagtctatgcttttagagctttattgtagaaagccagggggaaagagagaaggtagaaagagagaggaagaggctggccatggccacgtggagagagggggagggaaagagagaaagagagctagagagaaagaaaggtaaaagcttagagagcaaggtggggccaagcagcccctcttatagtaggctgggatattaggctgttgccaggtaactatggggaggagtctagtcagaatgccagaaacttgggaccttatctagccacatgcctctcctgtgggggctgtggaagtggtaacttcaacaggagccaggggttcaggagacttgttcaaatgccttcagtcccatgtaggtggaaattaccacctactgggtcccactggggttcaagacctaagctcaactggag

SEQ ID NO: 1573 - DNA, 1200 bp, mus musculus
tctagtatctattgagaagtcaagtatttttctaataggcctgcctttatatactttttatacttgatgttgttctctcgcagtctttaatatttttctttgacttgggtgtttactgttttgattgatatatagcaagggaactttcaattcttctccagtctatttgatgctgtatttccttcctatacaactaaaacattttgaccaaaatttcaattcattgtggtcttgctgaggctttcatcctcagtgataataacacgattttcactgttcaacattaccctcattagaatcaaaagagacagagttttctccaagtaaaagataaaatgtagaccccagtacatgatacaaactgtgtcctctggattgggatcctgttaatgaaccaatttcacaaacgagcagccggctgttaagtttctccttttgagctttacagatgtgttctcttctgagacaagctatttttaaaacccgtaagatagaacatggacccaggcaaacaatgccatgtaccttgtatctctttggctctcttacctagtgaagaagatcccctagaacacttggattgcaattgcaatcaagggatatgaaatttggctaggcactccttggagtgagacatctctggtaatactgcccatggctagatgctaggatcatgcttcctgtatcacttttgcttgtgctgcccccatttgggctgtctctctcaggaccgagtgctgtcctatgactgagaaagagtcattttaaagttatgccaatgtaatatatactacaagcattgtaataagacaatgaccatttcactacttacaattgcttgccactcacaaagtaaatattactatttctagtggaccccactgggtatattaaccacacttaaagttctttctgaccaagtatggtttatctatggtatatggccagcaaaaaatgaactcagtggtgttttggagatctattgtctgataatgttacttgattgtactggtcttttgtttatattatatggtttctgattttgtgtttgtattgagtattgcgtgtgtgtgtgtgtgtgtgtgtgtgtgtgtgtgtgtattttcccatgtatatgtttcacttactttgttgttatatcatatttaattattttatcttgtttttattgtggcttgtttaatttttgccagtttattt

SEQ ID NO: 1574 - DNA, 1000 bp, mus musculus
ctctctctctctctctctctctctctttaatattttgtccctccaactgttccccatcccatacctcctctctgtccccctgtctccaaaaggatgtccccacccccacctctaaacttcctgggggcctccagactcttgagggttaggtgcatcatctctgaatgaacacagacccggaagtcctatgctgtatgtgtgttgagagcctaagaacacccggtgtatgctgcctggttggtggtccagtatctgagagatctcaggggtccaggttaattgagactgatgttcttcctacagggtcgcccccctcctcagcttcttccagctttctcctaattcaaccacaggggtcagcagtttctgtccattggttgggtacaaatatctgcatctgactctttctgctgcttgtcaggtcttttagagggcagtcatgataggtctctttctgccactgctctatagcctcaggcctttgtgtctccactagagctgaatgccactttgagcctgtcactggagcatcttttcctcaggcccctcttcatttccatccctacagttctttcagacaggaacaattatggttcatagttttgactgtgggatggcaacccaatccctgacttgatgccctgtctttctgctggaggtggcctctacaagttccctctccccagaatagggcatttcatctgaggtctctctctttgagttttgagagtctctcacttcccaggtctctggtacattctgaagagtcccccaacctcctacctcccgaggttgcatgtttcctttctttctgctggccctcaggagtttcagtaccccccccccccacacacacacacatactcaatattccatcatgttcccctctctgcccacaccccatccctctttcctcccaggtccctccctccctcttttctgtatcttaatgcagacattatggaagtgattcacactaaaagctcattaaatagatatc

SEQ ID NO: 1575 - DNA, 1400 bp, mus musculus
ccccacctgggagtccatcccataatcagccaccaaacacagacactattgcatatgccagcaagattttgctgaaaggaccttgatatagctgtctcttgtgaggctatgccagtggctggcaaatacagaagttgatgctcacagtcatctataggatggaacacagggcccccaatggaggagctagagaaagtactcaaggagctaaagggatctgcaaccatataggtggaacaacattatgaactaaccagtacccccagagcttgtgtctctagctgcatatgtagcagaggatggcctagtcggccatcagtggaaagagaggcccgttggtcttgcaaaatttatatgcctcagtacgggggaacaccagggccaagaagtgggagtgggtgggtagggaagcagggcagggggcgggggtattttttggagtagcatttgaaatgtaaatgaagaaaatatctaataaaaaattaaaaaaaaaaaagaagaagtgcaacaggaggaacattcactttttgttgcctgacaaaaacttcatggaggaaatagaattgtagaaggaaaaaccaaaaaaaaaaaagaaagaaagaaagaaaaagaaagaaaaaagagaagaagaaaagaaaaagggaaagaaaagaaaagaaaaggaaaagaaaagaaaagaaaagaaaagaaaagaaaagaaaagaaaagaaaagaaaagaaaaaggagtgtacctgaagggatccatggctccaaatacatatgtagcagagaatggtcttgcctgacagcaatgggatgggaggcccttggtcctgggaaggtttgatgccccagtgtaggaggatgctggagcagtggggtgggagaggatgagtgggtgggatagggtctcaaataggaaaagaggagggtgacaatggatgtggtataggggtaagtgagaagcagaatatcatttcagatgtaaacaagtggaatgattaataaaaaaatgaaagaaaaggatagaaaaaaagtagtgtgggtaaacaaaacatttttgaactcatattttctctttttcatggtgcatgtctggttatggctgcacaaatgaatattcatgtgggagtgaataaatgtaatatcagacatcttccaccactattatctactttttgagacactgtctctcactgaaatcagagtattttggcttaaatggctgaccagtaatatcatagagccatctgtctcttccttccaacagtctgccattacaggtgctcactccgaagtctggctttcactcctgtgctgggaatctgaactaactcctcacacttgaacacgaggcacttcaaccaatgaaccatctctcaaccctgtacatttccatcaaccaccaccaccaccacca

SEQ ID NO: 1576 - DNA, 1200 bp, mus musculus
ttcctctgccatatgtttattcagaaagagtagcattcttactgtcttatgtgaaacttgaatatctactttgtgtcacaaactttaaaaaaagtaattttcccatttttcatttatttacttacactgcattttttattccctccccctgccactctccaacttttccacctcttatacctcctccccagccccctgatcacatggatttctccacctcccaccccacctgacctctaaataccctagggcccccagtctcttgagggttaggtgcatcatctctgaatgaacacagatccggcagtcctctactgtatgtgtgttggggacttcatatcagctggtgtatgctgcctgcttggtggttcagtatttgagaggtatcaggggtacagattaattgagactgctggtccttctaccgggtcatccttctcctcagcttctttcatccttccctagttcaacaacaggagtcagctgcttctgtccattggttgtgtacaaatatctgcatctgactcttttagttgcttgttgggtcttccagagtgtggtcatgctaggtccctttttgtgagtgctccatagcctctgtaatagtgtcagtccatgtgaccttcccttgagctggatcccactttgggcctgtcgctggaccttcttttcctcaagcttctttccatttccttccctgtagttctttcagacaggaacaattatgggtgagaggtgtgactgtgggatggccccccttctcccttacttgatgtcctgtcttcctgctgggcatgggctctacaagttccctctccctactgtccgggatttcatctaaggtccctccttttgagtcccgagagtctctcacatcccaggtctctggtgcattccggagggttccctcatcttcctatctctcaaggtttcctgtttccattctttctgctggcactcggggcttcagttattttccttcacccaataccagatcaggttcccctctccccaacaagtcctttctcccctccccctccacttttcctccctccctccctccctccctccctccctccctccctccctccctccctccttgtgattgctttcttctccctcccagctatcagaagttgaaggattatggcaaaataattttttaagagtccatatacctttgcttttaacctatctaca

SEQ ID NO: 1577 - DNA, 1200 bp, mus musculus
aataacctgaaatagaagggcacacctgtgaagtatatttgattaatttacagtgggtagatctatttctatctgtatctttgatgtaagaagacacacacctgcatcttttaatttaatctacatcttttgagctggaaagattcacctttaatattagacacaccttcttctgcaagcctatataaggatttggctctttgcctcttttcttttgccttccttgctagcaagattattcctcatggactctccacttgattttaggatcactggtgagtgggacacaacatcggttccaatctaatctcaatgggcctgagccagcagcagggaagcagaaaacccacctgaccaggggcacaagtcccttctggttgacaccagcttcaggtcaccttgggcacaaacactgggaaaggacccacagtccacagaggactctccatgtgatcttaggatcactggtgagtggaatacaacatctgttccaaaccaactgtgacaagcctgtggcagcaggagcaaggacacgggagccctgcctgaccagtagctcgggttccttctgatctgtactggtacaccttgatttcaaacacaacaaacagccccacggacctcaggggagacaccacttccaggtgctgtaacacacccaagatcttaggattccaggataacagaagcttggtcacaccaggatctcagagtctctgaggaagcttgactgccaagaacactgacacatccagaatctcagatcaacaggagcctggaatcacaggatcacagagaaatttggactctgaggaattctgagtcaaccaggattataggaagaacaggctccaaacagatataccgagggcagcaagcacttgagataatcagaggccaggagccaagctttaaaagaaaagcaacagaaaccaagattacttggcatccagaaccaaactctcccaccatagcaagtcctggacacaccatcacaccagaaaagcaagacatggatctaaagtcccttttcatgatgatgatggaggcctttaagaaggaaatacaggaaaacacaggtaaacagctagaagaccttaaagaggaaacaccaaaaaatcccttaaagagttacaggaaaacagtaccaaacaggagaaagaattgaacaaaaccatccaggatctaaaaagggaagta

SEQ ID NO: 1578 - DNA, 1200 bp, mus musculus
tgattttgttcatttccatcacctgtttggatgtgttttcctgttcctctttaaggacttgcaactctttagaagtgttctcctgtatttctttaagtgagtcattaaagtccttcttgatgtcttctaccatcatcatgaggaatgcctttaaatccgaatctacgttttcgggtgtgttggggtgcccaggactggctgaggtgagagtgctgggttctgatgatggtgagtggtcttggtttctcttagtaagattcttatgtctgcctttcaccatctggtaatctctgtagtcagttgttgtagttgtctctggttagagcttgttgttcctctcatggttctgttattctctaccagcatacctgggagacacgctctctcctgagtttcagtggtcagagaactctctgcacacaggctctcctctttcagtgaaggtacacagatatctggtgtgcggacatgcctcctggcagaagatgaaggccagaaacaggacctgtcccagaagctgttagcttctgtagtccaacttgtacctgttcagactagtctcagcgtggtccagggaccagcatggctccctcaggtactcctgcaaagccctcctgggcagggcagatacctctcctctggcagggaaggtgcccggatatttggagcccaaaaaggggtctgcctcagaagctctgtggctcctgcctgtcccagaagctcttagcttctataatccacactctcacctgagccgactagtcttggtggaatccaggaaccaagatgtctcctgcagatgctctggcaactctctcccgggctaggcggaaacctctcctctggcagggaaggtgcccggatgtctgtgcagaccagtgtaggtggaatccgggaaccaagatgtctcctatttcaatattcttgtttagtaatttgtagtgtgattttgtgcacatcttgtttttttttttttttatcatgatgcaagaaccaagtttttgttcctggaaacttgaactttaaatcctgttcacattatgtagaaaacaaacccaaacccaaagacaggtgaatttaacaatcaatacatttgtagggaaaaagtgaaaaataatgcaaatatattacaggtacaaaatcatgatctgacatgtatgatatactaaattcagtagagtgccacattgcttctttaaa

SEQ ID NO: 1579 - DNA, 1600 bp, mus musculus
ctatgtctgttagcttctttatttatcagtttagtttttgtctatattacctgtcaattggtgagagtaaggtgttgaagtctttccctattactgtttgggcttcaatgtgctatttaagctttagaaatgtttgttttacaaagggggggtgtcattgtgttttgagtatagatgttcagaattagaaatttactaatagtcatatttgcaaaatgttgtttctttaaaatgaatttgatcattgtggccagttattttatcattattatatttcctccatactagctatatttcccagtagctttgacttattctgtgtagcagtgttcaaattattaccttaaatatcaaattgatttatgtacttttaataaattgtttagttttaatataattttttcaacgaaacaaccacttttcctctgtattcttactgtttcccatagctcttctgagtagcattttacattactttctgtatcattctgaatattatttatattattatacatcttctagtttgctgatagtttttgaaaaaaatatttctcagttttcaacatgcctatctttttaaaaaattaggtattttcttcatttacatttccaatgctatcccaaaagtcccccatgccctattcacctattcccacttcttggccctggcattcccctgtactgaggcataaagtttgcaagaccaataggcctctctttccactgatggctgactaggccatcttctgctacaaatacagaagtagatgctcatagtcacctattggatggaacacatggcccccaatggagtagctagagaaagtacccaaggagctgaaggggtctgcaaccctataggtagaacaacaatatgaactaaccagtactcccagagctcgtgtctttagcaacatatgttggcaagttcttgttggcatcgaaaatagtgtctgggtttggtggttgtttatgggatggatcccaaggtggggcagtctcaggatggttattccttcagtctctgctctgaactttgtctctgtaagcccttccatgggtgttttgttctcttcttctaagaatgatcaaagtgttttcactttggttttcctttttcttgagtttcatgtgttttgcaagttgtatcttggatattctgagctactgggctaatatccacttatctgtgtgttcttttgtgattgggttatctcactgaggatgttacccctccagatctatccatttgtctaggaatttcatgaattctttgtttttaatagctgggtaaatgtaaatgtaccattgtgtaaatgtaccacattttctgtatccattcctctcttgaggggcatctgggttctttcaagcttcttgctattataaataactctgctatgaacatcgtggaacatgcttgcttactaaggcattataagagactatactaaatcatcttttaaggtcatgtttttatgaaaagtttgtattcctaagaaattttaaattatgtttctttttatcttggttataagaaatctagggcctttgtttagtcaaaattttataattaattttgtactatgtaatgactttg

SEQ ID NO: 1580 - DNA, 1000 bp, mus musculus
caattttcaagagagttatttactattcttagtctctgcttagatcagacttgttgagatggacaactgccaatgacctggaactcactctgtagaccaggctggtctctaattcagaaatctgcctgcctctgcctcccgagtgctgggattaaaggagagtgccaccactgaccagcataatgtgttttttgaatgggaatatgagattagtcagtgaccagaactttaaagaaaacgttctaattagtattggagagtgctagatggactcagaaagtgatatgaaagcaggaagaaagggtacttctttaaatatggggcagtcaagccagatgaaggcatttctgacacagatgatgcagcaaggaagctctaaaatctgagccatctcaatcctctactgttgctgctttagtctgttttcttacactgcattctgctctctaaatattgttttccaaggtattgaatatttcgactacagagcaatttctaacatgaatactttttaaaatatacattgttaaaatattctgagtagagctaattgccaaatttattaaggagaatttttttgtgctccaaaatagtgtaaaataaagtcgtatcattaccatcttaatacaaagagtaaaaaggaaaatccagagatatgagagacacaatgatttgtcatcttcatatgaagatgaagacactgaggtaaccaaatgttgtattatttattattcctcattatacgttatgattattatatttttccttgtttccaatgaatttttgtagaaaaaatcctacactgtattttatcatagttttctctactcaaattccttttaatcccttcccacgcccctactcacccatctccttgtgtattctttatctttagcaatcaaacaaagaggaacaaaccatgattgaaagaaaaaagaaaaacaaggaacatagagacgtacacacaaaaaaggtaaaacacaaaaattagaaataatat

SEQ ID NO: 1581 - DNA, 1000 bp, mus musculus
gggccctgtgatccatccaatagttgactatgagcatccacttctgtgtttgcttggccccggttagtctcataagagacagctatatcacggtctttgcaacgtgagttattaaagaccttcttgatgtcttctaccatcatcatgagatatgcctttaaatccgggtcttggtttttgggtgtgttggggtgccctaaactggttgaggtgtgagtgctgggatctgatgattgtgagtggtctttgtttttgttagtaagtttcttatgcctgcccttcgccatctggtaatctctggagtcatttgttatagttgtctctggttagagcttgttcctctagtgattctgttattctctaccagcagacctgggagactagctctctcctgactttcagtggtcagagcactctctacaggcaagctctcctctttcagggaagttgcacagatatctggcattcaaacttgcctcctggcagaagatgaaggcccaaaacaggacctgtcacagaaactgttagctcatgtagttcacactctcacctttgcaaactagtctctgtggagtctgggtaccaagatgtctcccacagatgttccagcaaagtgctcctgggtcaggcggacacctcttctctggcagggaaggtgcctggatatctggaacccgaaaaaagagctgcctcagaagctctgtggctcctgcctttcccagaagctgttagcttctgtagtccacactctcactggtgcagactagtcttggtggagtctgggaaccaagatgtctcctgcagttgctttggcaatttcctccagggccgggcagacatctctcttctggcagggaaggtataattccagtgctggaaacagaagcagaggcagaggcagggcaggtagatccctgcagctcactggtcagccagcctaacgaaatatgtgtgttccagttcagcaggaggctatgtttcaaaagagcagtcattgttt

SEQ ID NO: 1582 - DNA, 1000 bp, mus musculus
gtgggtatcctggcatttggagcaaagatgttcagaattgagaattcttcttggtagattttttttttcctttgatgagaatgaagtgtcctttcttatattttttgataacttttgttgaaagccgattttattcaactttagaatggctactccagcttgtttcttgggaccatttgcttggaaaattgttttccagacccttactctgaagttgtgtctgtctttgactctgaggtgtgtattctgtatggaacaatattctgggtcctgtttacatatcctgtcttttattctatgtctttttattggggaattgagtctattgatgttaagagatattaagtagagattgatccagagctagggcggtcctgacccacaccttcatgcaggggagggtctctcattcagcctgtgtcctgtttgcctagcttcctgacacccccaacctctgagcaggggcttgctcaagactagtttcctggctttgactcaggaggccctttcctcactgggccccatgtgtgatcagcagtgcattaaagatatgaggcagggacctaagccacagcagcagcggtcgccatcttggtccgagacccgccgaacttaggaaattagtctgaacaggtgagagggtgcgccagagaacctgacagcttctggaacaggcggaagcacagaggcgctgaggcagcaccctttgtgggccggggacagccagccaccgtccggaccggaggacaggtgcccgtccggctggggaggcggcctaagccacagcagcagcggtcgccatcctggtccgagacccgccgaacttaggaaattagtctgaacaggtgagagggtgcgccagagaacctgacagcttctggaacaggcagaagcacagaggcgctgaggcagcacccagtgtgggccggggacagccggccaccttccggaccggaggacaggtgcccacccggcaggggaggcggcctaagccacagca

SEQ ID NO: 1583 - DNA, 1000 bp, mus musculus
atcctcaaacaagtacttaaagaagagaaaggtctttgaaccttgtgttaattcttaattttcaaagccgaactacacggggcaatcttagtgttatggaatttgtatgatcagcaacaggacaccaactgcaggtccttcgctatgtcaccgtgagcgaggaccgcacccacttgcacatttgagaattggctgcagatagtattagtgttgaaaacatggatatttgtaggcttcaaatttctaaattgttagtttctctcggggggaaaaagtgtttcatttggtcttaactcttttaagactcattttgcctcagctcagtgcttttcccatcaaacttattaatatcttatagaatggtgacgggagggacccgtgtgatcatcgtcagctttttcccctggttgcccatccttttccttaacaatactatgtaggactccccattgatagcagctatcccagggacaattactttggggaagacattttggggcaaatacatgatatactactgttcaggctccacttcaccatccttagctgtgtgatcacaacgggtggattctgatgggtaaggtgaggcaagaaagaaaggcctgcctggagggaagagatctcagactgcagtgagcacagcaaggacagaccagagagaagcagcatcaacgaggcagctcattttaatgggggaaaaaaagggtatttaaaccattggggagcagtgattggggggctgtggggtgagtgtggtcaggcaaggtactggagatatttcatacaagcccagggataagatcttactcctgctgatctcataacgaggtttccagaatttggacatactcttctcttgctcccggactgagattcccagtcccaaggcaccccagccccacacatccatcctaaggcatagattgtgatgcatggctgcagtgtatactaacaactctggaatagtcattagcaattcataggcttagcgcatgctgtg

SEQ ID NO: 1584 - DNA, 1000 bp, mus musculus
gttaaagaagaaggaaggtccacatgaggatgcttaaatccaacttagacaggaaacaggaggagggaagcaactggagaggagagggagtggagagaataaaggagggcaggatcaggtagtaggggagacaggagagaggctcggatggccaggagaatgtagtgaatggaaatttgcagctagctgagaagggagttgggagtgatctctagaaaattccggagacctgagattagggaggctcccagaacttagctgcaagacctaacagtggggatatggaacttaaagagaacacctccagtagtcagacaggatccttagtggagggacagagaggacatcccacctacaaaacgttggaaccccaaattggtcctgcataaagaaatgcagggaaaaaataaagccaagactgaagtaatggtaaatcagtggcggtgccaacttgggatccatcccaagtaccaaaccttgacattattactaatgctatcttgtgcttgcagatagcagcctagtatggctgtcccctgaaaccctgaaagtctctaccagcaggtgactgagacagatgaagatacttacagccaagcattggctgcgtttgggcaggaatccatatggaagagataggggaaggattgaaagaactgaagaagatggcaatcctataagaagcccaacagtgccaactaacttgtactcttggaagtttccagagattgagtcacaaacaaaagagcatacatgtgctggtctgagaccctggcatatatatatcagaaagcttccttctttcatcttaataagagaagatgtgcctaatcctgtagagacctgatgccccagggtaaaggagataggggatgcacccatcagaggtgaaggggaggggagatgagagaataaatctgtgaaaagggaccaggagaggggcaacacctgggatgtaaatcaataaaataattaataaacacctttttttcattcaaat

SEQ ID NO: 1585 - DNA, 1000 bp, mus musculus
agacttccaaacaatactttaccttcgtatcaaagtcatgttttcttgatcaatttgtttctataaaaatctctcttggtctacccttgaacctctgcaatatcaaatctctgatcacgagcaacacgtttaatgggatgtgggtggcccatccaccattgaatgccatcaaagcatttccaatcctaagaaaagcttagtcttacttcaagtatcatgtgggcaggattttatcctaataggctcttgagttcctcatctcaaccttgattggccttcactttgtcatactcaacaagtattccttatgaaggctcatgcttgctagagagactttcacagacaaggaatcgttatggttttatactaggaaacgtctaagattcagtttaaaatcttgtacaggctaaggcaagaggtgtgtctttcagatacttcttaagctacaatgatgacctaagggtttgtttggttttttttttttttcattgtatttaactctgttttagttctattgctttgattttcatatgttcagagttccatccctctggcaaccagtggagatcagtgctctgaagggatgctttaactgtcacaataagagttgtatgaccagcaaattccacttttcagtctgtgtcaattacagagatagaagacatgcagaaatcagctcttccttcctgacattcgattctgaccagatcgaaatttaacattacataaaatggtatgtcagcattatattttggggaacatgatgttaaaagtctttcaggcgtcaccattgggaggggtctaggagtacacaattttgatgtcagtactctccattctgagaaaagacattagaacatataagaataacaggtaatttttttttctttgaattcaaggagaacttggtgactcctgaaggagaggctttgactttgcagagtttaaggttagtgaacatttagtatgaaactgtatatctttacctcatcagaataac

SEQ ID NO: 1586 - DNA, 1200 bp, mus musculus
tattttgagaatattactcaaaagaaaaaatggtactctgggcaatatgagattcattgttactagacatataactgttaaatgtaggttacagatctagttagaaataaacatgcacatagagaagcacttggtatggttttcatgaaagcatataagatgagattttaggatgattatatattagaatagagttctttttaagtactgtatttttcgtgtgtgattatgaaatgaaaatgtattctaaaactaggagatacatatatattcaagttttgttacatagctgaatttaaaaagattgcacccatcacagtcacaacagttagaaaatgttgtgcaatcaatcaagcacactgtgattctgctgtgagtctgtgcaggtgagagtgtggactacagaggctaacagcttctgggacaggcagaagtgacacagcttcagaggcagacccatttcaggctccagatatctgggcaccttccctgccagaggagaggtgtctgcaccacctgggagagctttgccagagcacctgggggagccatcttggttcccagatccctccaaaactagtctgcacaggtgagagtgtggactacaaaagctaacagcttctggggcaggcagaagctttgggacatgccccatttcaggccttcatcttttgctaggaggcaggtctgaatgccagatatctgtgcaccttccctacaagaggagagcatgcctacagagagaactctaaccacagaaactcaggagacatctagtctcccaggtctgctgatagaggccaacagaatcatgagaggaacaagctctaatcagagacaactataacaaataactccatagattaccagatggtgaaaggcaaacataagatcttactaacaaaaaccaagaccaataaaacatcatcaggacccagcactcccagctcagccagtcctgggcaccccaacacacccaaaacctagacccggatttaaaagcatatctcatgatcatagtagaggacatcaagaaggactttaataactcacttaaagaaatacaggagaacaatgctaaagagttacaaatccttaaagaaaaacaggaaaacacaaccaaacaggtgatgggattgaacaaaaccatactatacctaaaaagggaagtagacacaataaagaaaacccaaagtgagg

SEQ ID NO: 1587 - DNA, 1600 bp, mus musculus
ttctttgtatcttgcaggaaattggtccgagggattcgataagactcttgaggccctgagggtggcagttttaaggatcaactcgacgtgagtggacctgtcattgacagagggcctctcctcctggatttcatctgcattttcttattttaaggaatgggtgggggtaggtttattttgtgttgccacctgctgtggacttgtgttcatgctctggttggtttgcaagttcagaacccaacaaacaaatgacaaggttgtgatagctcaagcacttgctgccattgagcaaggggcctcccccaaaatctggctatctatgctcaagaattagttaacattggtgactggcctcttttgtagagtttgccctaggtcatttagtagttactgtcacatagcactgcggtatccagggatgggcaactttcctcatgcacagatcaacctaagacacggggcccggtggcgatagggttaccctatgacgggaaaggctgtgacattggaggaatgacctaagacaggagccacagcagatggacatgattacacagacctagtccagcctcattttaataaaataaagagggggagacgtggagagccgtgcctcgagcaatcgcgagcagcaagcaatcgccattataagatggtgctggcctccactgtgcctaactagtaaacaagccttgtaagcaggtgcgagagtgaactcacgcctagtcactgcccatctcgggcatagtagtggagtgatgggcgagcaacaaatcaggagctgacacgccatatcaggtgctgaaatgccatggctgagggctatataaacgactccatattctgtggtcggggtctccctcctgaagaagcaataaagcttgccgcagaagattccagttgtcccgagtgtgttcttgccagcggggacaaaagctagggatagtatgtagtaacttctttggaaaaaaaatggagagtagcctttctgtgaagaggtgaataaggtgcctacaagaacttaaaagtgagtccttttctaatgatactaaaattgattctaatcaatggtgtgttcatatttgttaggtgtaacctacttaagcttcttgcagaaaattatgcttgtataataactattttagaatgggtgtatttttaaataataaagcacacagtgtgaacacaatgcgcaatgcatttttcttttattgcctatgatttgaaaattattccaaaacttgcttgggaaattttatctccataagttctcaaatttaaaactttgatataaaaatgtgattaaaaatgtagaatttttgttgttattgtttgaaaatagagacattctatagttggtaaagtgctttgcttgaaagcgtgggaacctcatattatttatcaaaagttatgtaaaaacaacccaaaaaacaaaaaacaaaatctaatgttatagttctctaatgtcagcgttgaggagtcatagccagatagattcttaggggatcctgactagccaattagctacttcataattctaagcaaggaagatacctttcctcaacaaattaatgaataaatgaataaatcaatcaatcaa

SEQ ID NO: 1588 - DNA, 1200 bp, mus musculus
agataaagaggaaagttataaggggaagcatgaagtccttgggaagggaaatagaataaatatagtggatagaatgggaagagtgggggcagacatagggaaagggtatgcagagaaacagctggaaatggggttcttcgtatgtaggggtgtggaaaactagggcagtgaacatttcctggagtctatgagggtgaccttagggtggacttacagtaatggaggatactgagtttgaactcaatgaccatcttttgttgccaggcaaagcttcttgtaatgggactcggtatgtttggctaaatagctggcagatgaggtccagagatctctaaacaacagaagcttttgcaaggacagaaacttaagctccattgccaaaaacaatttctactcacctcaaccaatattcagagattaaggaagtatggatttgtagcctttgcccctacattctacatggatgtacaagaaggtacactgcaagctatgaaaagagaaaccgggacatggaacaccaacccagtcacaaacattgccatctatgatctgttctgcctgcaacatgtgctttggcaacgattgttcagagcctatgggactgtccaaccaatgattggtttaactcaaggctcatgtccagagacaggacacatattctacagttcgtggataaccaaaaaccagagactggatagcctagagacctaggatagaacaaaacaagcctggcagaaaaaaaaaatccaagaaatgtttcctaatgatatgtttctgtacttattgttactttattcagttatcatcagcataacttcgtctggcagcagatggaagttcagagacccacagtaaagcattatttgaaaagagattctaaattgcatatctctatgtgatggctacccccaaagaacagagaaaccggaggaggacagcgagaaaagactgtgggagtcagggggcatggagaacaccaggagaaaaaggcctacagaccttagcagcacgcatgtggacccacagcaaccaaaatagcaagtaggttattaacctatcctctctacttctgtaatttatcatattttcaagctggagttgtactgaattgcttccttgatctattgtcactgcctttttggtttgaattgtaatttgttcacctgtccctaaataattaacataagattatattatatg

SEQ ID NO: 1589 - DNA, 1200 bp, mus musculus
aaagaaatattaattcactcataagacataaatctaacatgggtcatttctctaagtgtaagagtcatatttgctctcctaaaataatttgttgatgatacaagtagctttgaagttttgttattttacatgtatcagtactgcctactactcatgtccaattatagacaagtccaaaactacaaattatttctgaactatcacattaattgaaaaaaggtgtgtagaaatgggagatggggaactggggataaccaccagaaattccatatgctaggaaagaaagcagctcccaggacccaacagagatgacattggctgaaacaatgtctggcaacaaaaaagaggaagaatctgtagagattttatccagaggttaggcaaggccaccaactcatctccaaatttgtaacccagaattgtttctgtctaaaggaaatatggaaacaaagtgtggagcagtgactgaaggcaaggccatccaaatgaaaggttccacctggggatatatcccatatacagacaccaaacccagacattattgctgatgccaagaagtacttgctgacaggagatgatatagctgtcccctgagaggctctctgagaacctgaagaatacagaggcagatgctagtagccaaccatcagactaagcacagagaccccaatggaggagttagggaaaggactaaaggagctgaaggggtttgcaacttcataggaagaacaacaatatcaatcaaccagacctctgagacctgccagggactaaaccaccaaccaaagactacacatggaggaactcatggctccagctgcatgtgtagcagaggatgcccttgccaggcatctatgggaggagagggccctggtcctgtgaaggctggatgccccagtgtaggggaatgccagggctatgtggtggctatgaagtgggtgtgtgggtgaaggaacaccctcatataagcagggagacaggggatagggtagggggtttatagaggggaaactgggaaagaggataaaatttcaaatttaaataaataaaatagctaattttttaaaaacattttacttgaaaccatagaaagtaaaattatatgtaagattgttttactgtgctgaacaatggaaaaagatggtttgtaatattaaatacttactccagccaaactattaaaatcaaaaaacaatgtga

SEQ ID NO: 1590 - DNA, 1000 bp, mus musculus
tttcctccattaagaactttatacatgcatgatatttacacactaatgagtggacattagccaaaacagtacaaaatacccaggatacaatgcacagaactaaagaaagttaacaagcagaagggcccaagtgaggatccttcaatcccacttgggaggtagaagaaagcaatcacagggagaagaaggcaggaacctgggtgcgggagggaaaggggaaggacaaaggggaacatgatcaggtatggggggagtgtaggagagaatccctgaggaccatcagaatgaagggaaatatgcaacctagaggggtgggaagggtggggggaggctctctggaaagtaccagagtcctgggaggtgagagactcttagatgaaatcctttcagcagggaaaggggacttgcaaagtatacctccagtagaaagacagggcatcatatggagggatgatggggttgccatcccacagtcaaaaaccctgagcagaaattgttcctgtctaaaagaactgcagagacaaaaatggacagtgagggaaagatggttcagtgactggtccaactttgggatccatgtcaaatggagtctccaaggtctgtcactattactgatgctatggtgtgcttacagaaggaaatctagcatgactgtcctccaagaagtccaacaagtagctgactgagacaaaggcagatacttacactcaaccattggcttgaagttggacacccctgtggttaagttagggaaaggatagtaaaagatgaggaggagggcaaccccataggaaaacatgcagtctcaactcatctgggcccctgagatctctctggcacagggctaacaaccaggcagcatacaggagctggtatgtcacagatagatcaaagggctgcctggtgtggcctcagtgggagaagatgtgcttagtcctagaaagacttgaggtcttagtgagtggggaggtctggtgggatgcagggggtgggggacatc

SEQ ID NO: 1591 - DNA, 1000 bp, mus musculus
gcgggttgtggtttataggccacattctagacctgaacataattagttttgcttttcccactagttatccttgtgatctttgcaaagttgtaaaacgtacctaagtcatggttttcttttgagtaaatatgagggccaaaaaaaaaatgttttaaaagaaagtcacttattctcaaattaagtcaggaaataaatcaatttcattcatattgtcagtttcatataggcagatactaaaaaatcaaatttaatcaactgcttggccaatgcacctttttaaaaattttattggttatttttttatttacattttaagtgacatccctttttccagtttccaccccacaaaaccctaattccatccccctcttcctgcttctatgagggtgctctcccatccacccatccactcccacctcactgccctggcattcccctaccctggaacattgagccttcataggactaagagcctctcttcccaatgataacagataaggtcatcctctgctacatatgcagctggagccatgggtccctccatgtgtactctgtgattggtggtttagtccctgggagctctggagtgtctggctggttgatattgttgttcttcctatggggttttaaacccctttagctccttcagtcctttctctaactcctccattggggtccccatgctaggtgttagatccaatggttggctgtgagcatccgtttctgtatttgtcaggacctagcagagcctcttaggagacaggcttttttcagcaagcacttcttggcatcagcaattgtgtctaggttaagtgactgtatatgggatgaatctatggtggggcactctctgcatgacctttccttccacaccttgtctccacatttctgttagacaggagcaattctgggttaaaaatttggagatgagtgagtggccccattccccaatgggtctcttgcctaacctctggatatggtctgtacaggttttccccca

SEQ ID NO: 1592 - DNA, 1000 bp, mus musculus
agaaagatctaaaaagaagcactgtgggaccttgaaaggcagcctgttttctggttgagctaggtttaaaccctggagacccagctgataattctgcaagagatggaaggaaatttgccatgcacccaaacaccagactgctgacaggaggccccatctccatacttctgtggccatcagtcacataggcaatgcctcaagcttctggtattctgtctggactccacccctacagttacctggcaataatcaggtaaacctggctcactataaaaggggctgtttgcccctcctccctctgttactccttactcttgcctctctgtctctctctctctctgtgtctctctgtctgtctctgtctctctcgctctcttgcactcttgttccccctctctcctgcatccccttccccctctctccatgtggccagggctggccactaattctctactttcctctctctgcctctactacctgcttagctccccttccagccatgacaataaaagccttaaaaccatgaattaccgcttctcatcaggatcccctgtgctggtgcatgttgtctacaaggaacacacgcacacacacatgcacacacacacagagtggggaggcaaacctatcttgcagagagaaaagaaggaaagatacattccaataataaattgacaaaaatagaaagcatagtgctaaaactgtatgacaaatataatttaaatcagaataattctgaagagataaataatatcaggggatattaacaaaatacactctttgggagtatatttaaatgcttaagatatgtagatgaaatgttggcaagcatattttcttaaaacatgtacttctggattaacaggtcagtgggtgctatcaatactccacactcatcaataggttatccaatacttatgataatcaacaatcattggaactatctacctggttttctataaactaattcgaataggaatttagagccacaaacagaatt

SEQ ID NO: 1593 - DNA, 1000 bp, mus musculus
ccaagaggatgttcccaccccacttcaccagacctccccactctctgaggtctcaagtatcatgaagtttaggtaggtgtctgaggtcagacaaggcagctgccctcctcttcagatttttccagcatttccctaattcaaccacagtggttcctggcttctgtccattgtatctgtatctgactctttcagctgcttgttggacctgtcagagaccaaccatgctagtctcctgtctgtaagcacacagcatcattaatagtgtcaggccttgggacctcccctggagctggatcccaatttgagtctgtcactggtcctcttagcctcttctccttttttatccctgcagttcttttagacaggaacaattctaggtcagatttttttactgtgggatggcaaccacatcattccatttgatgccctgtctttctactggaggtggattctacaagttccttctccccactgtagggcattttatctaaggtacctccctttgagtcctgagagcctctctcctcccaggtctctgatacattctagagggttctccaacctcctacctcccaaggctgcctgtttccattctttctgctggccatcggggctttaataatgctctcctcttccaatacctgataatgttccccttttccttccttgttccctcttccacacagatccttcccttccccccaccccccacccacagtgagtatagatttcagttattttattactattggttgtgggggttttggtgtgtgtgtgtgtgtgtgtgtgtgtgtgtttcttctcttttgattttgttggtgtgagatgaggttatttgcttcttgtgtttttaagggtaccatgaagacaacctccttagtttggagtttcccttctagcatattacatacagctacatttgtagatggatattgtttagatatctatctaaattgaaagttttactgtaaaatgttgtttggctggcatctgtcatctt

SEQ ID NO: 1594 - DNA, 1400 bp, mus musculus
tagaagattttgctttctgggatctattttcaacacataagttgaacaaagggacatactaattttatcagtcagttaacaagagtgaaaatggaaaaaaggaattaaagaagatgatgacttctacattttaattttttttcacctttttctctattaaaagtaatcttaaataattctgaacaaaattctaagagcatcaattgattatatcataactacattatttcattctcaaatatatataaggctaaacacaatctgattttctcgtcattgctaatctaatgtactgactggagagataaaacattactgttgcaggctatttgttcacactgtgaatccccaaatcgtgttgtttaccaggaaaaccctgtttttagttgtggcgctgcttacccttagcatatgccttaatccctctgcctgtaatatatacacacccgcaatgcacacctttcatcccaaagataaagtttgttgtgagaaggaagcagtcgtgtttgaaagtcatgttcaatcgtgtgtctgacaaactgaaaatcagagaaagatttgacagagtaggatattcctaactttcacgagaagagaaaggaaagagaagccacttgagaggggccatgtaaagaaaaagaagagaaggccgttttacagagactggttaaagagaaaataaggtagacacaggtgaagaaagagccagagaatgagaagaagccggaagaatagaacaaattgccagagtgaatttgaggccaagaagaacaaaaagtcagaggctgagagagaagccagattgaatcggccagcttgcagaggagtctgagtctgaagaactgagttggactaggcagccagagttcagaaagaacaagcaaggagtgatcttagtagaacgtctcagaggctgcaaacaacctaggccttgattagattctatggaggctagacgctaccataactaggcctaggctatccgatgaaggcattaagcctccaaaattgaaattacaacaggagaagaaatgttacagtgcatgatatataggagtattattaaaaaatatattacataaaaattacagagaaagtataagacatggaaaatagaatgttaacctcaagcctattataatgtgaaatagtaatatgtaaaaggattagtaaaataattggattgcataaaatcaataaaaagaaatttaaaaaatttaaaaaaaaagaaaaaaagatgattttgttttaggtattgctttaaaaggctagagatatgggttggggttaagagcaccaggggccctaggttcatgtctcagcactaaaatggattctcacaactatctttaactccagttcctggggatctgataccttcctttgacctttgttgttat

SEQ ID NO: 1595 - DNA, 1600 bp, mus musculus
aatggaagctgcattgtctaaaataacctacttaattttatcaaaacatttttataaagcaatcatgttcatttggtattgataaccaatcgctgcacttttctctaaggaagacaatttctcccaggctcagcagtcctttgtgacctatagttctttgtatagaactgggcctctagccccacccatgcacataatagcattttattgttttgtccttgttaaactcacatttcagctgtcatttgtgagactttatggatgtaagttctgacattcctgggtgtcccaacttcacagtaaccaaactgagcatcaggatctacaacctttctacaaactttttgtaacaatcccttaaacaggtatcattacacagtctgagctggttgaatttattatatatattttatatatattcgtatgtctgcaaaattcatgatgtccttatttttaatagctgaataatattctgttgtataaatatactgcattttctttacccactcctcagttgagagacacctacactgtttccagtttctggctattatgaataaagctgccgtgaacatagctgagcaagtgtctttgtagtatagtggggtgtcttttggttataggtccaggagtgatatagctgggtcttgagttagactattcccagtgtcctgagaacctacctagttgattttcaaagaggttgtggaagttggcactcccatgaacaatggagaagtgttgctctttctccatttccttgccagcatctgttgtctccacattgctttcattgtgtcccataagtttggatatgatgtgtcaacacttttattaaattcctggaagtctttcatttctttctttctttctcccctaaccaagttgccattgagtagagagttgttcagtttccatgtgtatacggcctttctgttgttttgctgttactgaagcccagccttaggccatggtgatctgatcaaatgcatggaattatttcaatcttcttgtatcagctgagggttattttgtgatcaattatatgatcaattttggagaaagttacatgaggtgtttagaagaaggcatattctttagttttcaggtgaactgctctgtagatatacgttcaatccatttggttcctaatctctattagtttcactgtgtgtcagtttagtttctgtttcaatgacttgttcattgatgaaagtggggtgttgaagtctcccgctattattgtgttaggttaaatatgtgtttaataatatttcttctacaaatgtgggtgcccttgcatttgcggcatacatcttcagaattgagattatctcttggtggatttttctgttgatggatacgaagtgctcttcctcatcacacttgataactttcagttgaaagtctattttattggatattaggatggctactccagcttgtttcctgggaccatttgcttgggagactttttgcatccttttcctgagatagtatctgtctttgttattgaggtgtgtttcttttatgcagcaaaatgctggatcttgtttgtgtatccagtctgttagcttatgtctctttatagttgagttga

SEQ ID NO: 1596 - DNA, 1400 bp, mus musculus
agttaggatctttttttcattttgtattttctttgattgttctgctgatgttctctatggaatcttctgcacctgagattctctcttccatctcttgtattcctttgctgatgcttgcatctatggttccagatttctttcctaggttttctatctccagtgttgcctcactttgggttttctttatcgtgtctacttccctttttaggtcttggatggttttattcgattccatcacctgtttggtcgtgttttcctgcaattctttaagggatttttgtgcttcctctttaatgtcttctacctggttagcagtgttctcctgtatttctttaagtgagttattaaagtccttcttgattttctctaccatcatcatgaggtatgcttttaaatcagggcctatctttttgagtgtgttggggtgcccaggactgggtggggtgggagtgctgcattctgatgatggtgaatggtcttggtttctgttagtaagattcttaggtttgcctttgccatctgataatctctggagttagttgttgtagttgtctctggttagagcttgttcctcaggtgattatgttagcctctatcagcagacctgggagactacctctctcctgagtttcagtggtcagagcactctctgcaggcaagctctcctctagcagggaaggtgcccagatatctggtgtttgaacctgcctcctggcagaagttgtgatccactcacagaggtcttaagatcctgtggagggtcctgtgggtaccttcagagtgtcaagagactcctcacccaagctaccctggtgctagctgggaccggaagggacttgtgcccctgatcaggccaggttttgtgcttccctaataaatgcagtctcaggttccgaatgattgtactggagcagcagctgtgttccactcacagaggtcttaagatcctgtggagggtcctgtgggtaccttgcgggtgtctgcagactctgcacccaggctaccccagtgctgaaggagagcggaagggctgatttttctatgtctggtaatatatagaaatattaaatgtagaaataatgaacttcagtcttttataataaatatatagctcttttataataaatatatataaataaatatatatatatagtctcatacccttcttaaccactctcttcagaactgaataggaactaataatctataacataattggatattatctgaacttgaaaatattttaattgcctcatacattatgagcaattttaatatatgaaaatcatagtaatttatatgattaatggtaaaatatcattggagaggtagaaagttaattatcctagttttttccagctggtacaacaaaattgcatcactgaagttgagttacacat

SEQ ID NO: 1597 - DNA, 1000 bp, mus musculus
gtacactcacaagataaagcatgaagacatgagtatagatttcctagagtcactttattttcattaaattatctttttcttagcactttgtagaagtgacttaattcacattttttttggatgtattttgttttatgctggctttcctctctctcagttccaggtaataaattcaaaagctactgcttgtgtttgtacaagtggttctaaatcaaaaagaataatgacactgagccaccaaacaggcagcatacaatagctggtatgatgctcctgacacagagctctgatacagcagaggactgctgagtctggcttcagtgatatttaaccctcaagaggctttaaacaccagagagtggggaggcctggcagggggtgggatgacctcttgaagatggggggaggagtgggatgaagaagtgtgggggtgtgtaacgactgtactgtgaaaaaaaataaagtaattttaaaaatgaaaattgtgttgctagaagctatagctttcatttaaacattgatgtgcttgtaattctcttaaaactaatgtctgtgccattcatggaagatgcttgctaaattttagttcaacaaaaactctgaacctttctctctctctcttttttaaggtttttgtttatttattattatacactgtagctgtcttcagacgcaccagaagagggcatcagattccattatgggtggttgtgagccaccatatggttgctgggatttgacctcaggacctctggaagagaagtcagtgctcttacccgctgagccatctcacctgcccccatctattagaagcccattggtcgtgcagactttatatgcctcagtacaggaaaatgccagggccaagaagtgggagtgggtgggtggggaagtgggtgggggagcgtgtgggggacttttgggctagcattggaaatgtaaatgaaataaatacctaactaaaaaaatatagaaataagccacagccatacaagaaaaa

SEQ ID NO: 1598 - DNA, 1000 bp, mus musculus
ttcatatagacaaacaaccgcctagtgtaatgatattctgaagtaaacacacttctatgtgctacacctggaagaaatgtgaaaacaggttctaagaagaattccatgtttagaatgacatatcaaccaaccagacccagacccccacccccaccccagaactcccagggactaaatcaccaaccaaagagtacacatggagggaccaatggctccagcagcatttgtagcagaggatggcctttctgggcatcaaagaggagaggccttggtcctgtgaagactcagtcccccagtatagggggatgccaggcgtgagtgagtaactgccctctgaaagacccaacaagcagttgaaagagtcatatatttgttgcaaagcagtggacagaagcagttgacttctgttgttgaattagggaaggctggaacaagctgagaagggtgattctctaggaagaccagcagtctcaattaatatgaacccccgagttccctcaaatattggaccaccaaacagacagcatgcacctgcagatatgaggaccccaatacatgtacagtagaggactgccaggtctgtgttcattcagagataaagcacctaactctcaagagactagaggccccaagagtttagagatcaggtggggtgtggctgggggacaatccagttggagacaggagggtggagaggaggtatgggatgtggaacagtcagagagtggatgggggtcaataaaatatggagtggaaaaaattaattgattaattaaaaaaaaagaagaaaaaaagaagaggcaaatagacctcaaacgtagtattacattcaggctttatttagtgaggaatgcatttattatacattgatttattttaatcaattatatttctattcatcctgtttattgattagccagttaaaataataatgatatgtattgtgtttacccttatagataatattcagtgacaccgaagcagagtagtggggaaaaac

SEQ ID NO: 1599 - DNA, 1000 bp, mus musculus
aaaaggcattgaaaacctaggaataatctgtccaatgtaagaaaacactaaatgtcattatattcattgaatctatattcaacatatcataaagaaatagtttcatttaaactgtttggcaatataagttagacaatgtgctcttacagtttcttctaaattcatcctgggggtttagattattgtctaggaagccatattagtcaaatcaaggttgatacatgggaaaccacaaactggttaaacagacattattctctcacagttttatagatgaggaatcctaagatcaaagttcaggctgatttggtcctttggtgaggacaggttctgagttcccagatggctctctttgtatgcttgagacaaggggaaggagaaagcacgagaggcagtaggataccccaagcagagggaactaggtctcattgatgtcactgtgtgtcaagatggattctagaatgcaaagaagcttgtgcaccagcgcaaagtgagcacagaggccagagagaacacacatccatgggggaatgtcatatttaactctggatgactcggtgaggcatcacagcattctaaaatactaaatgactatttgggacatagtgttaaaattcttttttttttaaataaaaacaaaacttagacatataaaccaaataaaattatatatttttttaatttcatgctaatcatctgtcttggggtaaagagtttcattaaagttgattgcaaatttgacctcatttctactttgctttatttttgttgctattattctttcatataatattttcctagtattctccctcctctgtctctcactccctccttctctctctgtctctgtttctctgtctctctgtctccctgtctctctctctctgtctctctctgtctgtctctgtctctgtctctctctctcactttaacttggtctcatctattctcaagagatttttcttctgttcatgtttaagcatgctttctaattttattc

SEQ ID NO: 1600 - DNA, 1200 bp, mus musculus
cactaaagtacactataactaatattagcctcaaactgagaaaatacttactgtcttaaacaaacttaaaaactgatgaagctccaaatttgtgtgagttagagcatcaagttaattttttattacatagacccattcatccgaccatgaaaagaacttcgtagtcacatattaattatttatttatttcttgtttgaccactgaaacacattcctcacaaagaacttgatatcaaaatctagataaattctactttatttcatgtcgataattttagttatgtaatggacgcccaaaatgcatggaaaacactaaagtgcactatgactaatactagcctactttttttgatgctgacactgtactaaacagaagtaccctgttcttggataaacagaagcctaaatccaaccttcctcaggaattttgtaaggtaggtttgtgcttaccaggaaaaccactacctcctttatctaccccaaaggtcaactatcttgggccatctacttctcagttaatccaaacaacttatattagctcaaagattcccattccactgactaccaaataaaattggattgctttcctgacaagttcctgtactttgtctcccagacacatttgacagtttgatcttatccccccatacctttccttctaaccacagagtggtccagtttggtggtttcattgtgtccttggttacaaataattaacattatgagccaactcctccatttggtgtaggcttgtgtgctgtctggcatgatatcaacttgacccaagctatagtcacctaagaggagggaatcttgattaagaaaatacctccataagatgaggctttaggcaaacctgtagaatattttcttaatgagtgattaatggtagagggcccaacctattgtaggtcatgccatcttggctgggggtctgggactctataagaaggcagatggagcaagcaatgaaagacaagtcagtatgcagtatctttccatgtcctctgtatcagctcctgtttccaggttcctgcctgtttgagttcctgtcctgttcaatgttgagcagtgatgtggaagcacaagccagatcaactctttccttcccaggcagcttttgactattgtgtttctaggacagtttctcttctcttctcttctcttctcttctcttctcttctcttctcttctcttctc

SEQ ID NO: 1601 - DNA, 1000 bp, mus musculus
attgtcaactcactgagaaaaactgagtacttacgcgtacatcatggacccaggactaggaaggtttctatccagtcaccatctgatctctatcagccaggtcagggctgggaggctggaaaataatgacagtcactgaggacaagaaaggaaacaagtccagcaggtttactgagtgaggtttgctgtcttcatatagccagatagaagcatggtctatttggtcccagccattgccacacaatgaagtaatgaatgtcaatacctacacagagaagctccaagccatagggtgatcagtgtgcatagctggtgatgattcagaagtcacacttttccagttggggaggtatgatcagaattggggtgaggccagcctcgggtttctttttttaagcaaaacaaaacactagtatatactgttgccacttcttgctaaattgttagaaattttccatcacttccctttgagggaaacatgaggtgtgggggagaagagtggccctgaggtatggaggatagcacctgtgcctgtctccttggtagtgtgaccatggacagtccaattagcttatcgctgctgatgttccccacaagcaatataataaaattaatttcatctaattgtggccattttagttctaaagatagaaataaatttcactaaagatatgtttatactccaatggaaaaacagaaaagtaaaacaaacaacatttaacttttctcaccatcagaaaaatcttaatagattttagtgtcataaatcacccaatatttagaaatagtactcatataattacataattatataaacatatgaatctaaatatgtgactttctcataaaattacattaagttacagcatagatattacaattataaggtctacctttaaagattcaaaaccaaatcagacctactagtgctggtctgtaaccacagttgttcagaagcccgatgcaaaaggataagttcaagacctagaacgtcattgag

SEQ ID NO: 1602 - DNA, 1400 bp, mus musculus
atcagcagacgtgggagactagctctctcctctgagtttcagtggggagcagtttctgcaggcaagctctcctctttcagggaaggtgcacagttatctggtgtttgaacctcctcctggctgaagatgaaggcccaaaacaggatctttcccaggagctgtgttgctttgaccaggaaggtggccggttgtctggagccgaagatggcactacctcagaaggtctctggctctcgcctgtcccagaaacggctggcctctgtattccacaccctcacctgtgcagcctgcccttcacggagtcccagagccaaggaggctcccgccgccggggcctgaggcagaaacctctcgggccgggtggacccctgtgctctcaccaggaaggtggccagttgtctggagccgaagatggcaccgcctcagaagctctctggctctcgtctgtccctgaaacggctggcctctgtgttccacaccctcacccgtgcagcctgccctccgcagagtcccggagccaaggagcttcccgccgccggggcctgaggcagaaacctctcgggccgggcggacccctgtgctctcaccaggaaggtggccggttgtctggagccgaagatggcgccgcctcagaagctctgtcctgtatttctttaagggagttatttttgtccttcttaaattcctctattaccatcatgagaagtgattttagattggagtcttgcttttccggtgtgatggtgtatccaggacttgctatgttgggagaattaggttctaatgatgctgagtaaccttggtttctgttgagtatgttcttatgcttccctcctgccatctgattatctttagtgctacctgccctggctaaatccggctggagcctgtcctttctgtgatcctggttgtgtaagaactcctcagagttcaactgtctctgtgatcctgtgattctgggatcctgtgatcatgagatcctgggtgtatcagagttttgagtattcaagctgcctcctagatcctgagattctggtgtgaccaagttcctgtgatcctgtgatcctgtgatcctgtgagcctgtgtacgtgggtgcgttagagcatctgagtgtggagtttttttctgagtgttgtttgactgactgtggcgttagtgtccaacttctgctcagggcactggcccagactgaaaagaacccatgccactggtcgagccaactaccttctttttaaattcttttcagttgattcatctattccaaatccttatctacttacttacattatggtttccttacattgagcatataatttaatatagtattgtggtatttgtgattggcttcaatattttcaaaatctgaggactcttattattattgtaggcatgtgaatta

SEQ ID NO: 1603 - DNA, 1200 bp, mus musculus
acattgatggattttcgtatattaaaccatccctgcatccctggaataaaacctacttggtcaggatggatgattgctttaatgtgtttagattttctaaacatttcttatatggacagtgggaatcctccctgcacacagaagcaacatgcctgttattgtgcaagaagggaacgcacttctctgggagatggaggctggagtagtctgtacagggctttgcctgggacattttcaggctcagaatgagcctcatcttggccaatctatgggaattcatgaagcaatacttcaaagacaagcagcctaacatagcaacctgctgacttttttaatcctcagaatcacctgggtgctgctgatgctttggatagcttaaaaccctctaagtcaccagtaggaggactaggtcctgaatttcaagtatccaaatccacagcgttgcaatgcattctgctggctaactatacttgaccatttttggtaaaaaggtaacccttggcaatggggaaaatctaaagaagcagatcagacatttggcttttgcaagggagcgcccaaactcacttgcatatgctgggtgatggttccctgtagtacacgaaaatacaactttaggtactggcagaaagccctccttgagttgagttctctggcaagacttggcagagatgaaagctttactatgttaggctaccttgtctttttgcacaaaatggccagctgcactccactcatgtatggcttgattggacttccacaggcctgcagcatcactagagagcagcagcagcagcagatcaggaacaaccacttaatatctcttaacatcaatagactcaattctccaataaaaggacatagactaacaaactggatctgtaaacaggacccatcattttgctgcagacaggaaatgcacctcagtgtcaaagacaaacactacctcagagtaaagggctggaaaacaattttccaagcaaatagtcccaagaaactagcaggagtagccattctaataagggataaaatccactttcaaccaaaagacatcaaaaagaataaggaaggatattctacaaaggaaaaatctaccaagaaggatgctcaattctgtacatatatgctccaaatgcatgggtacccacattcataaaagaaactttacaaaagctaaaagtacacataccttacacaata

SEQ ID NO: 1604 - DNA, 1400 bp, mus musculus
gtaccacattttctttatccatattacagttgagggacatcgaggtggtttccagtttctggctattatgaataatgctataaataaactttaagaaaggcacaagcaaagatgcttgaatctcacttagaagatgcactaagattgtcataggagagctgggcggtggtaggctcgcctttaatcccagcacttgggaggcagaggcaggtgaatttctgagtttgaggccagcctggtctacaaagtgagttccaggacagccagggctacacagagaaaccctgtctcaaaaaaacaaaaaacaaaaaacaaaacaaacaaaacaaaacaaaaaaaacaaaaacaaaaaaaacaaaaaacaaaaacaaaaaacaaaaaaaacaaaaacaaaaaacaaaaaaaaaattgtcataggaggcaggtcgaaggaggaaggggaatgggggattcaggatcagatgtggggagggacaggaggatagccagccagccatgataatgaatggaaatttgcaaatgactagggtgggtagatgaggagaatctccaggaccttaaaaaggcctggataaaggagttacatgagacccaatggaggtgaccttagctgggactcacagcactggggatatggaactttcagaggccaccttctgtagccaggcaggaaacccagtgaaacaacagggacaccaatatacccacaaaattttctaccccaaatgtatactgtctacaagtgatgtaggctcgggggttgaagcagagacggagggaacggccaactaataactggcccaacttgagacacattccatggataagcacctatccctgacacgattaatgatactctgttatgcttgcagacagcagtctgagaggctcaacccagtatctgactcagaagaatgaaaaagcccacgacccaacagtggttggaatttgggaactcttatggaagagttgggggaaggtggccctgaaggggatagaaattccacaagaagaacaacagagtcaactaacttgcaccttaatacttaactatcaaccatagagcataccaaggctggacctagccccctgaccccgcacatatataggagatgtgcaggttgatcatcatgtgggtcctaagcaactggagcaaggattatcccaaagctgtttccttttttaggatatgttcttctaactggactgccttgtctgaccttagtggaagaggatgcttctagccccgcggagacttaatgtaccaggatgggggggggggggggggatatacaagggagccacggcctctcagaggagaagtggaaaagggactaggaggagaggattgtaggaggaggcagtgagtaggatgtaaagtgaacaaataaaaataaaat

SEQ ID NO: 1605 - DNA, 1200 bp, mus musculus
agcagtgagtcaactaaagaagataaagtggatgcaaattgaaaagaagaaatcaaagtattatttttacgtgatataataacatcatatgtgacctcaaaaattctaccacagaatccctacagctgataaatgctttcaacaaagtggctggatagaagattaactcaaaaatatcagtagcccccctatacacaaataaaaacttggctaagaaaggaatcagaaaacaataccttcacaataggtacaaataatataaaatttattgaggtgaaagacctataaaaccagaatttcaaatctttaaagaaagaatttgatgaatatatcagaaatggaaagatttcccattttgtggatcagatccatagaattagtatactaaaagtagccattcttccaaaagcaatctaaagattcatcacaatcctcaccataattctaacataattcttacagaccattaaagaacaatattgaaaaacaaaaatccaggatatatacaaaaatcttgtacaataaaataatgttggccggtttcaatctgtaacctggagctaaggtggtcccacagccctccacaaccaaatcccaccaggagagggctggtctcccaggagtattctcactcctaagcccacaggtaagataaccacttttgctccaatgactgtccaaggagggacccaccagaagcacagagggcacaggaacagcagagcatcctgggacaagatctttccagtttccatctgtgccctggagataaggctgccccacagccctctgcaccaaattctgccaggaaagagctggtctcccaaggaatgctgacacacctaagatcacaggtctacaggcccacaggagggacaagctccagtcagaaacagcaagaccaactaacaccagagataaccagatggcaaaaagcaagcacaggaccttacataacagaaaccaagtctactaggcaacatcagaagccagttctcccaccaaaataaatcctggataatccaacacaccagaaaagcaagactctgatttaaaataacatctcatgatgatgttacaggactttaagaagtctcttaaataaatttcttaaagaaatacaagagaacaaaagtaaacaggtagaagaccttaaagagaaaacacaaaaatcccttaaagggaaatacaaccaagcag

SEQ ID NO: 1606 - DNA, 1000 bp, mus musculus
gacatgcaatagccatctttgcgctgggaggcaaaggcatgaaggtcagtgaactccagaggtacagatcattctgggcaatcttagcaaaagccactgtcagccaggaagtccaagggcttgagtcctcttcaaaagtctgaaagggaagaatactctatttttaggaggaaaaactacatgcatgagaatatgttttgatgaaaatataaggggaagaacacttttgctgcagctattgtctgtgtatctgtgggaggaaaccaacatatttccaataaaagggaaacatacaaaaaaatctatgtctgtctggagttctgtcacacacacacacacacatacacgtgtgcgccatcagctcatgcatatgagagctgcttctcacacaagaatgtgaattcaaaatgtaacgtttacctcttttttaaccacaagagagtttttggtcccttttggtaaaagaatggttctacaataactgatctcgttgctcatgaactagccccacagaattctatctctgacaattcacaggttgacacagtgcagggtttcccagagtgtggtcacagactccctgagtctactcagatggagtatttttgttgccctagcctgccagcttccatataacgctcatgataaatattctccaagcctggtattttaccaagcatttgtggtgtatctcaggtgattattatttagactctatgctaagagcttggttgtgaccaaaggtcttcctgcaagatcttggggtccttagcatcatcctgaaaaagactatggaattgcatctctttgccattcttctcagcatcttcccttcctccatctccctcgccgtcttttttatttcaggtaggttttttgttttttactttattattaacctttagtaacctatagtaacatttaaatagggcatgatcaattatttataaataccatgtaattgcattttctcatccccttctaacccacaaggtatttg

SEQ ID NO: 1607 - DNA, 1000 bp, mus musculus
gagctcaggcttagcagttttagagcagacctgggagcctgggcctgagcaaagcctgggccttgtgctttcagacccccagccaaaggctagagttatcattaatcacactggtgagtctagaggactatcaagcactgagtagaaaacctgactttttctggttatgctagggttaatactggttaatatcctgtgaagtggtccctcactttctatagtagccaggacacttgggaccttgtcagctgaggtggggtgctgctcctgttcctcccggtgctccagtctctacgggaatttctgctcaaatcagttccttcactttattacaaaacctccatcactctaggggacaaggcagtaccccttctgcactggtgcttttcccttccctattccacttaatgtcacaagccaggataatcataacgtaagaggactggaatgttacagtgacgcaatagccactgagagctaacaacagctagcactcgggtgccaaacaccctccaaccgttctagatacagcaacgggtttcatcttcgtgacaatctgtgtggtactatcgtctgttattttttcccattatataatcaataaatttaggctcaaagagattcaataacttacaaagtcttcttgtaggccttaggctacaaaccattaattagaccccagacacgcatgctccctcttataaaagcaaagcacacctataaaggagaacagatgaacccatgatccagctcttacgctcttactaaatcttcctgactttgttgatgattgacttttaaggtccctctgaggacagagtgtgaaaatatgtcaggtgttaaagacctggactctgctcagctccacgtctggaacctcttctgggaactcccttgtgctggagcttaaattcattacagggcattcccgaacattaaggtagctttatggctataagtcttaaggtggcaaaccaaggataaacacacatccagacat

SEQ ID NO: 1608 - DNA, 1400 bp, mus musculus
cgatcggattggggcaggcgctgtgttccactcaccagaggtcttaggatcccgtggggagtcccgtgtgggcccttgcgggtgttgggcaagactctgctggcaagtagcccggggctcgagtcgagcggaagggacttgtgccccagatcaggcccgggtagcctgcttccctatgtaccgcagtctcaggttctgagcgatcggattgggtcaggcgctgtgttccactcaccagaggtcttaggatcccgtggggagtcccgtgtgggcccttgcgggtgttgggcaagaccctgctggcaggtagcccggggctcgagtcgagcggaagggctactttcttttttactagaattttggtatcttctcaaatttgacaatttttagcactttaattacttttgcctgcgagcagatttacagcaacggcttgcttcccctagagagcttgcctcgggatctcatctttggagcccaatgctcttgatctccatattttgatttgtttcttgcctggttgttgagcgcagtcaaggaagatttataaaaaggccatgttggggaggcagctgtggagtccttgcatgtagaatgtcattggttgttctcaaatataaaatactccgtgtttccctcaactcacaagactttccctaaaacctttgcgcatgtcttcagggtccctgaactttccctttctccaagtagatgaatgtagaaatgttatcactcatttccaatattattattcacgttaccccctgttgcttggagaattttccctttgtccttagaatgcatgaaagttaagggaatcagatacaaatctaccttgataccctgaatgactagagctctctgaagataacaagatccaggctatgacacttggtctgatttccttgctctctagttgtactctgagggaccacagttccctttgacaccctgctttggtctttcctgagtttcagggtctgaattatgctagtcagtttctatcagctggacacaaaacagttggcagaagagggaatcttaactgagaaaatggcactataagagtgtttttgtaggcatttacttgattaataatgaatgtggggtgggcagctcactggaagaattactacccctgggcattttatatgccaggtggtcctggacaatacaagaaagcaagctgggcaagtcatgggagcaagccagtaagccagttcctgcttccaagtttctgccttgagctcctgctctgaattctcttcatgctggagtacatccgtcaactgaaataaaccatttcctctccaagttgcatttggtcacaacaatcacaacaatggaaaaatctatttaagacaaatggatctaggaaaatcaggacatgtgtaaataca

SEQ ID NO: 1609 - DNA, 1400 bp, mus musculus
cctgtatttcctggatgatttgagtttggatccttctgcattttgtattttctttcattgttgtgccaacattctttatggaatcttctgcacctgagattctctcttctatctcttgtattctgttgctgatgcttgcatctatggttccagctttccttcctagggtttatatctccagcgttgcctcactttgggttttctttattgtgcctacttccctttttatgtctagtatggttttgttcatttccatcacctgtttggatgtgttttcctgttttcctataaggacttctacctgttttgttgtgttttcctgtttttctttaaggacttgtaactctttagcagtgttctcctgtatttctttaagtgagttattaaagtccttcttgatgtcctctaccatcatcatgagatatgcttttaaatccaggtctagcttttttgttgtgttggggtgcccaggactagttggggtgggagtgctgcgttctgatgatggtgagtggtcatgatttctgttagtaggattcttacttttgcctttcaccatctggtattctctagagctgtgcacaatacactcggcggggtcctggaaccaagatgtctgtgcagggtacactcggcagggtcccagaactaagatgtctgctaccaatgctcaggcaaagcgcttccgcgccaggcaggtccctatcctctggctgggaaaatggtcacctgcctgtgcaggatacactcagcgggatcctggaaccaagatgtctgctgctgatgctcaggcaaaatgctcctaagccgggcagatccctatcctctggccgggaaaatggccagctgtctgtgcaggatacactcggtggtgtccctgaaccgagttgtctgctgctgatgctcaggcaaagcgctcccgcgcagatcccaatcctcagaattcttaagatcttgtggctggtgttgtgggtatctggcagtattcagcctactctgcaccctagctaccccagtgctgctcggaccagagggggcttgtgcccctactcagaccgggttttctgctttcctaactaatgcagtcttaggtcccgcgcgattggattggagcagatgctgtgttccactcaccagaagtcttaagatcccttggtgggtgttgtgggtagctggcggtagtcagccgactgtgcaccctagctaccctggtgttgctcggaccggaagggtgattgtttgttttttaagacatgctttccctgtgtaactctggctgtcctggaactcactttgtagattaggctagaccgcctcatggagatctgcctgcctcttcctcttaagtactaggattaaaggtgtgttctaccacacttggctccttcttgtattcttta

SEQ ID NO: 1610 - DNA, 1400 bp, mus musculus
gtgcttagcaaagacatgtcacaaaagaattcaatatgcatttaggaagtaaattattagttatatttaatattaaacagtaatattactattaatgaaatattaattgaaaatgaaatcacagaaggaaatccatatcatatattgcccttattaattatactttacatataactgatattttactctatggaaatttaaaactgttatcttcaaatccatctcaaaatttcacagtaatctgccaataacaatataataaatatcttcatttcttgtatattacctaagaaaaacagtattgcaatttctagctttactcttttagaatcaaactaaagactattttcaatgaaagtccgggatgccaggaaagcaagaggctcccaggacccaacggggaggacattagctgaaatgcccaacaaaggggagagagtacctgtggagatcatatccagaggttaggcatgaccaccggttgaggcatgaggccacccacccatctcaaaaatattaatccagaattgctcctaagaaaaatgcagggcaaagagtggaacagagactgaaggaaaggacatccagagactgtcccacctggagatccattccatctgcagacaccaaacccagacactattgctgatgccaacaagtgcttgctggcaggagcctggtatagttgtcccctatgaggctctgccagagcctaatcaatacagatgtggatgcttgcagtgaacatgagcactgggccctcaatgaaggagaaaggcgaaggactgaaggagctgaagggtttgcaaccccacaggaagaacaacaatatcaaccaaccagaccccctagagctcccaagaactaaaccaccaaccaaagagtacacgtggagggatccatggctccagctgtatatgtagcagaggatggcctcaacaattggaggggaggcccttggtcctgtggaggcttgatgccccagtgttggggaatgctagggcaatgagacaggagtggaagggtgggtgggtggggaagcaacctcataaaagcaggggtgggggttatggaaggaaaaccaggaagggggctaacatttgaagtataaataaataaaataaccaataaaaattttttccaagaaaaagaaagttaaaagtaattaagtgtacattgctgtgctttctctcttgactcacttttctgttttgaagaatattgcacaaccatccacatgctttctttcctgctcagacatgattttggcacgtgactttggagaaaaaaatccatcatatccacgatccttcaatgctggcagaaagagagtaaagtattgctctgtttccacttcctaagatgaaggaaaaattgttatctacatgacagttcaaata

SEQ ID NO: 1611 - DNA, 1400 bp, mus musculus; identical to SEQ ID NO: 1610

SEQ ID NO: 1612 - DNA, 1000 bp, mus musculus
acagacagagacagggagagagagatgcagagacacacacacagatctaattaaaaaacattttcatcagagctgtctgctgattaaattgattaggcatttaaataatgacttggattcacatgatatctatgtagacacctgcctcatccttgaggagcaagcatgtttggtgagcaggctgacactactttggagtttacttgaggtgtcaggaatgagtcatcaccttgctgttcccaacttggagcttagcatgttgttgggcctgatttcgttgccattccacagacagtaaatttctcaattgatctttccattggcagaagttaggcccttttgttttctccacagaaaacaaattgctttgccaagtgataggcaggcagccacacactaatacttttcttttcagtctggaatcaggtaatggtggtccatcattcttactgacagtggggatgacacgctggcctgtcctatatcttttagcacagcccaaggacaggaagattggctggaattttatcagcaagttcaagagctgactgtaggagtggtgtggacaggaatagataattagctcctgaaggctcctgtcctattatcaccaagtcacccggggcctttcctgcgcctccacttccccctttggaggaacacaatcgcaggttatttttttgttgttgttgttgtttttgattcacatgttcctgatctttttgatgtagcatggctctgtgagtcaaatccaaactctggctggtgagctcaggatgggtaagatatttttagatggttagaaaatcaggacaattattttgtgacacatgaaaatggtattcagtgctgcagtaaaggttgactggaacacagtcatacggatttatttacatgctccttgtggctttttctcagcagtcttgacaacagtgacatagttgagtatttgcaacagatatagcgagtgggccatcaagtctggttgaggcacgttagg

SEQ ID NO: 1613 - DNA, 1000 bp, mus musculus
gatagaagtccttgccaacaagtgtttatttttaagacccggacagcctgctcactatggcaattccagcaggcactgtgaaactaccaatgacacagaagagacatgagaaagaagcgagtcgggatgacttgacactaccctgcgagtgcgatgactgtatgctgttcctttagatattaataaggatgggtgggagatgtaagtgatcctgttctctgggagtcaggaagagaagcatgctgctcatttgatttgcctttagcacgagaagttgtcattcagtggcactggcacagagagaaggggctggatggtagctgctggtatcccttgcatctccacctccaagatgaccacgttcattttagagatcagacaaatataaagctgacattgtggtttatgctttacagaaattgaatgtatagtctcagggtctcattttaagcccagagaattcagcggttcctgtcgcagttgaatggtgtctctgggcaatacaacctgcccttttgtagacacagctgacgatgatggtgttgtgaaagaatgaactttttacaatcatgcgtaaatccttcaatcactgtgtgcttgatgctcttacagagctcgccctggaaattctgacagtcacaaagactcaccaggagctagaacactacaggcactcttaaaattctttgtaacacaacctgttttctcctagcttacaaccttgcttatgaccctgcctgcctgttctatactgcctctgcctgctgccctgcccacttacctgagcatctgaccctgacaactaccttccctttgagccaggttttgtccttggatgtcctggtgtaaggctgggcctggcttccagccttggcactgcttgcttgcactgaccccaccttgctctgtgtgctaaacacgtcaagtaaggcctcttgctatttaggatgtttgcctttctctttcagagcaaaaagtaatctctatagattataacatg

SEQ ID NO: 1614 - DNA, 1200 bp, mus musculus
caagaattttattgagtagttttgaattggtattcataagcaagattaatctgaggttttctgtctttgttggttctttgtgtggtttaggtatcagagttgcagtggcttcatagaatgaattaggtaatgttccttctctttgtatttcgtggaatagtttgaggagctttgaaggtctgatagaaatctgcatcaaaaccatctggccctgggatttttttgtttttgttttttgtttaggaggttggttgttttgttttgttttgttttaaagatattttcttcatttacatttcaaatgacatcctgaaagtcccctataccctccccctgtcctgctccccaacccacccactcccacttcctggcccttgcattcccctgtactggggtatataatcttcacaagaccaaggaccttccgtcctattgatggcctactaggccgtcctctgctacatatgcaactagagacacaagctctgggggttactggttagttcatattgttgttcctcctatagggttgcagacccctttagctccttgggtactttctctagctccttcattgggggcccagtgttccatccaatagatgactgtgagcatccactccggtatttgccaggcactggcatagcctcacaagagacagctatatcagggtcctatcagcaaagtcttgctggcatctgcaatagtatctgggtttggtggttgtttatggggtggatcacaggtggggcagtctctggatagtccttctttcctgcaaaactcatgaaactcaagaagaaggaagaccaaagtgtggatacttcattccttcttagaatggtgaaaaaaatacccatggaaggagttacagagacaaaaaatttcagagctgagatggttaggaggtcttgaaaactatttatttttgtaggggttattcgagtattttgatagtttacctgatcttcatgtaactttggtaggtggtatatgtctacaaattgacccatttcatctagattttccaggtttttagagtgtagacttttgtagtaggttgtgatgattttttcaatttcctcaagttctgttgttatgtctcccttttcatttctgatcttgttaatttggatactgtttctgtgccctttagtaagtttggttaaggtttcatctatctttttgatttttctcaaa

SEQ ID NO: 1615 - DNA, 1200 bp, mus musculus
aaaacattgcttacacgcgttgttaaaatactgtgtgaagttgcaatgttttgaaacagtgtctgatcagaaggacaaaatcggatcttttttactagatattttctttatttacatttcaaatgttatcccctttccttatttctcctccaaccacccccatcctatccccctccccctgcttactaacctacctactcccaattacctgtcctggcattcccctacactggggcacagagccttcacaagaccaaggacctctcctctcattgatgtcccacaaggccatcctctgctacatatgcagctggagtcctgagtacctttttggttggtggtttagtccctgggagctctgggggtactggttggttcatattgttgttcctcctatggagctgcagaccccttcagctccttgggtcctttctctagctccttcctccattgaccctgtgctcagtccaatagatggctgtgagcatccacttctatatttgtcaggcactggcagagcctctcaggaaaggccatccagtgactgtcccacatgggaatccatcccatatacggttaccaaacccagacactattgtggatgcgaaataggatcttaaggtcaatatgttggagacacctttggatacatttgtaccaaaacattgtaaatcagcatggttaattacagccctaagtttcccttttactcattgttatattgaaatgttaactgctagggctgggggtgtggctccatccatgaagcccctacggtgcaagcatgatcacctgacttctgatccccagcttctgggacaagctgagtgggaggcaagtgtttataatgccagtactgtgagcagggaacagacatggatatcttagaaacaagtagtgtagatagtttatccaatctgtgagttctaggctccatgagaggcacagtctcaagtcaggtggagggccacagggctgactcagcagtagaaggtgcttgtggctgtcttacaacctgagttcaatcctcagaccccagactattaaaggccaaacctgactctcacaagttgccctatgaaatccatggaaccatggcatgctctgccttccctatcacatcacaaaataaataagggcaagttaaaaaaaatactgtggagagcaagagaagacacctccacaaagacacaaacacac

SEQ ID NO: 1616 - DNA, 1000 bp, mus musculus
tgttgtgcttctcaggatactcctgagtagtggactcaactctactagaggagcaaactttgggtcaccgtcctcatcagctgagtcatcaatctctggggtgggccaaagcaacctgttttacatggccatcctaacccctggtaatttaaactcaggggacctcccagtaaaatgaagaaatgagaggaggagggagataaagggagggaaggtggatggagaagcttggacattaaaactgccttcatgacaaatgtttttcaacaaaccaaagcaaagtaagcactatagaattcccccagggccagggtcccctcacaaattaaagcccaattctctattgttttaggcaggtcaatttctcaggagttaaaaaacaacaacaacaacaacaacaacaacaaaatactttcctcatttcccaactccctttgactctgtcacagttgaaaggcttctggtggtacattcagtagaatcctctgtttcctgtactaaagtgtcagcagcatggagcacggttggatactgcaccattatctgcatgctgagaaccccacaaatccattcactgagcaagtatttcccgagaggctggtgtgcaccaggcactattgagtaagttgagaacaaagtaaagaataaagtaaaagtctgaattttatgggccttacaatctaaggagggagaaagtaaaatgtcaacgctaagaaagtaagcaccagacaaatggatctgtgacagaaaccaacacatggcaaagtgacagtgcctagaacatatttgttactttccttagaacggcgtgatggatcaaacttgaaaaactgactccaaaagactgtgttttgtctgaggaaatgccacacaaatgggcacaccaaatcaggcatggctgtgcatgcctgcattcctagccctcggagactaagtctggattgtgcatctgaagcaaggctgaactacataatggctcctagtctggggtacacatgga

SEQ ID NO: 1617 - DNA, 1000 bp, mus musculus
agagttcctagattagcaaagctaatttctaaagaatgcatagacatttccaggcacggaagacaggggtgtggtgtttaggcagaaggagcagtgtgaacagcaacataaacctgaaaaacagctgcatgaagggaaatattagcaatttggggttaccacagcatcaattttaaacttggagcaagaagacaggaaaggccatgaaagctaaatgacaagcctcgaatgcatgctataggtgccagtgagtccctgagaggaatttgtgtcaaggagtgagatggctgaatttatatgtgagaaacatccctgagggctgggtgcaaggtgggtccagcagatagaaatcaggaggcaaggagacatacaaacactgctgccgagggtggatgagggccgcagcagatgcgcgaggggcagtgcaagcgattgaaagcagggctgagcgggtgagcaggcacaagtggatggctgacgggctctaagtctaagactgccgtttctcaatgatcagaactgaccatcattaaaggtgagatggcacactcagaggaagacccagggcttggtttgggacatgtcacaaagctgtgtacacaacttgtgttgctgctcttcttgctgatgcggttactctgttctttggttctgaagaatagctgtgtttatcatttcctacatatatggattctgcatagttttctaagatgtacagttgacagaaacaattaagacctgagatctccagcacccacagaagtcaggcatggctgcacacacacacacacacacacacgcacacgcacaggcacatgcacacatgcacacatgcacacatgcacacatgcacacatatacatacttgtaccattgtggagaccagcagatcttgagagttcactggccagcaaacctagccaaaatggaaagctttgaattcattaagaggtcttgtctcaaggcagtaaggcttagagacacgaaagaaaatatcctg

SEQ ID NO: 1618 - DNA, 1000 bp, mus musculus
cagtgcccagtgcgagtgtctctgtgatttctgcagaagggaaaagaaaacaaaaaccaaaacctgatggaaagaagacagttgcccacagcaccagctgccagaggaaatgccatagtgagcgagggtttgctttccatctactagttatgggctggaaagtttaagagcgttcatcccacagcatgtcaggttagacagacagtggagcaagcttcaagtggctacacacacattcctctattcaagtcttgaacacctctgccattgggtatggggaaatgagggtcgtgggccacaggagggcgctgctttccaaaagtgtaaagtaacactgttgcaaagcgtccagaggcagcagggccgctccctactgtgcaaaagcagtttctgcaatggagggacaccggcatccttctaaagaaacaatcaggggtgggcaacactgaaaggaaggaaagcaaagcaaagctcttcaggtgagaagcgttaatgctgacaatccttttattcacgtgtgtatttgagcgtttaaaaatggaagtgttgggttcgattttgatatgtatcacagactggaggctgaaacctagaaaggaaggttgaaatttaggaagcataaggcactaaagcagccttcacggtttctcctggagacctgcttatcagggagaacaagtttgttccgaagctgctttcagcccgtagggtacaaggtcactgttgtaccacatgcctgtttctggacacatgtgcatatatgtgcattttagtgcataagtgtgcctgtcaccagggctaaagatggagagctggggaagccaaagccactgtcctttgcgtgaaatctccctccatgagggtgtcaaggcctgtcctttctttcttgggccattagtgaccccatgttgttcatcaaatcacagggcttttagaattgttcatagtattagtgctaagtatctgaaaatgttaaaatctagattaattgttttgattt

SEQ ID NO: 1619 - DNA, 1000 bp, mus musculus
taaattcattgggaatgactataagctttgaaaatgaaaatgctgggcagtggtggtgcacatctttaatcccagcacttgggaggcagaggcaggcggatttctgagttcaaggccagcgtggtctacagagtgagttccaggacagccagggctacacagagaaaccctgtcttgggaaaaaaagaaaaaaagaaaaagaaaaacagcagtcagcactaggaaacatactgactttcaagcctgaccgtctaaaaacagggtgctgagctgagcttcatcctaggtttacagagccagcagcagagccccccagatctcccatgctgagcaacgggacacaaataaggaaagtttgatgcctttgtttgtgtatgaaccacacatacagaaaaccagggcaggacagagctgcctgccgcgtcctttcggagattaggaaaactgagttatagactcagaaagcaggacaggtacgtatgctcccttgagatggggactatagaaaatatttggttttgctgaagaaaaaaaaagtctcagagctgggcgtggtggctcacacctttaatcctggcacttgcgaggcagaggccagtccggtctgtcgagtgagttccaggacagccaccaaacaagcaaacagcagcagggactcactcttgtagctgaggctgatcttgaactgaccttcatctctagttcctagcagctgggactacaggactatgggtctggcttaccacacctactttcttttgcttttagtgaatcaaaactacatttgtaaaatctgcatctctagtcaatgtgtgctggaggccaatcccaggccttcatacatgctaggtaccaggtagcttcagtcatcagtttgacagacctgggatgagggaacaaagtgtctccgacagatggggctggttgggcttgtctgcagggcatttctgggcagagccattcctaggcaggtggggctggactgacccagagcctagaa

SEQ ID NO: 1620 - DNA, 1000 bp, mus musculus
tgagaagcttgattgctggctggaacacaaagaggtagctatggtttggatacaaagtttctcaaaggcctgcatggtaaaggattggtctctatactcctgcctgcttcctatccttttgtttcatagctgacttcaagtgagcaacttcctctgctatggccctggccagaagccacaaagccaactgccctggactaactcctctgaaacagtcaaaggagtcctttcctctcttaacctcatcgtttctggcacttagttacagcaataggaaggagatcccagaggtaagagaccgagctggaaaagacttcctgcagagtacaaaggagtttgaaatccatgctgaggtgactctgacaggtgtctgcatagaggaatgtgatcagacctgcacttaagcgcaatttctgtgtctacagacctaaggctggtgggtaaaggcttgttagagagcaattaacactgcccagaagggaggggaaaatctgtgaggcagggccatgggctgtggaaatggatgaggggagatgagagacagatgatgaataggcaagaggtcaactgttagcatgatacttttaaagcaagctttctgggtcctcgagatgagggataaagtattttcaagatcctgacttattacaacaatgggctactcagggtgccaccttcatgggaaggcccatagtctgagaaacaggcaggcaactaaaaaagacgaggccatgtctgtattgttagttcagagccccgagggcttggttacacattgctgggagagctttggcttcattggctcaagctaaaataaacttccttatttcttctgaaaaacttggatttactgacttacgtgatgacatgtttaattgaattgaatttctaagtggaatgtcacagcgctttgctgatgaggaaggcatctgatcttaatccaaaaaaataaataacaaaacttaaaccttggatgaactgagatagagtcaatactctg

SEQ ID NO: 1621 - DNA, 1000 bp, mus musculus
tggctccttggagagggagggtatggatagaggcagggctgtgtccctgctaagcaggagctctaccacagaccagtgtccctgctgtatcacagggctgcctcacagtcatggactcataataaatgcgttttctcctcttgcaagagcatccccaaggaaccactataaaagcaggggcagctctgctttccaggccccactgcgtacttaggaagagtgttttaaatctgtttttcttcagagccagtggtctttgctgccctcaccttgggctctttagtgggcccagtcattgcaagttcaaagggtcctcattacagaatgaagtatattcctgcttcttcctgtgttgggaaccaaggagctgaaataaaaaaacaccaaggagacgtatatcctggatgtctatgacagtaataccctttcagggtgccttcaacagataaaatgtgttagatttctaatgctgtctggtaaaacaattacaaggaatttgggtggggtcaagagaggtggctcaggggtgaaggtgtttccacgtgtacttgtcaagctttacctacacaagctagagtcactcagaaggaaccccaacagaagaattaccggtatcatgttggaccacgggcacattgatggaggcatgtttttaattaatgttgatgggggagggcccagcccactgtgagtaatgccacctctgggcacgggtatcctgggtatcagaaaacaggctgagcaagccatgagaagcaggcgaatgggcaggattcctttagggtctctgatccagtgcctgcctccaggtttctgtcttggctacgctcaaggatggactgtaacctgcaagccaaacaaacccttttcttctcagattgcttttggtcatggtgtttattgcaacaacagaaaagcaagctaggataccacctaagctggataatcttgagtcaggtggtagaaggaaaaagctgaccccccacaagttgtctttcaa

SEQ ID NO: 1622 - DNA, 1000 bp, mus musculus
tgactgtcccacttggggatccattccaaattcagtttctaaacccatacactactgtggatgccaacaagtgcttactgaacaggagcctgatatagctctttcctgagaggctctgccagtgcctgacaaatacagaagtggatgctcacagccatccattggactgagcacagggcccccaatggaggagctagagaaaggacacaaggagctgaaggggtttgcagcccctaagagtaacaacaatatgaaccaaccagtacccccagattcccagggactaaaccaccaaccaaagggtaaacatggagggacccagtctccagcggcatatatagcagaggactgccttgtaggacatcaatgagaggagaggcccttggtcttgtgaaggcttgatgtcccagtgtagggggaatgccaggatagggaaataggagtgggtgagttagtgagcaaagggagcggggaagggatagggtagttttcagaggggaaatgaggaaaggggataaagtttgcaatgtaaataaagaaaacatctaaaaaaattaatccagaattattcctgtctaaaggaaatgcagggacaaaaagtcgagtagagactgaagaaaaggccatccagagactgccccacctagggatccatccagagactgccccacctagggatccatcccatatgcagacatcaaacccagacactattgatgatgccaaagaagcacttgcagataggagccaggtgtagctgtcccctgagaagctctgccagagcctgatcaatatagatgcagatacagccaaccattatactgaacatgggggccccaatggaggagttaggggaaggactgaaggaactgaagaggtttgcaaccccataggaagaacaacaatatcaaccaaccagactccccagagctcccagggattaaaccaccaaccaaagagtacacatggtgggacccatggctccagctgcatatgtagc

SEQ ID NO: 1623 - DNA, 1000 bp, mus musculus
atctaagtggattagggaacttcacataaaaccagagacactggtcgagggtatcgcttgggaggccaccgcctcgggccgaaggtttccgacagcagctcagctcaaccctcggttcgacttccgaaggagcccgcggcggctccgcggccgactcgtggggaacgcccgaaggagaaccaaggcatccagcgagccgagagttaactgcagcggagaggcacatcgtcgagctgcaccgggccgcctgcgcggtgaggcccgctccagcctgccccgcgcgcggcctctgcgcctgcgcgcgcccggccacccgaccccgaggcggccgggccgggaggtgttggacctccggcctggggcgggtcggcctggggcgtccgctcagagggtcctgcgagaaacccggtcgcacttttgcgttccggacagagaggtgtctgccctgagatgggaggctcgcgaggctcggtttttgatctgcgtcccagctaaaggcttgtctcggtttgtgtgtgtgcgcgccctccagcgtgtgagtgtgttgtgtgggggaaatgggtgctgaggaactgagggtaggactgagctcttacagggaacgtatgtagtacagacatgttgcctgtgcgtgataactcgagcagcctgccatccagtgactttagtaatgcaaacataagacagacgctttacatttttgccccgtgtcctctcatcctttgcctccagtccaagtgagcgaaagaaattataatcaggcaagtttgcatttttccttaggcattcttaaatcaccttttcttctggtttatggatttgacaattgcttgtcaccaccaatatctaaccttatctcccttcagtttcctgacactttagaatacaatagtttgaagatagcattatttatattttaagttttataatgatataagagtgacttgtaataaatctgtgtattaagctctgtgtttggctagtacttgataagaccact

SEQ ID NO: 1624 - DNA, 1000 bp, mus musculus
tacattagatggaaggtggagttttaggcatagaagatacaatagaagaaattgatcctttctggtttctgtcttggcctggtgatgatcctgtgccacagcactccttaccaaaatactacctggcggcagcatgttttccaggagtgctgacaagctgtgaacaaaggtaagaccactacttctgttcagacctgcctggggccctcaggtcacaagaaccaaggagcaacctcagacaggattcttcaggtttccatctgtgtcaggaactgatcctgttccacagtgctccatacacaaataccataggtagagagctggtctctaaggagtgctgactcacttgtgagaacaggtaagactaatacttctgctcaaattcctggcctaatagggactcacctagagtcatcaggactcaggaaccaaggaagagcccaagacaggatctttgttgtttcagtctgcatcagagctgaccctctgccacagctgtccatactcaaaatcctctgagagaactggtcttccaagagttgtgacacacaggcttacagaagggacaaaccacacccagagtcagcaagaccagctatcaccagagataaccagatggcaagaggcaagggcaagaacctaagtgacagaaaccaaggctacttggcattatcagaccccagttctcccaccacagtaagccctggaaacctgagcacacaagaaacataacactctgatttaaaattacatctcatgatgatgataaaggactttatgtaggacataattcccttggaaaaatacagttgaacacagggattgaactcataaaagaggaaacacaaaaaatccttaaagaattgcaggtaaacacaatcaaacaggtaaaggaaatgaacaaaactatccagcatctaaaattggagatagaaacactaaatacatcacaaacctaaaatcagacatggaaaagctaggaaagagatgaggagtcata

SEQ ID NO: 1625 - DNA, 1000 bp, mus musculus
gatggttgtcagatggaacctcagagtctttttttttttttaatttccgaggtgactatggactttgaacatttccttaagtgcttaatgagcatttgagagtccttggtttggtctgtggctggagcacaggaaggcattgaggtgggaggttagacagtgctcgttaggggaaagcctatcccatcgttcaagcatggcaggtcttgatgagcagagatagtgtatggttttagagctttagtgtagaaaagcagggagaaagagaaaagggagaaaaggggagaggggccagccatagccatgtggagagaaggtggaagggagagagagtaggagggctagagaataagaaagatgagagcttaaagagatcgaggaggggccaagcagctatttttatagtgggctgggctatcagttaactgtgggaaggagcatacctggctatagtcaggtaactgtgtggagtctagccaacatgccagaagcttgaaacattgtctgcatgacttacagttacataattatggagttggggactctgtggtgtcaggcacctgtctctgggaacatggctcattgtttcattccaatataggctgcttatcacagccccacaatcaacaaaagccatggcattatgagtccttcagaacatagcaacccttttacagcaatcggagatatcctaacataacagaagctaaagaaatgaccataaatccagtcttataaaggtgatagaagcctgttctctggaagtaccttgtctggcctcagttggagaagatacaccttacttttgagacttttggccccagtaaaggggaggatggagggaagagcactctctctgaggacagggatggggaatgggaagaagaactgtgggaggggaggaggagtagggcaatgtgtggaatgtaaaaaaaaataactaaaaaaatgaaaatgtgtatttttacacaatggacaattacacatcctgtacatatga

SEQ ID NO: 1626 - DNA, 1400 bp, mus musculus
tctctcttttgaccgatttttatactataaaattctctaagaaatcctttccatggatatataccattcaccaagataacatttagtaggagacaatcttttttgttgaatatcagtgagttttataaaaatgtgtctcaaaaaatttttcttttttaaaatattttttatttatttgataatatttatctttaatctttttttataacccagttattatcccccttctggtctgccctctgagattttctcactcattcctcctccagctgtctccaagaggatgttcccattcccacactacccccaccactccaggcctccagtctctccagggttagatgtcccttctctcactaagtccaaaacaggcaatcttctgctatatatgtatcaggggccttggaccacctagtgtatgcagctttgctggtggctcagtgtttgagagatctcagggatccactttagttgagattgctgatctacttatgaggttgcactcctctccacttcttcttccaaccttttcccaattcaaccacaggggtccctgaattctgtccattgcttgggtgtgagtatctgtgagtctctgtcagctgcttgtagggcctctcagagtactgccatgccaggcttctgtctgtaagcaatcatagcatcagtcatattgtcatgctgcggtacctcctgcagaatattccattcattctgctggccctcagggcttcacacttgtctcctacctccacattacctgatcatattccctctttcccctcctctttccatgatggttttcttctctctcctaactgggattggggcatcctcacttgggactttttacctgtcaacattcttgagttctgtggattgtgtcctaggtagtctgtactttttggctattatccccttactggtgagctcataccatgcatgtcattttgggtctgagttatctcagtctagatgatactttctagttccatccatttgcctgcaaaactcatgatgtcctcctttttaatagctgaatagtattccattttgtaaatgaaccacagtttctatagccattcttccattgtaggacatctgggttttttcccacttctggctatcacatacaaggtgactataaacatagtagagcattgcccctttggcatgacgggacatctcttgggtatatgcacagtagtagtacagctgggtcttcaggtagagctatttccatttgttttttgaggaacctccatattgattcaattagttgttataccagtttccaaacccacaccagcaacgtaggagtgttcctctttctccacatcctcaccagcatgtgttgtcacctgagttttttatcttagccaatctgattcatgtaaggt

SEQ ID NO: 1627 - DNA, 1000 bp, mus musculus
ctgttcccggtgtcctgatgcctatcgtctggctaggctacctttatgagacaagctggctaagtcaggcctggtggtacagacacctttaatcccagcacattgtgggtagaggcaggtggatctttgtgagttcaaggccagccagtgacactctgtctctcttagttcaccaccccccacccccacctcctaaaaagacaagcagacagccttgaacattacacacaagcctcaaggaagctatactttgaccacaggtgcttactgccaaagcacagatctggctcctaaagtcctgtccaagtcatgatttctccaacagcttgtttcaggcatcccagtgaacactaacagtcacttcctctcagtgcagggcaaggcacgagagctgtaaaactcatcaccatggacctaagggtcctggaaactgaggcccacccacgaggtgcagtactggtaaatgctgcttactgctgctgtcttcactgctgttggaagctgaggattacaatagctgccaagatccagggcttctggtggttaaagcccagagcaatagcctccaagctgagaacagagaacttttggcttctgaagctggagcaatagatccctagttcccagaggcctggagttgtgagcctctaggtctgtctgtctagtccctaggtggtaagcactgagagccggggaatgttagcattgcgagagcatcttcttgctgttcataattcctttctgggtagagcagaagaacccagtcagctgctgaagaacaatgtggcggtgtgtgtgggtgtcccttatgttcacaaacaagcacaaggcagcaggaacttgccttctcagctggaggccattgagctagctcctctgagtctctttgtcttgcaggccttttccaccttgttgatgccaggatctctggactccagattcagcctccattcttgtcttcggagatcctgtgtatgtgtgtttgagcctcaattatctc

SEQ ID NO: 1628 - DNA, 1000 bp, mus musculus
ccttgatgggtggctgtgtgggactgagactgagcagaaccacactgggtctctaggaagtgctctgtcctccctgatcccagtcaccacagggggtggggccctcattggcctggcctctggtgagcagaggtgagtggactgggagtggactctgtagggtcgaggtcagggtgcccctcctattcccagaggggtaaggcagtgacaggctgtagcactcgtgtgtctttgttccctcctctttggccacaaactccactaacagggactagaagtccaagacaatactcaaagccttttcctgtaattgcctataagggaagaggtccagttccatgactttctgtgttgacatttcattttctgtatacatggctcaggcacacatgcacacacagcatgcatgcacatgtgcacacacacacacacacacacacacgcacacacacacaggatatcaatgcatgcttgctctatgggcgtggggcagggcctctgagtcttcccttgcccacatctgtcagtggtaaatgattaccacaggaaaacatagcagattaagtgactgcactgtttcttatggctttcggcatttgcaccaagggatgcatgcactgcgagaatcgataaaatctccagaaaggacttgtagtgacacacggtaacaagtgtcacatgcacagtgtgccttctgctgcagactctcacatacgctcccgtatggcactcagaacagtccctgagtgaagcagcagatgtgcaccgaagtgcgtgtgcctccgattcctgcacgacccttgcaggaacaaccggagtgggaaggaaacatgtcccttcagggcccttcacacctgccaagtgctgtgtaccactgcccatccctactcctctcctgcaggtgactagcctggttcacctgcagggaggagggtctgctggtcttaggtcccaggaacatatctggaagggtgtgattccaccccatcacccaggtgtt

SEQ ID NO: 1629 - DNA, 1000 bp, mus musculus
aactaagaggggggggcatggctggcgccagggagggacaatggcctgaagagggaacggggagccgcatccacagcttcccatacaaggctttcaaaagagcagctgtgggaagccagtgggcagagcccagtcggcaagggcaggggacacggggtgttctgtgccagctgcctagctgcgccccatggcaccccagtccacctgctgcatcaggactctcccggagctgtcaggcacgtcaggcctcatgggctccccaggactgagcatcctaccattctcttctataaaacagaccaaagtcacctctgtttcctctgtgggtgcagagtgccaagagagtggttctctggaatgttggcctgagaatttgggcctggaaccagtgcttcctggaaaagcatgcagggatcgattagcaatgtctgacgtgagtgcagggtcaggcatgtggggcaagggaactatcaagggattggagcgttaccttgcctgcatggggttgaatgcaggactcctgtggacacccaaatctgaaggaggtcttcatgcttcttatgtagagcgtgtgtgtgggcctgagagcaatgcgcagtctcccaatatttcaaccggctctagatgactacccacacctagcatccaggaaatgtgttgcaggatcagggagtaaaagaaaaccagtctatacctcagcgcacaggcctttggagatcaaccctttcagtcccgggtcaggaactgtggaggggctggctgttttccttcttcctgtgctgtgaattttgaggtaaagtaggaagactcctgggtcaagtgagaattgtaccaggggtggtaatcgagccttgacatttctcaagccacagccacccaggggctgataaatctagcttcataaatgcaattatgaaatgctcactaaggtggcccttgttattctggaacccagagctctagttggaggccagcctgggctacacagtgagatcctatc

SEQ ID NO: 1630 - DNA, 1000 bp, mus musculus
tgtacatacatgtgtatgtgcacctgtgtgcagatgtttgtataccactgtgtgcatgtgcacatatgtgttcatgtttgtgtagttctttttgcatgtgagtgcatgtgtgtgtgcatgtgtgtgtctgtgtacatgtgtgtgtgtctgtgtacatgtgtgtgtgtgtgcatgcatttgtgtgtttccagaacgttcctcccctgcctgattaaagctcagcggcagggctgtggggtagagaataccaactctatgcaccaccccagcacacattgcctgaggatccacctaggacttcatatgcactctggttcagtgagaattccacacgctggaagccaagatcacacatcaaaggggaattcctccttgagtctgtttgccagatcagggctctgcaggggcagaagctctgcctcctccccataagctaagaccattctgtttgtggcacctgacacctctgcctgttcaggtgacactgagggacaggatgggggacacagcccagtacagaacttcccacagcctacagcctagtgattcccatcagatggtctgagggtgggtggaagacaatgcaaggtcctcaccccagtgagctcaggggcagaacgggacttcgggtctccaactaaggctaggggctggggtcacactcacgtgccgctctgcacacgcacggaagacaccttttcctggtatccatgggcatggaagctgggcacatcgtcgtctacaatctccatcttcttgccagtaaagttggggttctcatataagatgatcttgtgctcttggctgtcctgtgaacaaagcacggtgggtgaagcctgggatgcccctcccatcctatcccatcctccactcatctctgccaatatgtccacctccaggtgggactagggtcccctgactggatgcctaaggagcaactgtcatgggacagccaagctcgggtcctgtgctggtgaaggttttgattctgagactccag

SEQ ID NO: 1631 - DNA, 1000 bp, mus musculus
cagctgccatctctataactccggcccttttctcccacaggtctgagtcagccaggggcccccaagacacagatttttctgaatggcgcctgctccccgtctctgttgccagccctgccttccccggtggccttccctctgccagtggttcctgactacaggtgagaggggctgccgacaagcccggcctggcaccgggacacacagtgggggggcagtcagtcccctctttcatgttgacattgtttgttacctagttatttccaagacatgagtgtgtgcacatgtgtaaagtgtgcagagaactgtttcttgggcctccagctaggcagtcaacacaaaccttagcacttggacgcatgttgtactcagggcacatccttgaagttaacagccgtagttaacaattaggtgtgcctgtgaatgctcacactcacctcctgtagtgtaacacacagggctctttaagctttggctttgcctacaaaccccaggtctgtcataaacaattggtgtttttcccacccatcagctcctccacatacctcttccgcttgatggcagttgtcgttcaccatggagacatgcactctggacactttgtcacctacagacggtcaccaccttctgccaagaaccctctctcaaccagcaaccaatggctgtggatttctgacgacaccgtccgcaaggccagcctgcaggaggtcctgtcctctagtgcctacctgctgttctatgagcgagttctgtccagggtgcagcagcaggggcgagagtataggtctgaggagtgacaggccagcccagagccagggcccatggtgaggtccacactgtccaggataaaagcaaaggcatgccacgtgtacacgtgcaagccagccctctagagccctcagccttctgtgtattctgagagcaggctccacaagggagccagacccacacagcactgccagggtgaactggaagatgtcctgtgtgtctagagcgtctt

SEQ ID NO: 1632 - DNA, 1000 bp, mus musculus
tcttactttccattcaatgtcaccaggcagatggtgctgtagtggagacattggtgcatgggtgagtgtcctcccctccagtgctgggcaggctgctgggagctccacccgtgctggaagcactgcacttgccacatctcttcacaagggtcagatagggtgggacgcctgtgagagcaagggcactgactggttctgtccctgacgcttgtactttgcaggggctgggctttagtgcagactgaactcatagggtcccccaactgcttgtttaccagcttccccaggcaaaacagtgtgcgtgaagacctggaaggacctgttcccgaagcaggctgagctcactatgtgaagcaggtggacgccagaagcagaaacggaagcagaaggaccatctgcatctccctcctggtgtgaagtgtcagaccctgggaccctccccatgccccagtggagttggctgaaggctcatggctgagttcctccccaggagctagaactagaagctcaggtttagttatctgggatgtctggacgcgtgcagagactcctctactacaggatgtcacagttgctttaagatgctgctgtctggacacagtgacactcccctgtggctcctgcctactccataggctgaggcaggagggtggcaagttcaaggccagagtaggtgacttagtgaaaccctatctgacaataagatagaaacgggctggggacgtcgtctggtggtggtcacctagcacatggggccctgggattaacacctcagtaccacaaagcaagcaagtaacccacaagtgggaactatgtatctttgaggcaaggatgcagtttttagtgtttctcaaacatcctcggctgtggaacctgcttcctcattgtgtatttgatagggtgggtgctctgctcaactgctctgggacactctgggcaagatgttctgtttgcttatggtgcttgtttattcatgcatgtatatgtttatttattcatc

SEQ ID NO: 1633 - DNA, 1200 bp, mus musculus
catgctccttaggaaatgaaagtctggactgggcctcatcaataccttcagatccttggcatgtggcaaattctgaacagaaccagggctccccaaagtgctgtcaggtattagaaccacactcagggagactgactccgggagatctaacctggaggatcctccaaaccaaacactgacagaggccggatgactgtgattcctggcgagtccatgggaaccaagagcatagattgttgctggtgccttggggcctgtgggtctgtttttcccataaacacacagagtttgcagtgaggatgcaggatgcctgtcaggaagaagagggacagagcctatcagtggattccaggactatggagcctctgaccacatggagccctggcctgtgaaaagcaaacctatgacctgatagatctacaggatcagagagccaagtacaggccccagaacggtgatcaatccacagagtcagagatgcacatggggccttcagaccagacaaaacttatcacagggagatgggaacctaccacagtcacggtaggagcaatgttttaactttcatgtctaagtgtttgtacatgtgtgtaatgctcacagaggccaggagaaggtgtcagatcttctggaaccagagtcatagatagttgtgagctgcactgtgggtgagtgctgccagtcttctgccaaagtacccagtgcctttaactgcctggacctctgtccatctccatgagaaaccaagtttgaaaactatcatgttagacttaaaaaacagaaacaagataccaaagcaggtgttcacagtgcctctggaattctgagctccacatgaggtagtgagccacatggaggatgtccaccatggaagagacaaaacagctcacaaatccatccccaggggagcaaccaagatagaactggctacaaaagcctccgaggagagtgcgccctcttgtggacactggtggttgtacactgaggacagaggccctcctggaaataccacatagacctctgaactgcttctcaggcttcccttctggtgtgtgcttcagaaaactgcttcagactccaagagagctctgtgcttccagcaggccattgttgtgttttctgggaggcctggaagcttctctggctggcctctgtgagaatagagtgtaacatgtagtttggagagatggctcagtggtt

SEQ ID NO: 1634 - DNA, 1000 bp, mus musculus
atatataccatacacatatgtatacacatacatacacacatacacacacactaacatacatacacctaaacacaggtatacataaatacatatcctacacatagcacatgcacacacacatacatgcacatacacacacacacacacacaattatgagtgtgagctgcagaagatacagcttctctctaggctcagccagcagcccacagaataatgctgtcagtctgggtcgcggagagagggacatgattcaagtcaaccccaggtgaccgcagcacacggagaactcaagtgaaccgttaccttgctgctttctagcctttaaccgtggaactctttgttaccacagcctttcccctactagtgctgactaatacacagggtaggatgcaaggctggagacctagcttgtatgaagtcacactcagaaagtctgtggggacaattagagctatgcaatgtgacaccacattttccccccagaggtggggggtctcccctcaacccaagcccgcaagctcctggcttgcaaaccccttcaatcaaagtcagtttcaaggtctccagctctctaaatgatcagctcggttgccgcgtgcgttaacggccccgtctgtccagactgcctgttttatcagaagctgccaacaagataaatggcctcgtaactcattgttccggcagagtacctcacggcgccggcgccaggaataaatcacatatgatcttctccaagccgtggagcaagcgtgggaggccgggagctctgcatggccagggggactttgcagaggattacagagcttctgtggtgtgcctcgggctgaggtctgctgctggtgacagttctcttcctcccccctccaacccccatctctaccagcttctcatccctcagacaagctctgaggccggagtgtatgtgtcctgtgcactatgatgcaggtggagactatatgaggtcccttagtggctgggcagatgaacacagcattgttt

SEQ ID NO: 1635 - DNA, 1600 bp, mus musculus
gcctcagggaatccttctgtccccacttccctgagcttgactcacaagcccacagcacacacctggttatttatattggccttggagatccgcactcaggtccttaaaaaccatgctataagtacatgactctagcctgtctccccatcattcaagaaaaaggaaacattgatggtatcttaggcaggcggcgtctgaatgtttatgttgatgtgggctcaaacaaatgacttgctctgtttcccctgagcctgtgggtctctcccaggagccttatggagccctgcgggatgaatttcttggtcatcactctggagaagtctcttacagaaaactgtgtccaaattcacgtatcctattgctactacctgggtagttgttcccagtgcatagaaatgagctcactctctacccttcctgaaggatatattttggaagatgacagtctttttttttgctttttgttttttttgtgtgtgtgtgtttttcccccttgggggtcctctaaatagtggagccaaatagagtgagttgtcagatcaccaagcccagggctgcactcagacaggctttgctggcaaccctgggatttaattaagtggccctgatgcatttgctatggcttctctgtctgtgtttgtaatacactttgttgcggcttgaggatggatggagttgtctgcaaggctgtgtgcaggccacagtgtcaccccaggggttgctgcaacaccgacagagtcattagcactctctggagcgatctgtgtatttgtctctgagccatttctgcacatcaggtctggaacttagaggatcatcaaatcaagtgtggcgtctggagagacgggactttgtgactttcacagaacagagtctgggggtataaacagccggaaagggccagatgccttctgcatctggcgagagtggaggacctaacacaagttgaagaaagcaggggacagccttatatgtgtaactgagtgagtgtctatgtgtgtctgtgtatgcagttttatgtgtatgtattaatgtgtgtctatgtgtgtttgcatgtgtctgtatgtgcctgtgtctacgtgtgtttatttttttctctgtatctacctacatgtgtctctatgtgtctgtgaattactgcgtgtgtgtgtgtgtgtgtgtgtgtgtgtatgtgtgtatctgtgatatgccttgacttttattattagtggtgagattcaacaggtattccagcagccagggttgctgtccataggcacacgacaatgcatctgtggttcactgtagagcaacagagaagcagccatagggccatgtctggctcagaaaggtgtaggaatatgagtgtgtatgtgtgtgtatgtgtgtgtgtaaacatgtgtatgcatgcatgtagaggggcagaggttaacactggatgtcttcctcaattactttctgttatatataagacatactctcttactacacttccggttctgctgcccagtgattccacttatctttgtctctgcagcagtgggctatgggtgctcgcctgcaatgttctggtttttacatggattccaagagttcaaactcatgttctgcatgcttccgt

SEQ ID NO: 1636 - DNA, 1000 bp, mus musculus
ctatctatctatctatctatctatctatctatctatctgccaatcagtatgctatgatgtctgtatggaggtcagaatataacttgtagaagttggttctcttttttcactgtgtgggttccggggatcgaacttaggctgccagacttggtggcaagcacctttacccactgagccacctcacagggcccaagcttctgttttctaacatcaatccttcctcagcccctcgaccacattttatttcaaggtgttgggtgcagggtcctggcggagccggttctaacgtccatggatgcagaagcttccaagtgggttttggccacggtgagaggcccatactgaaaaggcctctgaatgcaataattgaatagacataattacaaggcttcatgccatgtgaaattgtaaatagactgacaatgtaatttgcactcatttatgatacagtagctcattaaggctccaatttccatccctttcattaacaagctcatctgcccctctgagtgaggccccttttgtgtgaggtgtggctctctgcccacagcgatgcccaagcgagtgcagaagcactcttggtgacagtgcagtgagtggccaagtggtatcctcagggtgcttatccgtcagcaaaagagaaacaggtgcaaattatgggatgtctctctctctctatgtatatttttttatttgagtacatctattttgtttggatggcagagaattcttaacattaaatataagctgtgggatgctaatacaccttccacaatcatagtccctgtgccatggtttcgtggggagaattaaatgaatggccaacctgcatgctaagcgcagggcatggtgcctggcagagcgagtgcttcagagatgtttgtaagggagttgagtgctcagctccacctgcaaaccaaaccttcctctgtagaaacagaatagtggtcagcagggttacactggaaaaagggagtctctatgctgccaaggctggtgg

SEQ ID NO: 1637 - DNA, 1400 bp, mus musculus
ccctgtaaggcattttcttattagtgattgatagatgaggccccagaccactgtgggtggtgccacccctgggcaggtggtcctgggttctataaggaagcagtctgagcaagccatggggagcatcccagtaagacagcacttctctatggcctctgcatctgctcctgcctccaggtttctgccctgctttaagttcctgtcttaacttcctttgatgacgaacagtgatgtggaagcagaagccaagtaaactctttgctcctcagcttgctttttggttatggtgtttcatcacagcaatgaaaaccctagctgagatgtgtattataaagaacgttttaaggaagcagagtaaaatttaagttacaaaccaatgagcagaggaatggatcaagaccactggatcaagccacacctgaaaggaactcgacacctgtatactgctactgggtaaaacacttgacggccttcctggaaggattaaattgagtctcaatttcatcacttgtaacagaagaaacttgacaaaactttttgccctgtctccttgcccctccatccaacgcttacattgtggttttgtgtttcataacgctccaggaaaattaggacaaagaacattgccagaaccattcccatgccagttctgattatatgtggacccagttcctcccttgggtcagccatctgtcagccacaggccacgtcaggtcgtcagctgttgggatgctaattaagcatctgctgttgccattctacagggcatggtcctcacagaccatgagggtgagtgagggtgccatccccggctctgcagagtaggcgcccaccttctatagcatccccagtgggcaagcaaattcttggtaagcctcacataacacagctgtgggatggagcctatcaaccctgtgtgaagattacattgtgagtctgaggctgagaaaccatacgctcttccttgtttggaaggaactttgttccatccaacaaggttgtagaacatccttggtaagagctaaatcagacaaaagctgtgctgacctgccatttactggcactggctttttgaaaaggtcattaagccagaagtgttgaggtctcctggaaattcttttgacggggttctctaggggaataaaaccaacacagaggagttatcaggctggccttcattggttgtcactccacagagcacaccagtatgctggatagcagagcatccaggaccttttcagtacaagaaatcaacagcctcagaacaagcagagaaccaggcaggcctggtccaatgatgaaatggaggctccttgttgagctggttgaagcttcaatgttgagtctgtctgcactggctggttgaagaagtggactagtgactgaggcctgtaggtccc

SEQ ID NO: 1638 - DNA, 1000 bp, mus musculus
tgactgtgaactccaatccaccggcctcagcttcccagatgctgggatcacaggtgtgcaccatcatgcctggtggacagagagctgggaactgaaccagtggctttgtacatgccaggatagcatgtacattaactcttcccgttgagctacactccagctccagggatctgacttcaaagtacatgtttatggcaagtccccacttgagcacaaaagcaacaagcgttatctgcgtgtgatggtgcacactaatcccagcactcgggattggagatttctacaagtttgtggctaccctggtctacagagtaaactccatgaaagctatagatatgtagtaaacccttatctcaaaaataatccaaagacctcatccctcaacacagtgatcaatgttcaatatttaagaatttagtccagatctgtagcttgtgggtactcttctgtcccagctccccactctctaacttaaaagtgatgtcgtgcttcaagtgccagggtctgttcctgagaggtggttccctcctccccttgttccgagcaccccaattgtgggattggggtaaagggagagaagcaaccttcaaacaacatcacattaaagctgtttccttccattcccttccaggagcagcaatttattcagcgaggtcatgcagatgaattttgaaatcgccagcttcagcagcctctcggggacacagcctatcacatggcaggtggagtacccgaggaagggggccacggacattgctgtgtcggagatcttcatcagccagaaggacctagttgccatcgtcccccttgctatggtaagtcacaatgccactactgtgtgcttcctctttcccaggtcattgctacaattatttgattatttgatatataagtgacttttcttcctccaccctaggattgccaacatcacctttcattggctaagtttcccagataatgcgtcatggtactagctgcgtctccataccaaagtccttgt

SEQ ID NO: 1639 - DNA, 1200 bp, mus musculus
cggctttcgggctggtttgtcccctgggaatgtgacggtgatctgtgcttttccaccaggtgccgatccccttgccacagtcgagtctccatggcctgaccgtgtcttgacaataattttgagcaaaatctatgtctaataagaagataaccacatcaagatggttgggaagctgaagcagaacttactcttggcgtgtctggtgattagttctgtgaccgtgttttacctgggccagcatgccatggagtgccatcaccgaatagaggaacgtagccagccagcccgactggagaaccccaaggcgactgtgcgagctggcctcgacatcaaagccaacaaaacattcacctatcacaaagatatgcctttaatattcatcgggggtgtgcctcggagcggcaccacactcatgagggctatgctggacgcacatcctgacatccgctgtggagaggaaaccagggtcatccctcgaatcctggccctgaagcagatgtggtcccggtccagtaaagagaagatccgcttggatgaggcgggtgtcacagatgaagtgctagattctgccatgcaagccttccttctggaggtcattgttaaacatggggagccggcaccttatttatgtaacaaagatccgtttgccctgaaatccttgacttaccttgctaggttatttcccaatgccaaatttctcctgatggtccgagatggccgggcgtcagtacattcaatgatttctcggaaagttactatagctggctttgacctgaacagctaccgggactgtctgaccaagtggaaccgggccatagaaaccatgtacaaccagtgtatggaagttggttataagaaatgcatgttggttcactatgaacagctcgtcttacaccctgaacggtggatgagaacgctcttaaagttcctccatattccatggaaccattccgttttgcaccatgaagaaatgatcgggaaagctgggggagtttctctgtcaaagtgagtaaatgtagtgttttctctctctctctctctctctctctctctccttccttccttctttcctttcttcctttcttttttgaaccctgcattcagctgatgaagatatggacctgtgccacttatggctgctcttgccagcacttgggaggcaggagcaaacttctgtgaattcaaagccaaccaggtcta

SEQ ID NO: 1640 - DNA, 1200 bp, mus musculus; identical to SEQ ID NO: 1639

SEQ ID NO: 1641 - DNA, 1200 bp, mus musculus
tctctctccatttctctctccatttctctctccatttctctctccatttctctctctctctctctctctctctctctctctctctctctctctctctccctctctctctctctttctcagcatttttctcactatggtattgagggaaaactcatggactatataataatgggtattttcttccccaaaatgaatctgccattctgtgttcagcctctcctggtgcagttccccggtgccactgctacatccattctgagaaggcagtgtaaagcctggaacccgtggtctccacagtccacttcttccctctggggcatcagacatcgctgtataccagaccgaggagggtgaagcggcgtctgggacaaattgggtccacagggttctctggtcagtcaggaatgcgaaaacgttccagctcatatgagataaataaacaggttcaggcgctgatgtggggcaggtggccggggcttcaagtctgggcgcagcttcagtggtggcagagatgtctggagcctgagcttccatgtgagctacaggagcttcgccaggtgggcgggtccaaggttcaatgatgagtgcttgggtcggggtggagggtgctttccccaagtgttacagctcagtaaaaccagtctcagatgatccttggttgaaataacgtctgctctttattccatgtggctagagtacattctattggctgaggctaaggctctgaggatgccctgtttgcatggggaagagctccaggtgctgcgctatgtgactgactgcttgtgatcacctggttaggggttctggttaagtgcaggcatggaaacggggatggagttagctctactcccaccagtctcaagttctgagatttcagggatttaagcatggtccacctcaccattcccatgtccattcctctggtggcatggtccacgtgcccctatgaatcttgaagtctctgttagtagtgtgcttattgtacaagaataaggattccagtttaagcccccaacatccatgtaacaagtttggcatagaggcacatgtctataactatacactcaggaagcctaagatgggcacactccctgggcacaggggccatccagcccatctaatcagggagcaccaggtccagtgtgagaccctactgaaataatgtctaggtaactgaggaagacacctgatttgacc

SEQ ID NO: 1642 - DNA, 1000 bp, mus musculus
tcacgggtagaggagccacgatttaaattagtggcccaaagtggttactaaaaagaaactgcagggcaatctcacacagtcagcacggggctcccagctgcattcatctctagaaaaccaccccccaacggagtgccagagtggctccaaaccccacccctgggctaactgagcccctggctgtccctaagaaagggcaccctgcagtttgctttctcctgcctccgcttgccccttgctcctctggcctggcctccgggagttaagatcccccccctgcctccagctcctgcttccctaccactcaggggttaatgcttttgaaagctccctgcagggttcggagtgcagctgttgctgccatttggacattttctttctccaaaagcctcagctgccttttggaaacaaccacagtgccatctactggtcaaagctgcgtattgtaccgcgatgccttaagctttctgaaggctatctggaggcagttgttggctgcctgaggtgtgacctcactacctacatgtgcagtaggagttgtggagcgaggtcctaattcccacgtgggatttctaggatccctgagcaggtaatcaagaacctggactctgagaggaaaaaggaatgaactgcttggggcctaggatgtgaggcctcaccctctgataaggatccaaagggctgacatgaaagatcctgcctgggctgcggtggatctctaggccgaagtggaggtctagactgggtggagcactaggctgggggtggggctctaggctaagggcggagttctggaatgggtgggaggagctctctgaattgggagtggagcacaaggctgggggtttagctctgggattgggtggagctctgaggtagaggtggagctctgggattgggtggagctctgggattgggtggagctctgggattgggtttagctctgggattgggtggagctctgggattgggtggagctctgaggtagaggttgaactct

SEQ ID NO: 1643 - DNA, 1200 bp, mus musculus
gttacaatagagaaaacttaggtcctagagagtccaaagtcacttggcctggaaactaccaattcctgtttccactcagtgtcctgatgtctggccaggggtctttctccctctgccaaactgttctgtgaacgactcagaaagcaaatgggtttttgtcccccaaggttgtgagccaattgaagctagaggatctgtgaaagaaaaaaaaatgttagagactaggaccactgcccaagtcccttcagtgaggtcagatttcctgtaggctgcagaagaaaaacaggcattagcccagagaaatggctgacctaacgcaacagcctccctcaagctgggagctttgccatcatccagctctgccgagcacagcacacacaccccagccctgcaaaacccagggcaagagtgtctttgaactgagggaagctgctcaggggaacaaggggtcctttggaatcagggtcctcttgtaacatccactggcctcttggctttggcagttaggatgaagtcctctaccactgagaggtctcgaagataagacgcagccagttggcacacttccaaacacagctgaaaacagtctacaggggcccatctggagccaatcagtcacactgaagtgaaaaatagcagatgtcagagtatgccagccgccccgggaaaccccagtcctgccaccctccactatggcctcacaaatcattcccgttctcatcgctcactggtgccaggtggcctctcggcttctggcttccctgctgccccagagacccagttgtggctgcaaaacagttctcaagccggaaagaaagcctggagtctccgctaaagaggatccaagagggttccaagcgccacgtactcatggggacatttgagacatctggttcaattcagccttttactattaagaattatttatttttatgtgtatggattgttgcctgcatgtgtgcatgtgcatatatgtgtgcctgaggtttatggaagtcagaagagggtattggatctcctggagctggagttacagaccattgtgacccaccttgtgggtactgagaatcaaactcaggtccgctgtaagggcaacaaatgctatttaacacttagctaactctccagccccaactccacctttttttatggacaaggaaactgagccctcaccagggaaggcaactctaaagagtgatc

SEQ ID NO: 1644 - DNA, 1200 bp, mus musculus
gacagggtggtttttccgtgtaggtctggctgtcctggtacttgctctgtaggccaggctggcctggaactcacagatccttctgtctctgtctcccaagtgcttggatcaaaggtgtgcagtgccagcactgcccggcttctttatgttggtgtgtgcgtgtgcacctgtgtgtgcatgtgtgcatgtgtgtgtgtgtatactgtgtgtacatgtgtaggtgtaggtgtgtacctatgtcatggtatacacgtggaggtcagagaagaacacacgggagcaggtctcttcttctccgcagtgggtcccaggaatggaactcacatagttacatttggcagcaaacacctttattccctaaggcatctccctagctctgtccttgggcttttatttgagtgtttgggatttgaactcaggtcctcaagtctgcatagtaagcaccggaccacccaagctactctccagtctcagaggttttgtgttcgttctatacccagacctcctctctgtcctcacttcaccagatctatgtcctacatcagggttacttggaataaattaggagatccgatgggtacgtcctgctcttctggggaaattctgagcctgtagctgcccagagagggcatagtgtcctccagttgggcctgcatggcccacccaccccatgcctcccagactcctttcctttgtggggaaagctgtttattcccaagggtttctcacctcacaccagagccagcccctgaaggcattggcgtgtcataaaccagcctgaccctaatttatctcatcaccattccggaactggggaagggaatggctctccaaggttgggtggaaggctggcaccattgacctagcctggacggtgaccaagctggattcgaacctggtaccttcccctgctgagacccagacaaagagcgagtgtgtccaaagcgtggggttggtttcctgctttgagtgtgccaggatttccaaaaccacataaagtctgtgccctccctgccacagagctgaatggcttcacgttttcttgggacgtcaccccgagccatcattgggagcctggaacatacatggtttggagggtgggcaccccacggtgtctgcttagcttcacaggcctctgctgtcctcaggaacagcccttaggcacctccaggctctaagcagttcagatgggactgtctc

SEQ ID NO: 1645 - DNA, 1000 bp, mus musculus
ctcactcaaaaagaaacagattaggggccagcaaggtggtttattaggtaaagatgattgcctccaagccttacaacctgagttctatcccctgctgtcacagcccttgggaggtggagggtggcaccttaagttcatggccaaccttgatttcttagggagtctaaggccaggtgaggtgctctaggcctgtcatctgagggtcatgggctcactgaggtctttcagttcaagggatacttttggacaggtcagaggtaagggagaaaagcatcatgagggagggtgagatggcccagtggctcccagaagtagttggtttttataacagagatggaccaaaggtccaggtctacaacaggtttctctagaaccacccgggttgtccccgcctgacacgcacaagggagcagggtcagggatcagggatcagggtcggagactcctgtgccattctcagtaaccctgacctcaccatctcccaagtagtgggaagagagagctaaaggaagttccagctggtggggcaaaggggatgggcaggtggaggaaagagagtggaccaggccagggacaggctgggggacaccacaagacacaccaggctgtcagtctgtccagcaagatcatttctatagagatcttcatgttgactatgctttttggagggtggtgtgtgtgtgtgtgtgtgtgtgtgtgcatgtgtgtgtattatgaatatgtatgtgttcatatatatatatatttgttggtgtttttcgttttttgagacaagaccacccattggcctaaactagccaaggtaggctaggctgacagtcagagagcctcagggtcctcgtgtctctgcctccctgttgtaaatgtgcaccaccaagcctgactttttttttttttaaagatgttatctacttctgtgtacgtggctgtgactgtggctgagtcaatgtgtgtccaggtacccgaagaggccagaagagggcggtagatccccttgcag

SEQ ID NO: 1646 - DNA, 1000 bp, mus musculus
accctcttctctgttcaggcacgcatttccacagatgtctgttgccctctggttaattacggctctagtttaaaaaaaaatggcagcaacccaagttgggttatggccactctgcaatgagagctgggtgtgcagtgattgtatagcctgctccagacccttggttcaaccgtggtgtgggttggtgggtgggggagggtaccaccaggaaatcatagaatagtcacactgtggactaccatgctcaactcagaaagaaaaggcatgaacaccaggtgtgtggcacatatgctgtcttgggaggtggaggcaggaggattgtgagttccagacaagtctggagtacatagtgaaagggagggggaagggatggaagaacttaagtagaagtaggtcactggggcggatcattgtcccaggagatgtctgtctctcttccttggtttcctagtctcctgttccacaccatcctgtggcgatgctctgagccctctgaaacagtgaactcaaataagtacttttcccttcggtggtttacatcggggatttggtaactaatacacaaattgaggtttagcgggagatctttgaggtatccgggccatgcacacaaagacaaccccaacattttaccccttcctcccacggacccataaagtaagcaacagcttcctctatcctgtcgctctgagatgctccacctcaccactgatccagaaacttttgtcaagatagtgaacgcacatgcccacatgcatgtggaggccagaggccatcctgagttcagttcccagtaggtatgtaagtaaggcagggtcagaatcacctgtcaccccagctttggagaatctggctccccacttctgacctctgtagataactgtattcaaacatatactctcccatgcacacacacacacacacacacacacacacacacacacacacatacacacacacacacacacatacacatacacacacacacacatacacacac

SEQ ID NO: 1647 - DNA, 1000 bp, mus musculus
ttgggactatgtctttataggaggaaatcgttccctgggcacggtgggctctgtaactgttcaatgaaaggagacagcgtgctgaggcagactttctactcctgacccatgctgaccatttaagttttagtggaagtcaaagggaacagagatggtgctggcttccctgagggcacctgtgaaagctgtcaatccctgggcttcctggcctcacacgccatacagaccaccgtacatgcagaaaccttcctcgtagctatgtctgtcatggttcccgactccacacctccccagccaagttttcaaacaggaaatccccaggggctggtctgccttcagtagcatcattgaaggctacgcctgcggacagtgacccagggaagccctaactgcaagccgtgtggaaacacggactagaaacaacaaacggaggccgtgtgagacagagagctgccaagacaaaccgagcgggtgtacgagggatgcaagagggctgcctgccaccagctctgctgggctccagccaggagagcagagtcaagaacacatacgtgcagggagacacaactgcagctgagcttcatacgggctcagcttctaggaggtttcaaggcaaggaagccctgaggaggtcgatggagggctagccagctaagtacgatggcacatgcctatagtcctagcacttaacgaaatgaaggcaggagatagtatgtttgagaccagtcagcctggataatgaaaccctgtctccagagggcaacaaaagacatggagacacaacccagcagttaagaatgtgtactgctagccgggcgtggtggcgcacgcctttaatcccagcactcgggaggcagaggcaggcggatctctgtgagttcgaggccagcctggtctacagagtgagttttagaacagccagggctacacagaaaaaccttgtcctgaaaaacaaaacaaaacaaagcaaagaatacacattgctcttaaaaagtttggt

SEQ ID NO: 1648 - DNA, 1200 bp, mus musculus
cgacattcttaaacagcctcctttccagaactagccaggctgacccaaacggaaagaatccaagcttgctatccagaggtccgcctccttctggcagtatccctagctccctccctaactccctccccggagcacagcccctaggattcagccgagaactcactcctctatccgggctaaactcgatatcctaccatccacctcgagctcctcatcccagctctccctctgaagttttggtgagtgctgcatctgtcttcagtcctttgttaagggtcttctgtgaacccctcaagtctccttccagaaattcaaaggtccctccaccggttccagcctcagcttctttaggcactcaccaggccataaggagagcagtcagaaaaaaccaggtcaggctccccagccaccgcccggctccttggatcaacttgccccacaaacttttctcagcacccagactcctccccctctcctccctttgtcccgccggtccaagcagccacttgcttgcttgggcattgatcagtctctctgggtctcttcccctccctgcccctttaccagtccgctggggaaagatcgcctagactgcctttgaaagatgtcacttctaccctcctttcaagtaggaatcaattacatctttttcttttggctttccacaaaacaagagatttattcaggtgaagagacagggagagagacagagaggctgccaagaagagcagctcttgccctgaaggcaggagcagtggtgtgtaatctaaggaggcctggtgttctgcacattttacagggacttcctcatgtaatttgtttgatctccaaattgttttttaatatattaagatactcagacctcaggcttgggaaatacggggttgttctttagagctgcttgctcccaagtgacagactccaagaggcaagaagcaggtagaaattgggccagttacagatgcccagggaaacatagactggaggaaaagcacttgttgcacacgcgtgcggacccaagttcagatcccttatagccatgtaaagacactgggctcggtcacaagcacatcttccctgtgattccagtgatatgggaggataaaaggatcactggagcgttctggctgccagcctagcatccgctttagccagaatgccagtctctccagggaataaggcagagagatatagcaaaac

SEQ ID NO: 1649 - DNA, 1000 bp, mus musculus
atgtttagtagatattttctttatttacatttcaaatgttatcccttttcctggtttcccctctgaaaatctcctatcccctccggctccccctgctccccaacccacccactcccatttcctggccttggtattcccctgttacactggggcatagagccttcacaggaccaagggcctctcctcccattggtgcccaaaaaggtcatcctctgttacatatgcagttggagccatgagtcccaccatgtgtactctttggttgatggtttagtccctgggaacttgttagttcatattgtttgttgttcttccgatagggctgcaaaccccttcaactccttgagtagtttctcttgctcctccattggcaaccctgtcctcagtccaatgtttggctgtgagcatccacctctgtatttgtcggacactcgtggagcctctcaggagacagctataacaggcttctgtcagcaagcacttgtttgcatcaacaatagtgtctgggtgtggtgactgtatatggggtggttccccaggtggggtaatcgctgattggtcattccttctgtctatgttccacaccttgtgtctgtaattccttccatgggtattttgttccccattctaagaaggacaaaaatatccaccctttggtcttccttcttcttgagtttcatgtggtttgtgaaatgtatcttgggtattccaagtttctgggctaatatccacttatcagtgactgcataccatgtgtgttcttctgtgattgggtacctcattcaagatgatattttttagtttcacccatttgcctaagaattttatgaattcattgtttttaatagctgagtatctactcctctattgagggaaatctgagttgtttccagcttctgtctattataaataaggctgctatgaagcaggatgcacatattggagcatgtgtccttattacatgttggagcatcttctggaaatatgcccaggagtgata

SEQ ID NO: 1650 - DNA, 1000 bp, mus musculus
ctctgtaatccatcttttttcccaaatttttattaggtatttttttcatttacatttcaaatgctatcccgaaagtcccctataccctccccaccctgctcccctccccacccactctcacttcttggccctggtgttcccctgtactggggcatataaagtttataagaccaaggggcctctcttcccaatgatggccgactaggccatcttatgctacatatgcagttagagacatgagctctgggggtactggttagttaatattgttgttccacctatagggttgcagaccccttcagctccttgggtactttctctagctcctccattgggggctctgtgttccatccaatggatgactgtgagcatctacttctgtgtttgccaggcactggcatagcctcacaagagacagctatatcagggtcctttcagcaaaatcttgctggcgtatgcaatagtgtctgcgtttggtggctgattatgggatggatccccggtggagcagtctctggatggtccatcctttcatctcagctccaaactttgtctctgtaactccttccatggtgttttgttcccaattctaagaagggacgaagtgtccacactttggtcttcgttcttgagtttcatgtgtctgtaacccatttttaaaattgaattatttgatgtattttaggtgttatatttttgaaaatctctgtctatctatctatctatctatctatctatctaattatctatcatctatctatcttatctatctatctatctatctatctatctatctaaattgtctgtctgtctatatattttggatattagccctttattggatatatatgtagttggtaaaaatatcttcccattccataggcttccaatctatctgaatgtcagtgccctttgttgtgcagaagcctttcagtctcatgaggtaccatctatgaattgttttcctcactacctgtgctaatgatgttttgttcagaaa

SEQ ID NO: 1651 - DNA, 1000 bp, mus musculus
ttagtctagctggccaacttgcaccagggatttccccgtctttgccttctaaacgctgggattagggggcggcttccacagccactcatgtgggttctgagcacctgaactccagttcttatgcttggagcactatgactgagtcctctccccacattctggctgttttgagccagggtcttaccatacagctcaggttggctgcaaactcactgtgtactccagtcaagccttgaaccttcgatcctcctacctcagcttcccaagggcctaagcattcagccctagctttcacgctttagggcaaggcctcaattctcctattccttaaaaagccatcatactggagggattggcttctgttatctgtcttggatatagacacttccaacataccattgtaatactgagccttgcttgcagggctcagaaactaagttgggaccatctcactggataatgttttatgaagcagggctggtgagatgctcaacggataaaagtgccaggtggtcgaggctgacaagctgagtttgaccctggaacacagactggaaggagagcaccaattcttgaaagctgtccttcaacagccacatatgcagaaggcagtcacacatccacatgcaaactgtgctatacacacacctgtatacacacacacacacaccccaccccatacacacgaaaaactattacagaataattttgggggtgtatagttggagagatgactcaataattaaaagcacttcctactcttggagaggaccggggttcagttcccggcactcacaatgtcagctcacaatcatctgcaactcccactctgagagatccaacaccctcttctggtctctttggaaactgcatgtgtgcacacatgcacataaataaaaataatattaaaaaatattgtccctacgctcaacggcacatcctttatcattaacatttgagcactgtgctggatagtttatgtcaacttgacccaagctag

SEQ ID NO: 1652 - DNA, 1000 bp, mus musculus
gagctggtaatcaaatactaccccaccacaacaaaaacagtcttacaattgaactgcaatgaactcaccacaaagctgcacagtggcctttcaaagggaggacagaagatgagagtgtggacaggaaggggcatggacaccaaacactgtcctctaatggagtgtttagaaagagtgtggtaccacaacactcagagaaaggtctactcccaagcactctaacacacccaggatcataggatcagaggtgaggaggacacaacatctgtcccaccaccggaagtgacttggtacagtgggacccaggcacctgagaactccatttcaccattggaatgggttcattctggtctgagtctgtggcctgagcagacattgggcacaaactttgcagccatttccaaatcacccagaggaagctccactcacaggctctctaacctgacttcaaacacaggatcccaggatcccaggatcccaagagcttggtcacaaaaggatctcagggtctcagaggcagcttgactccccagagctctgacacacccaagatctcaggatcacaggatcccagaatcatagaatcacagagacacctggactctgaggagctctgacacactcagcatcccagaatcataagatcccagattcacaggatcacagaaacaactgaactctcaggagttctgacaaaaccaggatcagaagaaggataggctccagccacatatagccagggcaggtagcactagagatgatcagttggtgggaggcaagcataagaacataagcaacagaaaccaagatttctttgcatcaccagaacccaattctcccaccatggcaagtcctggatacaccatcacaccagaaaagcaagattcagatccaaaatcacttctcatgatggtgatagagggaggaaataccagagaatacaggtaaacagctagaagccattgaagaggaaacacaaaatataccttaaagaattaga

SEQ ID NO: 1653 - DNA, 1000 bp, mus musculus
tatcccaggtccacaccaccaggatcagctctgcaatattgctgcatgtcaggtggggctagttctgctctcacacactttggtgggtcatcgagtaccgatactaccagggccagtacaactgttctactaaggcaaggtgtggggctgctttctaaagtgatacagccagcaaggtgtggtaccagctcccccacaatgctcatatgggaccttgggccagcttgcctgtctgccacaggcagtgaggagctagggagaggcatatctcctgcactgtgcccctgcacaggaaatgagggtagggccagcttttctgaatgccatagctgctgagggtcaggcccaattctgcacagatctcagatagcaacatggccccaggaagcaactcagaccaaaggcacctgcatggccttgagtggtaaaatgaaccataaatagtgacatagaccccagctgctgcagtcatagacgcagacatcgtcctcagttgcagcatgggcagggatatcaccatggtctcaggtggcatcataggttattcacatcaggctgttcctcatcgccatcacatctccagttcctcttctcttcacagtgcacaaatggttccatttctctttcattgccatctcacatatttgttcattatagtggcacctgctgacaggtggccctctagatgtcttctgtgtgcctgccaccacatttcagttaattttctattgctatgaagagatgctatgacccaggcaacctaagaagaaagactttaacagagagcttacctagtgagacaacagccatggagcaaggagaaaaccaactgggaatgggatggcttctgaaatctcaaagccagagctgggaggttgtggatcatgcctttaaggccagcactcaagaggcagaggcactcagatctctgtgatttcaaggccactctggtcaacagagggagtttccagacagccagggttatatagtctcaaaaaat

SEQ ID NO: 1654 - DNA, 1800 bp, mus musculus
gtcctctgactgtacacacagttaaagaaaaagtggttggaatgtatgtgtcctgacgctgtaatcagacctccatgggtgtgggtcacagcctctgctgttgtactgctttagtccttgcgtctgtaaatgtgtaaatgtggcttcaatgatctacaagcattaatttaaataatcatactcagttaccagattcttgttaatgtgccttccaaggacaaccgtttgttgacaggacattaaagtaggaaaaatgaagattcacaaatctgggtctctgtgtttgaatatttttacattactggtaaaagagacccatgaatcttaacagtacaaattagtgagtgcagtgtcatgatagagatagattggaaaagaaaagaatgcttgcttgttgggtagaagagttggcaagagatggaagacatgcggaagaactatctccatgtcagctgtaggacccagccatttagttctcttcagcaacccagtgtaatgacagtagtaatgacagtgtaatgacagtagcccagattattttgatgccacacctggcactgggaagaatctactcaataagtcttgatccattagattgagttttaagaatcatacacacacacatacacacacactcacatacatacattcatgaatagtattttattacagatggcaatctactttgcacacaattgtatattttaagaaatacatctgagtgtcatgaacataaaattttaaatgagacatgggcgcgggaaatgtgtacggaagacgcactccccggcgccgctcgtggggggcccaagtccttctgatcgaggcccagcccgtggacggtgtgaggctggtcgcggcccccggcgcgccgggctcggctcttcctggagtcggattgcttgggaatgcagcccaaagcgggtggtaaactccatctaaggctaaataccggcacgagaccgatagtcaacaagtacctaagggaaagttgaaaagaactttgaagagagttcaagagggcgtgaaaccgttaagaggtaaactggtggggtccgcgcagtccgcccggaggattcaacccggcggcgcgcgtccgccatgccggtggtcccggcggatctttcccgcaccctgttccaaaaaaaaaaaaaaagaaaaaagaaaaagaaatttatattagtaaacacagaaattgacttgggactatttaattttatcttattgcttatccagagtccaaaggttgtgggcaaatgctaataacttttaattctattcgtttaataaaactaaaaactagaggtttctatatggctttttaaataacattctcagttttggttaatctttccccctatgtcctgccactgtggatggcaggagatgttagtgcagaccagccaaaagggctttttccaaaaatatacagatgccacatcactatggagcacaaaggggcccccaagtgactaccaacccttggggcacctcagcaagccagcaagagacctagaaatggcagatactctacaagctccaggcaccaaacaagcctttgcctagccagtgcctacctgcagaaggatagaggacttggttttttgttttttttaccaaaagtaatttaatttataatgtctccccaataataaagaaaatggggtttaaaattaacaaaacattttcaggatctgtgtggtcaaaactacaaatttctgatggatgaaagcagacctaaatggttagaattccatactatgttcatggattggaagacacataatagttaatatgtca

SEQ ID NO: 1655 - DNA, 1200 bp, mus musculus
gtacagtctggcataggataccgtatgtgctgaggttctgttttctttcaacttgatacaaggtgggggaagctgggaagaaggaacatgacttgagaaaatgtctccatctcattgacctgtaagcaactctgtgaagcattctattcattaatgctctatgtgggaaggtccaggctactgagggcagtgtcacccatggactggtggtatggagtcgtctgagaaagtttgagcaagctttaagcagcattgtcccatggcctttgcttcagttcctgcctttggtttctgcctgagtttctgccttgacttcccttatgatggacagtaacctgtcagatgagaccaatgctgccttttccagagtgtttttgtcagtgttctaagacagcaatagaaaagaaggctaaaatgccctaggatcagacaggtgcccctcgctcagtgctcagccagttttattcattggtgagcagaggactcagggagagcatagctcagaggaaactaagagtagagtggctgaggaagaatcctaatgtcaaattcctgcttccacccacgtggatatgggcatgaacacaaacgcacatgcataaccatgcatacacataaaccacatgtacacacatacacatacataaatcacatgtacacacaagcacacacataaacacaaacacacaaagtcttttaggggtttactgctgcaaacagatacaatgaccaaggcaacattgatctggagctggctcataatttcagagattcctccattatagtcagggcaggaacataacaacatccaagcaggcatgggcaggaggagctgagaattctacctcttcatctgaaggatgctagcagaatactcacttccagggagctaggatgagggtcttaaaacccacactcacagtagcacacctactccaaaaaggccacaccttgtaatagtgccactccctgggccaagcatatgcaagccatcacacactcacacacacacacacacacagacacacacacataacttgatcatggccaattttgagtcacagctcaagcacctcttaccagctgtggtcaactgtcaggaaggaagaagtgttgatggatctgaaagcagagcatagaagtgtacacagaaaataatcctggaatgcagtgttcacagagtctcactatggagttctg

SEQ ID NO: 1656 - DNA, 1200 bp, mus musculus
acaggtgtttgaggaagtgttgtgtcatactactcctggggagatgtgaataaatgtctacccactccagacagggaatccatgacagatcaaagtacagatgccaccaatgtctatatgggagaaccaatgagtttcattgggtttatttacaggagtatgggtgaggggctacttatagaagcagaagtgacttgaagaccatcaccaaagcccatccaaggatgggtgatagctcacaaaagctgtgaacctggagctcactgcacagcctgcaggcagcccagcaggttgaagatcgtccttacctgtcaggcaaccttacctgtctttgccttttccaggcagtttggctggtctccacttcttccaggtggcttagctggtctgagagtcttctgggaagtttattatgtctaagactgactctcagcagtccttacagattaaatgtgcttggggaaggagggacctagtgaatctggtcagtttcagggacttcctgaagcctttgagttgttgactccctgagcttgactaggcttccttgcatggtggaatgttcctcctcccttccccatccaaaacagaggattgcctcagatgaaatcgttaggggattgaaggttctgtgggagaggacctaagcttgttgggttccttgttagaatccaggtcacaggatgagttttagtacaaaggaggagacttccacataaaagctaacaatggggtgagagttctgctaaagcagtgggctcttcaacatctcctatgtcctggcacccagtggttcacttgccagggcacagcacactagatggacatgtcttcttggcattttgaatcaaaagaagcacctcactgtgtagcttagactggcctgaaatgtgctatcctcctgcagcagttatgccttgtctgctgctaacaagaactaactaactggttaattgcagaattcccaagggtcagtcttgtagttttggagtgaaatattctgccccatgaagaacaaggcagagagatattggaggattagatgtagagctgatagttggtaaaggatcaactctgagagaagaaaaatggatgcccagagaaaaactcaaaaggacaaaaaatatttttatttttgaactaaacactatatattagtctatttaaaaaatgaactaagctggggttgatgtttcaaac

SEQ ID NO: 1657 - DNA, 1000 bp, mus musculus
aaaagctggtgtcatagctgggtatcaaaccagaccctcatctttcccagcatcccacatccctacccaactctcatgcctgtggagcagaagccacacagcaccacagacgtagactccaaaccccttcccaggaaaacgggagctcttacctaggaggccggctgaaatgttcacaattagccctgagaatttggagggctccacgttcttgggtgagaggatggatttcagagaaaacttctcggctaccggtaaaaagcctgtctgtgattcactggcactgaccagctcattctgatctactcgatctagctcctcggtggttctggccatctggtataccagattaggttgttctggctggtacctgtaaagacatgcccactgcatgagtgctgatagcggcttttgttaagaaaggacacgcacatcagtctgagttctcactgtgcattcaaaggttaaggtgcctgggacacaggtcataaaccagtagaacggtgcagactctagcaatacaagaacaaaggacagatcaatggaggactggtaagctctgtctacatgccgtaactggataaagctattctaaaacgctaagttccatggagtgcgtaccgacagagcctgtgaagaatggaccctgtggaatggttgagccccacgttagggttgagcctctaatgacccaggctacctgcagatgaagcatgtgattacatgagggcaggtccttgccttcccaaccagaccgtccatcctcaacagctttgaaaagcagagtcccttttgaattgttttgaggacaatcaagtccaagcgcaagaagcgtgtgtatcaagggtatcaagctagttaactgttcttcctacagactcacgaaggcattgtattttagccaattaagaaagtaggtgggggctgaagagatggctcagcggttgagagcactgactgctcttccagaggtcctgagttcaaatcccagcaaccacat

SEQ ID NO: 1658 - DNA, 1400 bp, mus musculus
gctgtttgatgccattcgtttgtcttcctggtctccccaaagctcagggaaattaacaacagcccaggcatttaacgacaacaaactttcaagtctgaaaaaactactgtaaacaagaaaaaaaattctgaataattaattgtccgattacgtagtactgggaaacgacagaaaggacacccaaggagccccgcaaacaatcactggacaagcgccataaatggaggagagaggacagtctctggagaggcttgtcgatgtctgcagagctggacatgaagatccctgcgttccaaagactccacccccgattggcatgcacagatgagctccttgtgagaggaatccgtaggcatccgcacgtcagtatgctcagctgctacgggctgaccagacagacggctgtgtgtgctgagtgatggataggtctcgacatgatcttgggtagaaaccagtgacaatttgggatttcctgcgtgagctgtggaggagtgttgctgatgtgagattgcctcaagaggctattcgcagaggagctgcaagattccatctatgcaagaagacagagcggacgaaagctagtgtgtgtttagtaactgtcccaggtttttttgttttttttttttttcagttgctgtggtgaacacgtgaccaagagcaactggggaggatagggttcatttggcttatgggttgcggtccatcgttgagggggaagccaaggcagggacaccagcagaggccatgggggaatgctacttgctggattgctctctgtgtcttgctcagcctgctttctcattcaacccgggacaacctgcccaagggtggcaaagcccacagtgggctaccccacctcccaattaatcattaatcaagaaaaatgctcctacaggcttgctttcaagtgactcggatggaggcaagttctcagctgagtctcccagatgactcaagcttgtagacaaaacactaacaccacagacataatggaggggcgggaactgggcgggggcggggccggggttagaggctagaatgcatgggtcactctgccatggaactgtgtttcatgtgtgcacaggtcactcaacagggctcatttgttttgtggaagtgacctcagtcgtacaattgagagtgtgacacattttctgtcatgcttcagtaatatttacccatcacagattaggatatgaacccaatgaagaaagccttattctacgatgacacatgggtgagccctttttcatcatagtcaaggtttacttaattaggccacaaatggttttgatttgcgccctgtgtttagaagggagggggtgttgttttcttaagctttttctctctctctccttgaaagttgaatttttaaaaaatgactgatgatatttttttct

SEQ ID NO: 1659 - DNA, 1000 bp, mus musculus
acattcagtttgacatttctgtgtgtattttttattattcacaaaggaattacatgtacatcgctgagtatgtactgccatgtagacagaacacccttagcacattcacaagggtacttacaggatgttttccagtactatatctggctggatccaaataaattgctggatttctttgggaccttctagtaagatgaaaatggggatgaatgcacctaggattatgtctgccttcatataggtgctgggattccagaactcataacagctcttgcgagtcatctccactggtgtaaataaagattgcaggagcaggaaaagacaattaaaagtaaagtacatattagagtctttaccacacagagacaatgccctgtatctaggctgagccaaggagattactgtcttaggtcatggaacaggctcagaccacaacaatgtcagagaagactttgtatgctacagctgcctcctactgttgtttcaggcttcagtctgtgcacagcctgtggttctcatgacagacaaggacacaggcagaatcaaagttcagacaactgagagtaagtcacagtgctgagattgtcctataaatgttaccagtgtccctaaatatgctggctttgtgattttattttcctctcatgcatgtgctctggggattccataaccctggggttctgcacctgcatcatctatgctggtgaaaaacatgtttggtccttctttcttcccccacctttgtgatttcataatggtccacagtgactgcggagagcaccattgcctgacagagcattgtacggcattacaagtcagctgatttgttttgaaagacagtttgagcaggtgatttttttaaaagccgcacatggactcttcaaggcttgcactttcaatagttcatacaatactttcctaagaagttaaagttgtaatgtcagtttctagtgtctgccattcagaagaacactaatcttgtatctatcttgactccctg

SEQ ID NO: 1660 - DNA, 1400 bp, mus musculus
gtgcctttgtggtttgtggcttgtggctcatggcttgaggattggtgactttgggcccttccagggacagggttctaagacttcacatccatagatctcttctctctgatccccaccctcaggccccaagacctgccttcaaccaagtgtctggaaggagtcggaagcatagtggctgaccaccagggtgaaggtcagaggtctttcttaggaaagcacccagaggtggactcctgacattcaaaacaagctcagggaggagggagaagaggttagaaaccaggaaggaggaaagaaagacccctgggagccggggtgggggtaagggctgcagataccacaggaagaaaacatggaggaggagacatggagaggagagaaaagctaggtacaacccattgggtcacacagtgatcaggtgagaggtgagggtccagcaggccccttgatggagagaaggacaagatgggaccacacgtcagtgtgcatctgatgacaggctctaaccgggagccttggcttgaactagcatccagagccaatggattctgtcctttgatgtcatggcatgctgtagcagcctaggtagataactgaagctccttcctcctcatcccccaagtcctctgaacttcacctctctgtgtccacctcccacgttcttggccatccaccacggaggggtctgtcatgaatgcctgccctcgtaaccaagcaaccatcaaccatcttggggcatcagctgcaccccttgcaaaagatcatacaagctggggttgttgactgctgatacccctcatggaggggtgggaaggttcacaagaccttcacctgaggatccagcccctgtctaccacctgtcacgtgcaactctgcctcagggaggcaggagagtataacagtctgggaagaggagggaaagggggctccatctatgcactcaagccctctccctgcaggataacggatttcaggttcagcatgcagagggagaagcatccacacctctgtaagcatcccccatctatgctttctaaagaatcccagcaaactcattggttctccagaatgaacttgggtaaactcgtgcctgggaccttagaaggaaggctagacattgtttccatctttccttgggaaggcatcctagcaacagagtcctagggcccattttttataggacccagccctatgcagatcctcactgcctgtcaggtggaaggtgagagacctttaaactgaatcatcaaagtatgaggaagggatcattggaggcacccaatctgactgtcccagtcacagataggaaattggaggcttagaaagggaaaatgcagggagtctctaggcttttaccagccctgcaatccctatgcccactccaacactcgcacgggaca

SEQ ID NO: 1661 - DNA, 1400 bp, mus musculus
gatcagtcaggactctacaggggccagaggtcttgtccttgtaatgtttcgccagcaaaactcactcagacaaccagatcaaagctttattgcttacttatcaggaagacctcgaatacaggaaactcagcccttttataacccacaaagagtggttggagacgtgtcagctcctgattagctgctcactatcagcccagatgactgccacgggacaggcagggcacaaggcatggaaaaataccccagcacatgtgcagactacttgtttactagttagaacactggatatcagcaccatcttgtaatggcgattgcaaggggggctcctcacacagagggttgactgtggttcttggaataggtttcctatccaaagtgccaggacttcttacatttgaaaatcctttgtgtttttatggtgagcatggaaaaaagggaagttctaacgcagatttgcaaagccgcgatcctagccagtttcaggtgcagctcccctttcttgggtctgtgcccaaggggatctgaaaaatgctattccagcaaatctgaggaggtcacaggctcttgactacttttggggtcttgttgggttggacccaagcaaactataatgattaaaggccagtgatctggaaccagatttgcacttaagggctactggcaaacttcaaaccggtatttattagcaagccagatgtcttgcagattgtcccacgaccctgacttctctaattgtgtttcttctaatgtaggtcagagtatctcaaacacactataaagctgactagaagctggtgcatctcagacactgctccagttctccctgctttgccagggcagctggattgattttgttttttaaattccaacattttcctttatttttatccatcaggttagtttgaataatgccatccattcttgatggacattttgagttatgagctgatgctgtagctcacctaattgcttgcctaaccctgggttccaaccttaacacatgcctatagttccagcacacaagaagtgaaggcatgaaaatcagaaatgcagctatcattgactttgtcaggaccagcctgagcaaaaagagcaagacactgcctcaaccagaaaacaaggtccaaagaaacgaaccaaccaaccaacaaacaaagaatcatcttgagtactgtattagttagggttctctagagtcacagaacttatggatagtctctatatagtaaaagaatttattgatgacttacagtcggcagcccaattcccaacaatggttcagtcgcagctgtgaatggaagtccaaggaactagcagttactcagtctcacacagcaagcaggcaaaggagcaagagctagactcccttcttccaatgtccttatattgtctccagc

SEQ ID NO: 1662 - DNA, 1600 bp, mus musculus
gactttttaagaagctacaaatgttctcaaagtgaattgtgtcattgttaccttcttctcattcatgggtgtgcccactgtgtaatacagtttcagagaggtctattgcacaatagctgccaaatccagtcagcctcttatgaccggtggaatgatctcactgctattaatttgcatttccctaatacctagtgatgccaaacatctattcatgtagagttgggttttgccatttgtatattttattttttttaaaaaaatactattttatatgtatatgtgtttatctctatgtagtatgggcatgtgagtgcccacagaggtcagaagaggccaccagatccccagaagttataggcagttttgagccccccgtggcggcgacgacccattcgaacgtctgccctatcaactttcgatggtagtcgccgtgcctaccatggtgaccatgggtgacggggaatcagggttcgattccggagagggagcctgagaaacggctaccacatccaaggaaggcagcaggcgcgcaaattacccactcccgacccggggaggtagtgacgaaaaataacaatacaggactctttggaggccctgtaattggaatgagtccactttaaatcctttaacgaggatccattggagggcaagtctggtgccagcagccgcggtaattccagctccaatagcgtatattaaagttgctgcagttaaaaagctcgtagttggatcttgggagcaggcaggcggtccgccgcgaggcgagtcaccgcccgtccccgccccttgcctctcggcgccccctcgatgctcttagctgagtgtcccgcggggcccgaagcgtttactttgaaaaaattagagtgttcaaagcaggcccgagccgcctggatactgcagctaggaataatggaataggaccgtggttctattttgttggttttcggaactgaggccatgattaagagggacggccgggggcattcgtattgcgccgctagaggtgaaattcttggaccggcgtaagacggaccagagcgaaagcatttgccaagaatgttttcattaatcaagaacgaaagtcggaggttcgaagacgatcagataccgtcgtagttccgaccataaacgatgccgactggtgatgcagcggcgttattcccatgaccagccgggcagcttccgggaaaccaaagtctttgggttccagcgggagtatggttgcaaagctgaaacttaaaggaattgacggaagggcaccaccaggcactggacactggacccctgcctcatgaattcacttttttctttcccacctgccagtatgttgaagcccgtgttgtgtattttgggaaacaccctgagagtcatcattagggaggttgaggcattctcttggggtttgtattctgggtccttttcctactgtgatatgctttagagagtcacttcatacttctagacagtatgattatagggcagtgatcttctggcatttaccctttgcacactgctcctttaaaagtttatttggaaaacaaaacttctcaatctgactcaggctaaagcagtgcaggagacaaccacaaagatgaac

SEQ ID NO: 1663 - DNA, 1200 bp, mus musculus
tcagagataccttccaaacatcttatattaataatctattattatatcttatatattatattatattacattatattatatttattatattatattatattatattatattatattatattatattatattatatttgagaggctccaggatagaactgaagttcttgcttgacacacttgaggaattttttcttttttggaagtagggcgattactcactggggaagggagtgtgcagtggactagggcccagccttagagggcagggtactgaaactccatgatgctgagctgtcagcttgagctagacctgtgctgcttctcaggcagggtatatacaaatcaacatctcacctggctaatccttcagaagaaatactcttaagacagtagctaaatgttccttggaaagaagagcccaaagagctcagaagcctctctgtaattcttgttacaggagtcttggggtgcagggtggttggctaggacactgcatagtttattgtgtggaaatgacaattaattgtatgtcttggaaaaaaataccaatgtggagaaaaggaaagcaacagactggggaatgcaaagaggactccacagttccacactgggcagaagacacaaagcagcagcttcacactgagagagtgcagagacacacagcctgctctagaaaccatagctgagctcagtttgggtgggtgtggcctagctccctcccttcactgattccctccccttccccttctaaggtctcaattaccaccaaacaccccagaatggtttcttccaagcatggctgttcctgaacctgaaagtgctccaaagttgaatttcaattattgttgttcacagtcgatagtgttgttcaaactccctgtctaaagagtttttactgctgtaacaaaacacagtggaaaaaaaaagcatgttaaggaggaaagggtttattttgcttatatttccttaatgctgttcatcatctaaggaagtcaagagaagaattcaaagagggcaggaacctggaggcaggagctgatacaaaccatagaggggtgctgcttattgccttgctccccgtggttggcacagtctgctttcttacagaacccaggaccaccagtccagggatgacaccacccacagtgggttgggccctcccccatcaacaactcattaagaaaatgccttagagctgg

SEQ ID NO: 1664 - DNA, 1000 bp, mus musculus
tctgggcccttagttgggtatctgatgtgggcggtttctggagaatctaatgtgggcctttagtggagtatcttgactgtgagtgtactgtgtgcagttagtggagagtctgatgtgagcgattactggagtatctcgactgagtgtactgtactgtgtgcggttaatggagtatctggagtgtaagtgctgacccgccaagtgttaagtgcattgtggtgctgggcactaagtcaaagagctgtgcagaatgatggttaccttgctatttttgcttagtagtcggacacttgacatatttatgatacactaatgaataaatacttgtatttgtataacccgctagttgtttctctattttggcattggtgcctgattagttaagacaaatttaagtgcatgagttagtgacaggttttatatcgggtccttaataattatatttctcacctcatttttacactgtgttaaaaatatttagcttagtaaacatttgacatattttgttttttcttaaggaacataggagagctaacagaagccagcgtgtgtagtttattgtgctaatctgaatgagttgtgattatgatgatgataattttgtttcctgagtttatgcgttccctgcccctttcttcctttcgactgttcattttcttttcctcaggatacgacttgatgaactgagaatgttcttagagaatgagacatgggagctttgccctgttaagtcaaattttagcatcttgcagcttcatgtaagtttttcctgtgaacaaagaaatgtgtcttttagttactatttgagcttttgtcttagtagcagaaacttatgtgagagcatttataaagcaaccaaagtaaagaacagtgccaagcttcaatccatgaaaggcattcctagcaggcccttttgtaggaattatccactgattggcctgtaaaactcccttctttccaaagcttattttacatgcttcagtaagcactgttttggaca

SEQ ID NO: 1665 - DNA, 1000 bp, mus musculus; identical to SEQ ID NO: 1664

SEQ ID NO: 1666 - DNA, 1000 bp, mus musculus
ttcattatctctgtaagaccctcaatatccacatgcttattacagtgcatagatgtcagtgtgtattggcccagggaataagacacatccagcaaaatatttgctgtacacagactaactactgtgggatgtaaaactatgccaggaagtttgataaaatggagcaggtcaagacccagagacttggtggtcacacacctgaggcacccagctccctgacagattcctgacttggaacatgtgccgtgcttcccacataaaagaaatgtatcctatggtcacataggcccaaagtagagttctccatgctaatgaggtacctaggggcccagagggcttagctaataagcttcccttcccagacattcctccctgcaaaaggtatttaagctcatgcccacactgagaattgggttatggttttacgaatacattttctgccatgacaataaactgtttaaaaccatgggctgtctcttttcatcaagatcccaccgtggggagccatgaagaaggccttcacctacagagccacaacgcatcgtaatttcctgtagaagtcttctctgtgctcttacatctgccaagctaaggacaactgtcctgtaaaacaagtgggggcttcctctattcccagctttgagttagatgcagtctgtggcccctgattgcattctctgctcttctgtgactcccagcatcaccttgataaccaagagtctgagaaccccacactccagccttgttgcaggtcagggaccgtgaaccagctctggctttcacacatctcagcctgtactttcccacccctggaggggtgttttggagcttccctacagccccacactcaccctgtgggtgtcatggggaaagcacagtgaaacgtgttccacctcctcaagtggctgtcctcagcagtagagcagaagtgggcttataacctgacaaagaacccccttggttgcatagatattttttggagtttgagctgagagtgtgc

SEQ ID NO: 1667 - DNA, 1000 bp, mus musculus
gggtctattgataatcacaaaacattaaccaagtttaaggattgccacaggcaaccaatctgctaccctggccaaccttagtgtcaacaaagatattgtgtaaacataaaggagaaaggggctcttatactgacatccacaccaacttagacacactgtacaggatgcatctacacccactgcaactggacaaacagcacattgggcagttgagtattaaacggtgaacatgggccttacacttgagttgggtgttcggatttacagccaccccaacacctggccagcatcttaggtgcagaggaacttgccagacaggtcgtgggtggcctgccgttaaggccccacgaccgtgggagagcagagagtagaaagtccagaaagggtgtgatgggggaagcagggagtgtacttttttttcccggaacagtagttctattgccctaacctgggctcaggtagctgccagtccacttgggcatagccccggagctgacatctgggccgggctgcaggccctggccctctgcccccccaacacccatacagtcaccatgcctgtgcagccgtcgccgcccgctgccgccagtgacccggtgaccccggaggcccgtctgggcccggtgaccccggagccccgggcatccggacccccgtcacaggcgcagccgctattaaggcaggaggctaccagggaggaggaaggggaggagacaggcggccagggcgcctggggcaccggcacggctgagcaacggcggcggggttggggggaggccgacgagggcacggggaaggccggcggcacggaggccgcaggctcggacccctcggcccgcggttcgggcgacgggcaagggagctggcggccgcttctcggctggctacggcgcccgccgccccagtgctgcccctgcgcggcgccccttccccgctccgccgcgcactgttgtcatggaggaaccaagatggcggctctggcctacaacctgggcaagcg

SEQ ID NO: 1668 - DNA, 1000 bp, mus musculus
tgtttgtttttagttctatttttactgtaagtgtattacagtcttcagtgttcatagttatacatccctgctttccccactgcttgtagtagtgcacctgttactgtgtgacttaagtatcttcttaaatggccacagagtatcaagtggctgcatctaattccatatgcttgccctgttctttgtttggtttggtttgggttttttggttttcttgggttctttgttgtgggtttttttttttaagtttttatagttttcttgagataaaaaaaaaatgacatttccactttgtagaataaaaaaaccctaatttctaaaatccttaatgtagaatttctacaatgcaaatatcaactgaaagcacataagcagttaacggtctatttcttgctcactgctgcagtgtgtactgtagttggaagacaagtacgggctccttatcttctgcagccttccttccctggcactgagctcagaacggagacagcagggtttctctgatggggactttctcattttacaaatagatctttcagtgaaaactaacaaggcttaatacctttgtatgtgttaatttggggggagtgacctatctcattatagccttctattttatacactctctaatcctgtcttcaaactgcctgtagttacagatagggaatggcaaagggtggaaagtggagactcagtgcagagttgcaggagtgactcctgagtgtgaagtggaaatctgcctgtcccatgagctcacctgtgatgaggagctcagaaatggagtgcccagcaggaagcagctatgcacatggtgctgatgatagtgggcccttaatccttaggaactgagcgccataaggataatagaaaacagtgatgttggctatatatggtacttggtgtttgtaaacgtacattctattaatatacacagacaaccttgattgcaagaaaaccttttaatatttataggcttagaattccttctggaaattaatag

SEQ ID NO: 1669 - DNA, 1000 bp, mus musculus
ttttgtctgcatgtatatctgtgaatgacacacatgcttcgtgacttcagaggccagagaaaggcacttgatccttagaactagaattacagatggttgggagccatcatgtggacgctaggaatcaaacctgggtcctttggaagagcatccaggactcacctccaagcctcatttgcataaaatatttgaacattgctaacatgtagctaggatgcgaccaaaaagcaatgcgcaaacacaacacagagaactcatataacatgaatcttgccccttcccaaggatatgccttcttctttttttctcttggagacagggtttctctgtatagcagtggctgtcctggaactcactttgtagaccaggctggcctggagctcaggaatccgcctgcctctgcctcccaagtgctgggaataaaggcttgcatcaccagtccggcaggataggccttcttaaagaaggctaggtgttcccacatgcaatgcttcttttgttgtgaaccagccacaaagccagttatggaattactcggagaaagtgttaagactctggcaagccttaacttacggaaacccccctccccccaccccgccccagagtgaacaatgtggagctgggaatcagtgcaatagcaaaaggaattttattgttgcagcatgctggggttgccctgcacacgaaggagagagagaacagaccagtacagccagttttcagagcagcagccgtttgcgaacaacgacgtgattggcataacggtgtgacttttaaactgattggtctttagggaatgaggtagcaaaaacttcccttgtctgtaagtggccaacagtcgtggaatgtgtctacgtgctctaggcctcccccacccgcaggtgactgatgatcggcccctaacccctcaccactcccctccctccccaccaccccctggtctgaggaatgtaattagcctttcccttccggaggggaggggtgcctaagtgctctatga

SEQ ID NO: 1670 - DNA, 1000 bp, mus musculus
taactaaggtgtgcgctgccttcagcctaggactgactgtccccgggttccctcctccttgccaggctggcccgaggcggtgctgcgctgtgcggaggccctcccgcgggaggcgcgggtgtggagggcgtgggccgtgggcggggcgagccccgcagccctggtgttgggagctgtcagtgtcaggctcaggagagaggaagtgatcgctccgggaggagcgctagcctagccgcgcagcgtgagacagcacatcctgctggcgcgggcccgctgctctccgtcctcccgcgcctcctccacgacctccagtgagcctccgcgtacagcattcaggtaacccatgggtgggaggtcatgtctatatgcagccacctctgagccccgagcccccggctacatccgcaggacaccggggagcagcagggcagcagtgactgctgcagccaccgctgggcacacagcctgggcccctttccccgtgctcctgcatactgaagcgccccaagctggagccctccagaggcagccctggctgcagctccccaggagcggagaggtacaggcagaggaggacgggtcaagggtgtcatcaccttgtagcccaccttgtacactgggagaggcgcatggcaaggttcctcaccttgtttatttctcctcgggagcaaaaggccagaagctgtgctgtccacatccccgtgggctaccagctcatggcccctagaaagggagacctacagagtgagggaaaggatgctgtctgattacatttctgagctgtctgcaaagctctaggatgctgttgctacccgccaagtcggagggggccaatgcacttccaaccgagctttaattaaacactcatgcaagatgccagtttctttctctgctggattaaaaaaaaaaaagtgtggctggggatgtgttttggtaaacacctccgcggttttccttcccccactcccatccagaattgctctggccacgtaaagctctg

SEQ ID NO: 1671 - DNA, 1400 bp, mus musculus
caatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatgggaaaaaaaaaaaaaaaagaattgacagaaaattttcaacacaagagatggtgaaattcaggtctgtatacagggtgctatctgctgccatccaagggtacaggctcagcctgagcagccagagttgcagctctctgaggggaatcttgagcaaggcagacggctgggcctcttccttggctagtgctgccccagagttggcggcaggtggcaatacacagtgagtagctaggggccaagatcggggccaacaagcaggaagtggctgtggtcaagcgcatgaacccagctggttgggcctggtagaggtccagcaatgaaagcttccagagagaaacttcttcactgcagtgttacagctcaataagacaggcactctcagatgatctttagtgaaataactccctttcggggtgggttgggacgtagaggcagatgctttctgttgcttggtgtgaggtgttacggatacctcatctccatgtggaagcacttctggtgtttgatctaatcagtggaggcatacatagccctggatgctctgccaccttattcaatactcaactattctcaactgtgttttccccccactttttcacacagagcatcatgtctatagtgccagggctcttccaagctctacacctatacttgtaaactcctgctgcataacatcttcatttccattaaaaatgtaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctaggcaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagact

SEQ ID NO: 1672 - DNA, 1400 bp, mus musculus
tcaagtgattttaggacaaaattctaccagactttcaaagaggagttaacatcaataaaatttaaattatttcacaaaaaagaaatagcagaaacattgtctaattcattttacatggtcacggttattctgataccaaaaccacataaaatttcaccaatgaaagaaaattataggctgttttccttcatgaacatagatgtaaacgttctcaaaaaaatatctgtaaaccaaatctaagaacacatcaaagtagcatccactacgatcaagatgcaggggaagttcagtgtatataaaatgataaatgaaatccaccatataatcaaactgaaacaaaatctacacgattatttcatcagataaataaatggccttagacaaaattattattattattaattattattaatacaatttggatattttcttcatttacatttcaaatgttttgccttttccaggtcttgccttcagaaacatcctatccctttttctctcccactgcctctatgagggtgctcccccactcacccacccactccagtcttcccaccctggcattcccctacactggggcagagaataccctcaggcctaaggtctgctcttcctgctgatgttcaactaggccatcctctgccacattttttagcaggagccatgagtatctccacatatactctggttgttgttccagtccctgggagctccagggggtctggcagtttgagactgttgctcccctcatgaggcttcaaactgcctcatctcgttcagtctcttttccaactcctccttctgggacactgcactcagtccaatggttgcatgggagcctctgcctcagtattgttcaggctctggcagagcatctcaggagacagccatatcaggctcctgtcagcaagcacttctcagcatccacaatagcatccaggttaggtgactgtatatgggagagatcccctggtagggcattctctggatggcctttccctcagtctctgctccacaatttgtctctagatttcctcctgtgagtattttgtttccctttctaagaagcactgaagtatccacacattggtcttgcttcttcttggacttcatattgcccatgaattgtatcttgggtattcttaacttttgggctaatatcaacttatcagtgagtgaatacccgggatgataatttcaagttccattcattacctgtgaatttcatgaagtcattgtttttaatagctgagtagtattccattctgtaaatgtaccacattttctgtatccattcgccaaaattgtatactcttctattataaagtccagaagatattagggatacaagggacttatggcaacataataagggcagtttatagcaagcccatagccaa

SEQ ID NO: 1673 - DNA, 1000 bp, mus musculus
aatgttatcccctttactggttttcccccctggaacccccttatcccatcctacctctccctgcttctatgtggctgttcacccagccacccactcctatctccccatcctggcattcctctataccagtgcatcaagccttcacaagtccaatggtctctcctcccattgatgccaacaaggccatcctctgctacgtatgtggttggaactatgggtccctccatatgtattctttggttggtggtttagtcccagggagctctagtaaggatagcaggggggttctggttggttctgagcctctcaggagacagctatatcaggctcctgtcagcaagcacttattggcattcaagagtgtctgggtttggtgactgtatatgggatggatcaccaggtggggcaatctctaaatggcctttccttcagtctctacttcacactttttcttcatatttcctctggtgagtgttttgttccccttctaagaaggactgaaacatccacactttggtcttctttcttgagcttcatgtggtctgtgaattgtatcttggttattctgagcttttgggctaatatccactatcagtgagtacatagcacatgtgttattttgtgattgggttacctcactcaggatgatattttctagttccatccatttgcctgagaatttcatgacatcattgtttttaatagctgagtacttttattttttttttaaatccagttgttagccccctcctggtccatactcctacagtctctcatcccattcctcctcctgctgtctccaagaggatgcccaaccttcactggcaggcttccccatgccctaggccctcatgtttctcctgggttaggccttctactgaagccagactaggcagtcctctgctatatatgtgttggagacctcggccagctagtgtatgctgcctgattggtggctcagtgtctgtgagatctcaggggacctaaccaggttgagact

SEQ ID NO: 1674 - DNA, 1000 bp, mus musculus
taggggtctgcaccaggtcctctgcatatatgttatggctattagcttggtgtttttctcagactcccagtgaagtgagtgtgcctgtgacccttttgagcgttcttgagactgtttttctcctattgagttgccttgtctagcctcggtatgagggctttcatcttgtattattatctgttcctttctgaaaagagacagagggaatggatatggttacacaggtgagttgagattgggaagtttggagtagtggaaggatggaaacctgtgatcaggatgtaccttatgaaaaaagagtctattcttgcagaaaaaatttaacctcaaatggatattaaaatagtagtcagggtcaccttgggcgcggagtccatggacacccccaaggtccctagaggatagcttgagaggcagaccccgttttgggctccaaacatccaggcacctttcctgccagaggagaggtgtccacaccacctggaaagattttccagagcaactggggaagccatctttgttcccagatccctctgagactagtctacgcaggtgagaatgtggactacagaagctaacagcttctgggacagggtgaagagacacagcttctgggtcaggccccgtttcggaccttcatcttctgccaggaggcaggtctgaaagccagatatctgtgtaccttccctgcaagaggagagcgtgcctgcagagagtgctctgactattgaaactcatgagagagctagtctcccaggtctgctgctagaggaacagaatcacgagaggaaaaagctctaaccagagacaactataacaactaactccagagattaccagatggtgaaaggcaaacgtaagaatcttactaacagaaaccaagaccactcaccatcatcagaatgcagcactcccaccctgcccagtcctgggcaccccaacacacctgaaaagctagacccggagttaaaaacaaatctcatgatgatggtagaggaca

SEQ ID NO: 1675 - DNA, 1400 bp, mus musculus
gacttttttagatacttgtttttgtttgactgttgtgtcagtttcttctattgtgtcttctactcctgagattctctcttccatctcttatattctgttagagatgtttgtgtctgtagttcccatcctctttcctaggtttttctatccccaggtttgcctgagtttgtgttttctttattacttctattttccattcttgaacaattttactcatatatttcacctgtttgttgatattttcctatatttctttatattgttttgtttctgctttaaaggtctctacttctttgaatatactttccccttatttctttaaggggtttattcattttctctttaaaggcctctatcatcttcataagattagatttaatatcatcgtgtgcatcagttttgttgggatatagagggctacctatagcagtattgctgggctctggttgtaccatattgccctggctcttgttgactatgttcatattctgtcctttagccatctgtttttctctggtgttgtctggatgatcccaattccaggaggactcctctagaaggcaggagtagttatgggccagacaatggaggtcaaggcactggactctgctggctgtgtttccagtgcatctgattgacaaggaattagttggaggttgttccaaccttgtttttcttggaattactgcagacttccaccatgaagtagatcatttttggggtgtcctaaggcttctcaggaaggtagcacaagccagataatggaggtcagaggagcacatgtgtgcaactcacctcagctggctgtgcctcaagtggaccaactctgcagactatgcctcaggcagacacaactgggaacatattggtgagtcagtgttctaagttggttgttcttggggtccctgcaggtctccaagggaaagcaggatgcacttgcattcccccaaagttctttgggatgggagggcaagcccaaagccagacagtggaggaagatgaacttctttcaacatcatctatttaataacacattaagtgccttttggagcaaccatttaaactgtattctaaatataagcagcgtgaatgtttatatgtaggttatatgtgtataaacttgaacatatgtgtttcttcatctactttcatttatatggtaattcttatttattaaattgaagtgtaaagacagagaaattcttccacgtttctgattttcccctctttctatatcctttatttgtcaaagtaactgtaaaattatattttaatattcctcataaaatttcagtatttatcttgaagtgaactgaattgaattctagcttcattaggaaagagtaaacattgtagaacatagatgaaatgaaaatagagacagggagcatttggggcag

SEQ ID NO: 1676 - DNA, 1600 bp, mus musculus
gcttatgtctgtagtccctgttccttttcctaggttctccatctccagcattgactcagtttgtgttttctttattgtttctatttccattttcaggttttggatagttttattcctatccttcacctgtatgattgtattttactgtgtttgtttatatttgtttgcttcgttttttaatgcctttacctttttaaatgtattttcctgtatttcttttagagatttattcatttccacttcaaaggcctctatcatctttctcagattggatttaagatcatatttgtgtacttcaattttgctgcacccagagcttgctgtagcaggattcctgtgacctggttctgaagctgtcctttaagtcttctggttttacctggtgttacttggatgatctagatgagcgggactactctggtaggtgggaaatcaaggggacagacagtggagatcatgttacccaactctgaatgcttaagcagaccacagtggcaagatattggtggggcaatgtttcaaactggtagttcttggagtcccaacagtcctctactgggaagcaggctggtcttgggatccttgcaaggctcttctggactccatgccaaacccagtaccagatagtggaagtcaggggactctacttaactcacctctcccagctgtgccccaggcagacccaacttgaaaggcattggtgggagagggttacacgctggttagtcttggggtcccagagacctccacatgtacactgggcactcctgggttcctgcagggatccttggtacaaaagggcaagcctaaagctagacaatggaggtcaggggactgggcaccactcacctctgtcagctgttccccgagtagacccaactgacaatatacgtaattatatacataattttcttgtttgtcaatgcgttcttgagatccatggctttattataattaatttagctaattgatccttataattcatttttcatacttagtaaatttttaataaaactttaataaaccttccgcccccccccaggaggaatgtctatttgtattttcatgttaagctataaagggaaaatttccacggatcttactcataatgaatgcatcaatacatttatttacatttacttgtgatttgtaaaattgagtttcaaaaactctttatctgaattcccatcaaaagcttgaaagagtcaatgattaccttgtctagttaattttggttttggtaaaaatggtcattactacaaaaacatttcccttaaggagacaataaaattgcttcagtttatttgttttgcgtttgtttgtagattctgaatctcttctctcctttttggtgaacaatatctagagaaaatcttctttaagctatgtatagtgacagtcacaatgccagaacctgagagaatgaggaaggataatggctgcaaggtggaaaccagcccaaatagcaaagtgagttcaaggctagaaaagaaatttaactgcctttaatttagcattctttctagtaatattttttgctaatttgcaatttattagtttaaaatcagtttaagtaaaagaataaaatattttattctaa

SEQ ID NO: 1677 - DNA, 1000 bp, mus musculus
acaattatctgtatttgtactcctttgtctcataggatgatgtcatgtgagatgagtgagacactgtagattaaataatggacagtgtgaataggctcttctaaactctgtgggatacttttgcctatacaatattaacacatcaataatttgaaaatcttaaagcagttttacccttgcacccatcagtgttaaaatggtgggaggtgttctgtactgaaggaaaggaagtggaaccatgtaatgtgctgatggatgacatcacagcactataaacagaagggagaaggaggggcatgccaattcaataaaaggaagcaaacaccaactcatatctttattatttagagatttatgaagattttaagagtcctgctttgagataccttttccattaatgacagcactggtggctgaacaaggaatgagttcacagactatgagaaagtttagtttcccacagtgttaaagtaggaaagtagagaacattccagtgcttgatatgcaagcttaatattgcttcttattttccttttttctactatagtgtatcaatttaaaaataaagttgtttaaaaccacactgagttggtttcaactggtaagcacagtttctcttggagaggcaagaacagatgcatcctttagctgtgacacaaaaattacaggttcctagactaaaaatagctcccttaatatgtatgtgttatatcgtcactgccattcttcctaaaagcaacagactggcagctgttattaataagtacgttgattgtgggtatctttttcactacacgaagatctcatacctttggcaatctttcagggaagatagttccacattcatgtcattgtaaattttgtctttacaacaagatcttatatgtagctctgagttgtatcacctagataggttagcctgggatgtctgtggacttttatccttctgtttcagactggcaagtgcagagtctagtattttggcccatcatggatagct

SEQ ID NO: 1678 - DNA, 1600 bp, mus musculus
tgaagtaatctctggcactgatcaaatcagtgaatggaactcttatgaaagaacagaacaaaaaataatgctttttgtcagattttaagcaggagagtttatcaagtgagagcactaggaataggagagtgttatctcaaggcatttcatttaacaagatggaaacatagatgggacaaattgtaatcttctttagaaagttgttcactagtctgaccccgattattttgcaattcattcttacactttagaagccatatgtaagcaaagtctcatttaagttacttttctgtgaactcataggaaccttggtatgattggttacagttaagatgccgtgtatgaaaattatttggaaaaaaaaaagttagaaaatcttaccagaaatgtaacaaaaacactggtacattctatgatcatatttttattttttaatttaattttacttgcacaaattattcactttgcatatcatgcactgtttgacttcttgtcactctttcctacaattcttacccaattcctccttcaaattctcccctgagtggtttggggcctctggaataatacctgcaaccctggcatttcaagtctctgcaaagctaggtgcttcatctctactggggccagactaggtagcccagctagaacatataaaacatacaggcaacgttttggggatatctcctgttccagttgtctgggacccacatgaagactaggtcaagcagctgttctttggtcaatgattcagactctgagaactccctagggtacagttgactctgttggttttccagtgaagttcctatccctgtcagggccctcaatccttcctcttcttctttcaaaagagtcttcaagctccatccactctttggctgtgggtttctgtatttgtctgggtcaactgatgggtggatcctctcagaggatatattatggtaatctgtatggttcaggcgtctctggtctgatggaaataggggagaggcagcaggagaatcgaccacattttatttttcataggaagacttccttgtttatcttagaatacaatataattaaaagaaaccatccatgaaaatacttttattttaaataaatataaatgagatctgggtttggttgaagatattctcatttaatagtctggtgactgatcgaagaaagtctttggtcataggttacaggagattgtaaaatgcacctgccaccaatgatcaggcccttacacacttcataccagaagaaattctagaaaaggaggtgtgttgatgcagacaacaaatatgcatggctacagatggccaaaaaacatttgaacactgaaaaaataaacatatttattataaaacatattatagtgaatatgagttaccatttatctgttaataaattatgatttatatattaattgtaaagactaaatattatttatatcacatgactttgaggatttctcttcctccaatagatagacattcagttattttgtggtgaatttctagattttgattaaggtattttggtatgtgttgtaagaaattataaaataatggcatggggtgatggatagattactattcttttaaaaaaa

SEQ ID NO: 1679 - DNA, 1400 bp, mus musculus
ccgtagatttggtcttctcattgtgtcctggatttcctggatgttttgagtttctttttgcattttgcattttctttgattgttgtgtcgatgttccctttggaatcttctgcacctaagattttctcttccatctcttgcattctgttgctgatgcttgcatctatgatttctgatttctttcctagggtttctatctcctgagttgtctccctttggattttctttatttttttctacttccacttttagatcctggattgttttgtttaattccatcacctgttagtgttttcctgtaactgtctaagggatttttgtgtttcttccttaaaggcttctagctgtttacctgtgttttcctgtatttccttcttaaagtccttaattatcatcatgagaagtgactttagatccatgtcttgcttttctggtgtggtggtgtatccaggacttgctatggtgggagagtttgattctgatgatgccaagtaaacttgatttctgttgcttctgttcttatactagcctcctgccatctgattacctcaagtgcttgctgccctcaatatttctgattggagcttgtccttcctataatcccagttgattcaggactcctcagagtccagctttctctgtgatcctttgcttgtgggctcctgtgaacctgagattctgggtgtgtcagagtttttggcagtcaagcttcctctaagaacctaaaatactggcgtgacccagctcctgttatcctgggatcctactgtcctaagatcctgagggtgttacagtgcttggaagtggtgtatcctttgaggaccatggatatgtctggtctgtttgaaatcaaggtaaaccagaactgatcaaaaggaacccgagcctttggttaggaagggctctggtgtccttccttgttcctgctgtcatacgcctgtcacaattggattggaactgatgttgtgttccactcaccagtgatcctaagatcctgtggagagtcctctgggttctgtgggagtgtctgctgattcagtgcccaaggtgaacccatgctggtgccaaccagaaaggacttgtgctcctggtcaagccagtcttctgcttccccactgctgtctcaggtcccgagtgattggattggaacagatgttgagttccactcatcagtgatcctaaaatcgcatggagagccgtctagggaccatgggggtgtccactgactccgtggacctggtgacccagtgctggtgccaactggaaggcattaatcaacttttaattgctaaattttgtcatcattaaaaattcaaagcatcatgtactggaaattgttccttatctttcatcatctctatatctactacttagaaatatttagttatttcttttcgttt

SEQ ID NO: 1680 - DNA, 1600 bp, mus musculus
cccccaaaattccaccagagaacccctcaatctgataaacaggttcagcaaagtagctggacaaatttctttgcaaaggcttattccagttttatgaggctagcacaaggtgtgtacatttttcagggcaaatcaatacttcagaatcagctccttcagcagatgcctggtacctgctcagtccatctagaagcatttgcagaggacaatggaggggcctgacttgtcatactcctggttgctgatccacataagctggagagtgcacagtaaggtcaagatagagccaccaatccagacacttgcgctcagtgggaacaatgatcttaatcttcatcatgctaggtgctagggttgtagtcgtctgcatcctgtcagcaatgcctgactacatggtggtaccaccagacatcactgtattggcatacaggtctttccggacatccacatcacagttcataatggagttgaaggtggtctcatggatgtcacagaacacttgaactgctcattgcccctggtgatcatctgcccatctgacagctcatcacacttctccagggaggtaattgatgcagcagtagccatgccttgctcaaaatccagggcaacatagcacagcttctcctttatgtcccgaacaatttccctctcagcagcagtgctaaaactgtagcccttttcagtcaggatcttaataaaatagtctgtcaggtccaggccagccaggtccagacacaagatggtgtggggaaacacatagccctcacagatgggcactgtgcatgtgaccctgtcaccagagtccatgatgatgctagtggtgtgcccagatgcctacgaggagtgcaccacccgaatggccatacacatggctggggtattgaaggttttgaacattatttgtgttatctctctcagttagtttcggggttcagggggccttggtcagaagcaccgggtgctcctaaggggccacaagcagctctttatagaagatgtcatgccagatcttctccatgtcatttaagttggtgacaatgctgcgctccatagactatttcagagtcaggctacccctcttgctctgtgtttcgtcacccatgtaggagtttttctgtccatgcccaccatgtaggggatgcgctagccattgtggagggaaacatggccctggggttgtcctcgccaccaaaaccagctttgtacttgccagagtcattgtcaatgatgagtgcagcaatttcttcttccattgcaatcagtgaagggcagggcgacagagcagcagaaagaaccagagtataagtcgttataactctaacatttcagagatggcatgtttatttagcaactttccatttctcagtgacccagcttgtcaggtgtcatgctgaatagtactctacagaataaaataattctaatttggctttatttaactttgttgaataaatgccccaaatgtaataaatatcagtcgaaaaatataactttttactgtgcatttttcatataactgaagtgtagcctaatttattattttttttgaaaataagttttattatgttattgtattagttgtcttttattccactat

SEQ ID NO: 1681 - DNA, 1200 bp, mus musculus
tttatttaaaattgtaataaatattttctttatttatatttcatttaatcacctctcctggtttcccctctgaaaacccccaattacctcctgcctcccccttctcaccaaacaaggcactcctgcttcctggcgctggcattcccctctactgggacatagaaccttcacaggacaaagggcctctcctcccattgatgaccccctaggccatcctctgctacatatgcagctagagccatgagtcccaccatgtgttttctttggttggtgatttagtcccagggagctctggagatacggattagttcacattgttattcttcctatgggtttgcaaacaccttcagctccttgtgtactttctatgccttcttcattgtaaccctgtgatccatccaatgaatagctgtgagaatccacttctgtatttgtcaggtgctggcaaagcctcttagaagacagctatatcaggctcctgtcagcaagctcttgttggcatccacaacagtgtctggttttggtggatgtatatgggatggatccccatgtggggcactcaatggatggtcattccttcagtctctgctccaaactttgtctttgtaactccttccatgggtaatttgttcccccttctaagaaggattgaagtgtcttccttcttgagtttcacatgttctgcaaattgtatcttgggtattccaagcttctgggctaatatcacttatcagtgaatgcatatcatgtgtgttttttgtgattggggtacctcacttggcatgatatccttcaggagtggtattgctggatcctccagtaatactatgtctaattttctaaggaaccatcaaactgatttccagtgtgcttgtaccagcttgcaatgcactagcaatggaggagtcttcctctttctccacatccttgccagcatctgctgtcacctgagtttttgatcttagtcattcttactggtgtgaggtgagatcagtgttgtttgatttgcatttcctagatgactaagggtgttgaacattttctaggtgcttctcagccattcctcagttgacagttttttttatctctgtacctcatttttaatagggttatttgggtctctggagtctaacttcttgagttccttgtatatattggatattagccctctatcagatttaggattggtaaatatctttt

SEQ ID NO: 1682 - DNA, 1200 bp, mus musculus
ttttggttgctgttttgttttttgtttttgtttttgttttgttttttgttttttgagacagggtttctctgtatagcccaggctgtcctggaactcactttgtagaccaggctggctacgaactcagaaatcctcctgcctctgcctcctaagtgctgggattaaaggtgtgcgccaccaatgcccggcccttcccagattttaaaggaagaatttgcagttttatacagaaacaacaaacaagccaacaaacaagcaaaaccaggatggcagtggtggcatgtctttaatcccagcacttgggaggcagaggcaggcagatttctgagttcgaggctagcctggtctacagagtgagttgcaggacagctagagctatacagaggaactctgtatcgaaaaactaaaaccaaaacaaatcaaacaaacaaaacaacaacaaaaataacaaaaacaaaaactatcctaaataaagaaatatgaagtccttcctgttggcagggccaactttggcactgggcgtgaactctggggatgatcccacggttcccagaggactctctatgcaacaggtgcccagcatacccaggatcgtaggaacactgctgagtggaacacatctgttccaaaacaaccaggaggggactatgccagcaggaacagggacacaggaaacccacccaaccagaggctagggtttcttccagtaggcaccatgccccaggccactttgggcaaaaactcattggacagttgcacagtccccagaggactctctacactgcaggcgtcctagcacccaggatcttaggatcactgaggaagagtaggctccagagagggctctgatttctggactcaagtgagagctctatcttaaatcccaggtctctcatagaccagaccaagcaggccaaagaagcaacagaccttcttgtatagggtcccttctggccttcatcttcagccaggaggtagatctgagcaccaaacctctgtgcaacttcactgtagaaggagagcttgcctgcagagagtgctatgaccactgggactcaggagagagttggattcctaggagcactgacagaggctaacagaatcagaggaggaacaaactccaaccaaagacagctagaacataaaacaccagagattaccagatggagaaaggcaaacgtatgactcttactacagaaa

SEQ ID NO: 1683 - DNA, 1200 bp, mus musculus
aagttaccataacatttaatatttcttacaatccattttattcattctctcttcctttttctgtcaccatattatagactgtgtaaggctgcctgttttggttgaatgaggtttgctctggtgacccagtagaaaactctacaagggacaggacccagagacaggtgcctgacactacagagcccccaactccataattctgtgactataagtcacacagacaatgtgccaggctcctggcattctggctagactccatcctcacagttacctgactatagccaggtatactcctcctcacagttacctggcaacagcaaagtagtccagcccaatataaaaggggctgcttggcccctcctctctctctttaagctctcacctttcttagtctcatctctagccctccttctttctctctctctttctaccttctctctttctccctgcatttctacaataaagctctaaaaccatagactgtctctgaccatcaaggccggccctgcttgaaagatgagataggtttcaccctaaagagcagcatcatgcactctagcaacagaacagaccaaggattctcacctgtgtgggaaccacccagcaccccctctctcactgccctctcctcccttcggcctgggcatgactgagccacctccagggcccccactttcttctcagctcttctgcgatgtccagtagtgcctggaattcccgagactgagaacctgttatctctagcctctgtgaggcccagaaatctaggacatccccttgtccacccccgtgggctaggtctgtagcttcccacagaaagacacccaccaggggccacatagaaaccttgtggaagtcctctacgtctgcccacccagagcactggaactctggcaggatgtgggttttctctcactccctttactcccccatgcccactgcctgcatagaaccttagccatactgatgaattctaaatacttaaaaggtatagagactatcactgaaagatggagaggctgttttgcctctgaattagacattgctctgtattttagacataactttgcctattcagaattcacaacactgtggcttcttgggactgcattatataaccatcatttctctgtattgatgccagtggtttgcctaactcttgtgaagcagagcaagttctataagacttgcgattttgcc

SEQ ID NO: 1684 - DNA, 1000 bp, mus musculus
tcaaattataggaagagagaagttttgaggaatctcttttatatatgcacctgctgactattacacagctaccttgtatttcaatatttcatttatatcatgtcttcaggtggatttggagaaactcggggctcaccattgtggagcaggtcctaacatctccatgagttctcagcatctgatttcctttctgggtaagaagaaaggacaaacacaaaatgatagcatgcatttgggtataattaagtgcatttgaggaatggacctggaagggagtcaagaagcataaaaaccattatgaggacaaatgcttcacccccaacgtgatatagatacacatttgcacagatattctcaatcactgagaaaagcagcaccattccctagtacatcagacgttagtgtatatcagagtacatttggaaaggaatttctcccaggattttgatatcacaagtatgaatagaataaataaatctgtcagtctaaacaaattactctcaaaaactgctatcaagggcagtattttggcattccctcagacctttggcaacatcaggacctgtcacccatggtcagtgagaagaagctatgtcagaataaccaagtagtgactgagtgcacattctctgacaggcatctatctccatatgaccagttcacttggcatctgctgcccgggttttctcttcttcctcctgacaacctgctctttcagcctccccaagggtgccatttgttgataaagtcttgacaaacacctgtctgagatatcatacaaacattgaaagctcaattaatttcacttaaaatagaaataatgcctggctttcattcaaagacaaaaagaccaccaacagactgggaaaggatctttacctatcctaaatcagataggggactaatatccaacatatataaagaactcaagaaggtggatctcagaaaatcaaataacccccttaaaaaatggggctcagaactgaacaaagaattctca

SEQ ID NO: 1685 - DNA, 1000 bp, mus musculus
agataagggcaacagaacaattgtgtgctatctttaatttcccagctctgctcatctgctgcacaaatagcagaagccatggttaatcaccgcatagccctggatcccagagcaatcgtgcagctttccatatggtctgctccaaacaaggactcggacatatatcaaatacaaattatgcaagaaaatgtgatcatacagtggaaccaggtcgtaagagaaaaatacctgttcaacaaaaacagaaacctacttaataaacactccacattcctggttcccaaggcagagcaataatgtgcagactacataaatccccatcctaacattagctaggataatttctcagacatactcaactggaagctttcattttcactcatccgggcagaagaagaaaagtttaattgatcatttccattttcttcttctttaatgttgtaggctctgcaaggcgtgctacctacggggtgagtacgtccctcttcagctcagtcttaacattgttttcccctaaatttcatctgtaagctctgttcatccctcttcttcttcgacaatcattagctttatgaaaggtaaccagttaaagtggatgcacgtgcaaatataataagcaccattccaaaaagaaactgaaaaaaaattaaaaataggaagtgctagacaaacagatattgttaaagcacctttgggcttgctttttgattaacagaaagcctgtttactaattttaatgctcactttgaagctttgaagtgtcacttacataagcagaaactaatttaactgaaggtttgattctatttttactacaaactacatttgttattacagtcaactgataagtaaaaaaaaaaaaaaaaatcagagttctcatgccacacctccaatacaagtaaacacagagcactgagaagggaaataagccttctaatacaactatagccttatagcctgggtatcctgaccatagaaaaaggggaaataagccttctgg

SEQ ID NO: 1686 - DNA, 1000 bp, mus musculus
ttcatatgagaaagtaaatgtgtgtaatataaggaaggggatggggtatgcattaggaacaagtgacgcctgtgcttctgctgtcaccttctgttgcagcataggccctctcttgactgaccactgctggcatcaagatgagcaggtccaggacacacctgaagggaactgaatcctaaagctcattggcagaaaggggaaggagagtccttactgtgcagctttctcacatcctcagaagcaaggcgatgaggacgtgataccgtctacttagacatcaagtgatgttcacatccacacacatcctggatctgtggtttgtttgaattctctaagaaacacagctgctctgtggctctaataatcaaaatcactaaactgtaaaacatgaaaatattacagttcagaaaatagaactattacttcttccatgtttttcactgtaaagtatgatttccaaaggcttctaattatttgagaaaattggcctaattctgtttcagtctgcatctattctctgcacatagcagatataaaggcacgctgacatttgtcaaaggaagttatatcaggtcactttgaactttgcaaacaaatattttctcacttttcactagtgaggatacatgcacatcactgttagtttcacaaatgaagtttgttgaaattttatgtacgtagaaaataaggtgtaaaaatctgacccctggatggtctcaagtcccttctcatgtgtctctctgtctgtctgtctgtttgtctgtctgtcttcctccagagcagtctacctcgtgtttgtgacaagctttcactgagactaaagctcaatgcttaggtgatgatggccatcgagtaggccacggacatccatctgactctgcctccttatctctgggatactggctaactccacaacacctagattccttttcaagagttttggggatggccctcatctttgcagggcacacacttccccacagagctctcttcagcaaac

SEQ ID NO: 1687 - DNA, 1000 bp, mus musculus
ctctctctaggcacagatgcctgacccctgcacgtgccacatgattcagaatatgagtctttctgcccatatgataattaggaaatgtgttctgtataatcaatcagttcctcctacacatatggtgctgtattacaaccaatcagcccttcctgtccgtattataattaggtgctgtgttatgatcaatcagctcttcatgtacagaaccctaagaaccttgtataccttttccctggaaaaaaaaattaagctgactcccgggagttcttcccgtcatacagcgtgaataagattatttaaaggacaggtagcaagttaggttcattccaagagtggaagcagaaccttataaaaagatagaaagataacctaaaaagcattgctgagaaacaagcagagtgaaaagtatagagtaaggagtgggcacgtccttcaagagttaagggcttgcatttaaaaaatatatacattgaatttaacaacataagaggtgatttgtgacagtgaaaacagttaaggtgtcaccaggacagtgacatgaggcatgaatgggagcgaaggaggcagttctggggttgtgtaaatccattttcaaatctatggctgtgaggaggaacagaaagggggatatttaagaataaatagaaatggtaaggctcaagtgaggcttatgtctggaacaggggttgctcacatggttctgacaagcaagggtaggagagcactagcacaagttgagaacatctaggatgttggatgactcaggaaagaatggaacagaggagaagaccattcttaggcagtggaaaggacatctcatctctcactgcagtagggaaaaatggcaaggtggcagaggctggaggactagaacattatgtgattttttttcttttgcttatgacttagtattcattagctctgtttattattaactgttgacttcagggcattttgagtttttatttctttgtcttcatagatagatttgtttcag

SEQ ID NO: 1688 - DNA, 1000 bp, mus musculus
gctgagagttctatgtcttcatccaaaggctgctagtggaagactgacttccaggcaactggggtgagagttttaagcccacacccacaatgacacacctattccaaccaggtcacacctattccatcaaggccacatatccagatggtgccactccctggtccaagaatatacaaactaccacacttgcacaaaaagaaaaaatagtggttcagacaacatgaaaaggcagactatctctgtataagtaaaatacttgttttcaatgaggtaaaagaacacacgtgaagctaagcaatatagatattgactcaatagtaaagcagagtatgagatgtggtccttcaaaattagaaaattcagacagttcaataaaatgttattataaacacacacacagataaaatatgttcacacacacagacacacacacacacacacacatttaaaacatctcaaaattctagggaagctctctagtgtatttttctaaaatgattgaacagttttgacagagaataaattccaagataaaatctggatggatcagaagccatccacatcatcgatcaatttttccagaggcttccttgaattttctaaaactttatggtattttaggactcatcaagagaattttaaggatttatgtttccttagattaatttgctcaacaagcagttttggacagaatataaagttgggtaaatctaggattgctaaaccatggtctacaggcctggagaaatagctcagtcattaagtttatttgttgctctcatggagaacccaaggcttagttcccagcaccagtatggtgactgtgagccatctgtaactccagttccatggtatctgctgcccccttttggctcccatgtgaaacaggcatactcatgacacacaaaaatacattcagacaaaacacttatgtaagtaaaataaaatgaatcaatttaataaatcctgattttgtaactacccttactacccaaagatc

SEQ ID NO: 1689 - DNA, 1200 bp, mus musculus
catctatgagaccccttagaacttgctgtttctccaggccatgtgcttcacctctgcttttcttcttctttctcctcctttgagtcctctctctcttccattttctccttcttatctttcttaccttccactccacctttcctttatctgcccaattatcagctctcctttatttgacaaattaaggtggtaagcaggtttacaggaaatcacctgagtgctgactcattccttgttcgcagtgcctcactggagaacagaattaacattaaatataattagcccagagctatatctaatatatatatattttttttattagatgttttctttatttaaatttcaaatgttatccccttttctagtttcctctccaaatcccctctccccttgctcatcaacccacccacccctgcttccctgtcctggcattcctctacactggggtattgagccttcacaggaccaagggcctcagaaagggtacagactgcccaaattggattccatctcaaggggaggatccaaggcctgacactgttactgatactatggtgtgcttacagacaatagtctagcatggctgccctccaagaggcccaacaagcatactatacccaactaatatactgaagttgaggaccactgtgcttgacttagggaaagactggaggaagttgaggtggaggatgaccccatatggagaccagcagtctcaattaacctggacccctgagatctctcagacactgagccaccaaccaggcagccttcgaggcacctgacacatatacagcagaggactgcctgttctggcttcagtgagagaagaagcacagaaccctctagcaacttgaggccccagggagtggggaggtctggcagggcagggtggggttggctgggcgggggcatcctcttggagatgggatgagaaggaatgggttgtgtaactgtcaggagggtagactgggagggggtaacaaccggactgtaaaaagtaattaaagataattttaaaaggtagggggtacagatctaaacacagaattctcaaaagaggaatttcaactgactaagaaacacatagagaattgatcaacatccttatccatctgtgcagtgctatcaaagatcccatcttacacctgtcagaatggctaagatccataatattcgtggcaaggagaatactcatgg

SEQ ID NO: 1690 - DNA, 1200 bp, mus musculus
ataattattgtatttatttacatttcagttcttgtgcctctccttccagcaagcacccctcctacaggccctcatcccattcctcctcccccttgctttcaagagcccctcatcagattcccccttcctctcaaggattaagggcatcttctcccactgaagccagacaaggcagacctatatgtggcaggggcctcaaactggtccttgcatgccccatgttggtggctcagtctctgggagctccctggggtcctggtgagttgagactgctctgctagtcttcctatgggatcaccctcaccttcagcttcttcaatccttcccctaattcaaccataggagtccctgacttcaatccagtggttggatgtatctgcatttgtctcagtcagctgctgtttgagcctctcagaggatagctatgccagacccccatctgtaagcacatgataacatcagtaatagtgtcaggtcttggtgctccccctcaccgtgagattggttccaagttggaccagccatttgacctcctttccttcagtctcttctccattttttgtccctgtagtacttttagacagaaacaactctgggtcagaaattttgacttgggttagtaacccagtccctcaacttgaggccatgtctatctactggaggtaaactctataagttccctctccccagtgttgggcattttggctaagttcacccccattgagtcccaagcacctctcacctcccaagtctctgttactttctagagcttcctgcccaccccatccccagacgctgcttatttccattcattctcctggctcctggggcttctctcctgttccccacccccatatctgatcctgttcctccttcccctccttttcctcctctccactccctccctcctttcacccctctgcctcctgtgattactttcttctaagtaggattgaagcatcctcacttgggccttccttcttgttaaacttcttatggtctatgggttatatctcaggtattctgtattattcggctcatatatcctcatcagggattacatatatacatgtccatttttatctgggttatatcaatcaggatgatattttctagttccatccatttgcctgcaaaattcatgatgtcatcattcttaatagctgaatagtaagtattccattgtgtacatgaaccagt

SEQ ID NO: 1691 - DNA, 1200 bp, mus musculus
cttggctaatacaggatctataagagatgctcattttatagctcagtggggaaataatgtcatctagttaccatatagtagctcctaactagcagggtttctgttacagtgtaaaacacttgtgtgctggtaggtctcagtgaggaaggtcaatatctatttcacatcttttttctctgctgatctgtgtagatctcaaaccccagaagccctgagtctcagctcctagcttttatactgatgccagcttctgctactggttctcctctacattggcctgtgcttctcctatggtcctttatcagtgaggaaccccttaggttgggtacaagattcaagggggtgaaatcaggctattttggccttttgttttcttgactgaattcccaggtttcatttgtggactattctactgacatttctaccaataaatagggcacagctttgactaacatatagtggaagaaaaataccgtgtataaacagcatcaggggagctgatcctgtgtcatgatgctccatacttaaataccaccaggagaaatctggtctcccaggagtgtgaaatacctgtgagcacaggtaagaccaccacttctcctcaaattcctggctcaagagggacacaaccaaggaacaactgggaataggatcctaccagtttccatctgcacctcagagctgaccctgtgccacagttctccatacctaaattctccccagagagtactggtcttccaagagtacttacacacaggctttcaggagggacaagccacagtcagagacagcaagaccagtgaacatcagagatgacctgatgacaaggggcaagggcaagaacataagcaagagaaaccaaggctactccgaaccatcagaaaccaaattcttccaccacagggagccctggataccccaacacactaggaaagcaagactctgctttaaaaccacatctcatcatcatgacaaagggttttaagaaggacataaaaaaaaaactcccttaaagaaatacaggaaaacacaaacaaggaaaggaatgaaacaaaaccatccagtatctaagaatgaaaatagaacaataaagacatcacaaagggagacaaccctgatgctagaaaacctaggaaataaatcaggagtcatggatgcaagcattaacaacagaatacaagagatagaagagagaatttc

SEQ ID NO: 1692 - DNA, 1000 bp, mus musculus
tattttttcttcttctatatatgtcacatggaaactgaggacccattgtatattgaatctcaggtgcatgtccccattttagtctcatgaccaatgttaatgtttgctggtttggaagcccattttctatgtcctcgaattctttcccagactaccattcactttcgaacgaccttaagtccagtagggcaaatcagaggcaagtaagaagcagggatagtttatttttgcttgtttgtttcattgcttttgtttggattggttgccttggtacagaaagagaagtcacaaagaatggacttgaggtctgtagaaaacatcatgcaacatgacagttcacccctttgccaacctcttgcttcagttcctttaagctatatggctgaccagttagcaggtcattccttaggatctgttgtctaggttttgccttgactatgtaccttggctaggtcttctaagtgctaaatgttgttcccattccctacaggttaccacgcaaagtgtgggagatgaaatcccaatgctcgctggctgaccaagcagaaagcataacccagcttccacttaagcaacttattccacttttttcttccaggtgcctgctgatttcctgaagggcttgtggattccccatccgtcattccccaaggcaaaccctaatgcacaaagtacacgatttcacatggtagtttagtgtttgtcaagcttacacaaaacctggagacagcttcagttgaggagctgcctccaccatactagcctgggaccaattctgtaaggtcgttttgtaattaccagacacagaacaaagcagttatgggacatgaaaccatgccagaaagtttggtaaggttgagcaggttgaaaccagaagattcagtgggcacacacctgaggcttaggtgagtcccagctccctgccagacgcctgacttagaatgtgtgcaatgcttctcatataaaagaaatgtgagcacaggtcatttaggccccaaac

SEQ ID NO: 1693 - DNA, 1000 bp, mus musculus
aggcggacacctgtcctctggtccggatggtggccagctgtcttcggcccgccaagggtgctgcctcagcggctctgtgcttctgcctgtcccagaagctgtccggttctctggcgcaccctctgacctgtctatttatgtccttcttaatgtcctctatcatcgttatgaaaagtaattttagatctgaatcttgctttcctggtgtgttggcgtattcaggacttggtatggtgggagaattgggttctgatgatgccaaataaccttgatttctgttgcttatattcttatgcttgcctcctgccatctgtttatctctagtgctacctgccctggctatgtctgactgaagcctgtccttcctgtgatcctgcttgtgtcaggacttctccaagacaagttgcctctgtgatcctatgattctggaatcctgtgaccctgagatcaaaagtatgtctgagctcctgggagtcaagctgcctttgggaccttgagatcctggtgtgaccaaacttctgggatcctgggatcccctgatcctgggtgtgttagagcaccagggagtggagctgcctgtgagtgttgtggggatggctgcagagtttgcacccaaggtctgctcagggcaccagcccagacagactggaaggaacctgtgccactggtctggtggagtttctgctgcctgggacccactggtcccagttactccttgtgaaggggacagatgttgtgtcctcttcacctctgatccgatctcacgtgtttctttaccttccattaaaatattatggtataactccttccatgggtgttttgttcccaattctaacacagggtaaagtgtccacacagtcagctattggatggatcacaggacccccaatcgagaaactagagaaagtacccaaggagctaaaggggtctgcaaacctataggtggaacaacaatatgaactaaccagtaccccccggagctcgtgtctctagctgcata

SEQ ID NO: 1694 - DNA, 1400 bp, mus musculus
agttactcacataaatttcttattagttcagaatttggacctgaatagtatattttatctattaattttaatgtgtcaattgatatggtaacatgagtttctatttttatcactgcaacattggaaatttggaccccagattattgtgaaattacacaatattatatacttctgagaaattttcttgcaatctcttagttgtatacatattgatatatttataaaatttacagttggagagaaaggagagaatttttaatatattttaaaaattatttatttattcacattccagccattgcctccccttcccagttccccttcccacagttcctcatcccactcctcctacccttgtctctgagaagatggttccccactaccagggctccctcctcccaggcctcaagtatctctaggattaagcacatctcccactgaggacagaccagacagtcctctgctatatctgtgccagaggccttggaccagctagtgtatgctgcctggtcggtagctcagtctctggcggctccatggggtctgggttagttgagactgctggtcttcctatgggatcgtctttagcttcttcaatgcttcccaaattcaaccataaaggtaccttacctcagtccaatggttggatgtaagtatctgcatctgtctcagttggctggtgaaacctctcaggggatagccaggccagtctactgtcttcagtctcttctcaatttttgtccctgtagttcttttagacaggaacaattctgggtcagaaattttgactgtaggttattaatcctgtccctcctgtcctctatctactggaggtagactcttcaagttccctctcaccattgttgggcattttgtctaaggtcacccccattgagtcctaagagtctcttacatattcactggtacattctggagggttcccccacctccaactcccttacccccaaggctgcatatttaaaaggggagaattttgaagacaaaatgtcttccaagttttgcaagttgtatttacaagggaagaatcaaactcaccaagaagacataaacggtccgagaccggccgaacttaggaaattagtctgaacaggtgagagggtgcgccagagaacctgacagcttctggaacaggcagaagcacagaggcgctgaggcagcaccctgtgtgggccggggacagccggccaccttccggaccagaggacaggtgcccacccagctggggaggcggcctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctttgt

SEQ ID NO: 1695 - DNA, 1200 bp, mus musculus
tctgataactgcaaggcacatgctgttgaggatgccagtaatgacattgaagatacagtattgaggatacgataagacagattttaaaattcctgcatgaaaaatagactctctagtctatgaagagaataaaataaaacaacataaagtatgactgctcatttcttcatgtggatggccaccgggtttactaaagtggtggtatcttacacagccatcaactatatttcttgacattgtggcagagttatttattataacctcctttcaaagccttatctaaccaagactaaatgctcctggttataacatgtctttaatgagctcttttattttattctaattttgagacactgtgcttcctgtcttaacctagggctaaaattgagtatcaaaatcccattgtggtttctggttcatcaagaaacacgctgagctcccccacaaggcatatttctctactttcctaacagagaagtgagtgaatctaggatatgtaatgctttccagtctcttttaattattagaacgcagagcccaggcatgacaatggactgtgcagttgattgggtactgaggtctaaggtgagtgctcgatgcggtgggaaaaaagacattcactcagcccgacacatgttcgatcccactctttttcccagatcttgttagcagacccttcctgacacagaagtgctgtgtttgctttagcagagttcttctgcatattgtggtgccgagtctctcaggtcattggcttagaagacatctgacatactgccccccttcgttgtggtgtgttccatgtcttttatctagtattttctgacaaaagctgttagaaaaaagcctctgggtgactcacctaactttctcttttcttcatggcattcagctcattctgttacactacagaaatgatcttgtagaatgtatttttccagattaagcactatgcatctcttggtaaggagctgcctttggaaatctggaggagttttacatttataaaacaatgcaggacgcttcagacaatcctgttcttgttctttccttagtggattcctacaagttccaaggcatttctcatcgatgtatattagaatagtttttaaccttcatgaaagaaccctgatttcttcctatgtaattgttacaggtattaatacagtaattattattaatacaactaggatctagaat

SEQ ID NO: 1696 - DNA, 1400 bp, mus musculus
aaaggcattcgagatgtgtatgctgcacagtgctggacaaagtggacacaacttgagtggcatggggcagaaagccattcagtaaagaagtcccagccaggatggtggaaggtgacaataggaatctgtacacgtgcagcagaggggtgacagaacctgcctccagggagccactgtcctggggcctgtggattgttggggatactctacctactcaatagaaacctggacccagtggcttgtcagctgccataaagaaagagaaactgaaggtctgagcactctatagcgagacagaactggagacacagggatggcaaggaacagcctgatgtgaggagtctgtggtgccacctgaggccatggtgacatcctggtccatgttgcccctgagagccatgtctgcagcatgagagacctgtcttgatattccatggtctgtgttatcaccaagagccatgcagatgtccctggtctgggctgccacctgagaccatgttagtgtccaagggctgtgcagagctgaccccatccttcactgaatatacttgggagagctggccacatccacctacattgggtggtgtgggcttggaagagatgccttccccccatctcatacctttggtgtggctggtgagagagctggccctgatgtcacagagtgctggccccaccgtagcgagctctgctccttatctggggagttcagtagagttgaccttgatggctaaggcataggtgatctatgcaagaaggcatgaggaagggagagctggcatttgggtgagctagccaggacagtgcatgagagctggtgggctaaaaagtcaggtactatccaggcccaggtccagggctttaagttggcccaagccaacatctaccccatgtatgagattctggaattcgtgaatgagctggccctgcagatccaaagcagtaggatctccatgacacagggcaaaaacaggctatcagagaagagtctcagtgaggagccagtattgatggtgtagcagaagccagatgccttgaaccagaccatcgactcattgcaatgaacatttgcaagtaaatatgtttggacaggggagtatactgtgtgacacacagtgacacactgcagcttccagtgtgaggtgggttttttgtttgtttgtttgtttgtttatttgttgttcttttcttgggggggatgtttaaagggcagagggcaggtatgaaggaaaggcgagatgagtgtgattggggtacatgatgtaaaattcacaaagactcaataaaaagttttaaaaatagaaaccagtattctattaaagaaggaggaggagaaggagaagaactaattattactcgaatagtttgtcttagttagggttttactgctgtaaacagac

SEQ ID NO: 1697 - DNA, 1200 bp, mus musculus
acaccatatatcccatcacaattctcattccttccatggttcccatttgggccccccaaataaactaattaataaataataataacaacaacaataataacaacattaataataattagtccaattgtgctgtccatatactcactggagcatgatgaaactccctgtgcccagcaccctaaagaaaactgagttcttctctgcctcagtccttgccagatgccatcaatatggagagctacactttgacatctttatcacaatttttaagagttctctctgatggctttcgttttaggctgttactttgggggtagggtagtcatagaacctttctatgtccctctttctcacctgcagtcattggtatcactactaaaggagctcccttgctctttatgttcatcagaagtatggagcccatgctccatactttcacgtggcctcaggtggagatactggccatatattatcaacatggtgccctacagcagcaaggtcatgtagacatcaacatagattcaggctgcagcataaaccacagactctcacatggcctttggtgataactccgacacagacatcaatacagccacagtaagaccttgaaagccagtctaatagtctaatagtagcatggccttggccatcaccatggcctcaggtggcagagcatgctactcacatcagcctggcccccagccacatcagggccactgacccatacctggcccttggcagcttcttggagcaccactgtggttccttgaggaggtccaatccagaatgtgacccgttccttatctcaggccttgatcattgcctagagctggttgcagagtctgtgttgacagctctccacagaccccactggacaaccatttgttccactgttgacttcagcctctctctctctcacaactcactgcctctctctaccacacacacattgttctgctcttctacctttccaacttcttcatcatacattcattcatcttagtggtacccactcaccctcaaggtggaggaggaagggtgggctatataatgtttctgaagtctgattactagcctttactattttttataggttgtactgtttctcatccatagtagttcttctagactgttactatgttcatggtttgagtttcactggatacaaatattatcataccttattttattgattatctg

SEQ ID NO: 1698 - DNA, 1000 bp, mus musculus
ttacataacaagctatggaaagagaaaaacagtgagagccagctcgtcattcacagtgatggccaagccctgcggaagttgtttagatattttcttctcttcatatttttggcatgttaaatacttctaaaattagtaatgcatattagatcaagattacaaagtcatcctcagctatttaatgattttgaggccagcctgggatacatgagactctatcttgaaacaaacaaacggacaatcaatcgtttatatggcatgcgtcgtataatattggtgatggggaagaagttttgcttgaacatggtttctgagatctagtctacaaagtcccccatctctttcagttctgtgttgttattgttcctagcaaagatctaagaaaggttagatctgcttgtcctacaacagaagccaattagtccaaagacaaggttgcaacatagaagaaccttattttggtgagctagatggtgggaacaggtggggaccatcttgtcggacagggccatctggctgaaggctcagggttggttaatatggaaatggctgagtctggctccaccaatatatttgctgatgaacctgcttcacacagtttgaactacagaattcttcctctatcaaagttgtcaacctttaaaattttgtacacacattctcagagtctcttagttagggattccattgctgtgaagagacacgatgaccagagccacccataaaggtacacatttaactggggcaggcttacaccttcagaggtgcaatccgtgatcatcatggcaggaagccaaaacagctctcattctttccaggaatgactttttgctgctgccgctggccaattgtgagattcctttacagctttcctatagggttgtcccttcaaaagttgcaagcagtccatgaagagatttgtagggcattccatacattaagggtgaattttgaggcacgtgggagaaagcatagttgtaatttctttagtgaccaagct

SEQ ID NO: 1699 - DNA, 1000 bp, mus musculus
gcttgagccactccccactttctctatcacgactaatcctagcactgcgacctgccacatggccaggtgtacctctctgctcaactctcgtccatctttccatttctgtgcccactggcaaatcttccacctctaatttcttctcccagagtccctctctctgcctggaaattcatcctccacttcctgcccagctattggctatcagatctttattgcagccaaatagatacaatgctagattgccttaggtgggtgagaaaggaacaaatagttataaaatatgtgactaatgatgggccactgaccaagatcctgacgacatgtagctctctgcaggtacagaccagtggtagtgagagctcattgttttaatgaatttagagtcagcggatgacacgtgctgactgcagatccacttgctgctgtgacagcctcgagactttgaagcatatgcttggtcatttgttccctccctctcatctcagcagctggaggatgggaagggctttgctttgtatttcccctcccagggagtttgctgcatgtatattctaacaaacctaggtttgtatagattcttattacccaaattagctcttctagatgttctctttgctttggcctaggtaatgagatttgtctcttatatttttatgtccctatatgtaatattccagagtaaacccagatgtaaaatcttcagtgttattggtatgagggtgggaattgtggtctgccctggatagctcctgagattgatgcaggcactcactcacttgctcatcattcctgtgacatacattaaatactcctcctgagacaagtgctcagggctgaggatatagcgataattgtggaggggatacaatctcccacagggcactaggactttaaagggaaacaaaaagaggcattctgtgtgggtggaagcacggtgattttgtaggctcccagaccccaagatgaacatgtgatgagggtgaagtgtaaagacaca

SEQ ID NO: 1700 - DNA, 1400 bp, mus musculus
ttcttaaagcaaacaactcagttttttttttttttttattttcaaacgaatgaactaaggagctgagcagaaatataaaactctaaccaccattattaccaaaatcaacttcaacatcaccagagataattatgtattcttacaacattttctttataaaataattctgtgaatatcctacccaatgtaaaattcacttcctctgagatttgcaacctcattctaatcacagagtgctaacaacattttacaaattaaacatcttctcacagacaaccagacaactattctttaaacatgttgaaatcatagaggacaaggaacttttcaggagccaacatagtttgtgggagaagcataatagttatagacgatctgtgggctggaatagaaaaaacatattagggcaggtaagatggctcagtagggaaagaggctggcgattaatcctggcgactttagttcaacatctcagacccaagggatgtaaaaagagagcacactcctgcaagttgtcctctgactgtggagagccttgctgcgagcaatcgcgtgcgtgccgtgagcaatcaccattataagatggcgctggctgaccaatgggcctctctttctagtgatggccgactaggtcatcttttgatacatatgcagctagagtcaagagctctggggtactggttagttcataatattgttccaccgatagggttgcagatctctttagctccttggatactttctctagctcctccattgggggccctgtgatccatccaatagttgactgtgttatatgccccagtacaggggactgccagggccaaaaaaatgggaatgggtgggtaggggagtgggggggggggacttttgggacagcattggtaatgtaattgaagaaaatacgtaataataaaaaaaaagatggtgctggctttcactgcgcctaactagtaaacaagccttatgcgcaagtgcaagagtgaactcacgcctagtcactgcccatcttgcagtgtagtaatggggtgatgggcgagcaatgaatcaggagctgtcacgccacatcaggtgctgaaacatcacgctgcgggctatataagcagcgcccttttcctggttcggggtcttccctcctgataaataagcaataaaagctttgctgcagaagattccggttgtcctgagtgtgttcttgctggcggggacaaaagctcaggatatctgacattaccacacattccatgacactgtccctattgcccatatgtaaatgtactaaaaattcaaaaggaaaattcacagagcttggaaatgttaaacccaaatgcagtctgtatacaatacagtttggtggatgttgtgccactttactggactaaaacatgccctgatagttg

SEQ ID NO: 1701 - DNA, 1000 bp, mus musculus
ccagctatactacttctgtggatatactcaaatgatgctccaacatataacaaggatacatgcttcactacgttcatagcagccttatttataatagtcagaaactggaaagaacccagatgtcattcagcaaagtaatgaatacagacaatgtagaacatttacacaatggagtactacttagctattaaaaacaatgacttcattacatacttaggaaaaagaactagaaaatatcatcctgagtgaggtaacccagtcacaaaagaacacatatggtatgcacacactgataagtagatattagcccaaaagctcagaatacccaagatacaattcacagaccacatgaagctaaagagaaaggaatacaaatgtgctgatacttcttataatggggaacaaaatactcaggggagaaaatacataggcaaagtgtggagcagagaccgagagaaaggttatccagagactgctcctccttgggatccatcccatatacagaaaccaaacccagacattattgtggatgccaagaagtgcttgctgacaggagcctgatatagctgtctcctgagaggctctgccagaacctaacaaatacagaggcaaatgctgacagccaaccattacactgagtactgggtccccagtggaggagttaagagaaaggactaaaggagctgaaggggtttcaacctaataggaagaacaacattatcaaccaaccagagccccagagctccaagggactaaaccaccaaccaaagattatacatatagtgacccatggctccagttgaatatatagcagaggatgctcttgttggacatcaacaggacaaggggcctttggtcctggaaaggctagatgtcccagtgtaggagaatgccagggcaaggaggtggaagtgggtgggcgggaagggggcactgtcatagatgcaagaggaggggggatggaatagggggcttcaaggggggaaaacgagaaaggggg

SEQ ID NO: 1702 - DNA, 1200 bp, mus musculus
gggctgtttctattgaaaagtcattgtcatatgagcttaattagagtgtgcagctagctcccaagccttgcagtccccactcctgcccttgctgggtgttaagacaagaaaagcaagccatgcatgtgagttcccaggtcccaggttcctgcgggaggccatgatgatagctgtgacacatttccaccaagggctgtgtagatgtttgtgatctgtgctgcaacctgttgccaagatgagacctgtgggctgggatgatgtaggtggagatgagcagccaacagaccatggtaattccaggttctttttactgagggtcacaaatcagctcaggtctgtcttgatgtctgtgttataggttgccaatctgaattgccaccaggggccatgtgtggtcagtgctgccacctgaagtcacactaaaatttgtagactgtccatcctctgaggagctgtattgatgagagtaaacaatgtgtcacctaaggtcatagtgatatctgtatccttgctgaagctgagtgatacacatgggtccaagccctatgtcagctgaggtctgtgtttatgtccatggttccagttaccaccaaaaggcatgaggatgtctctggagttccatgctgccacccgaggccatgtccatacccataaacagtgctgccagcgggtccttactgagctgagtggactgttctgacaccccaggctttggtgatgtctcggtccgtggtgtcactgtgagacatttctaggtccatggtcctactgcagccaaggcttgtattgatgttcttagcccatgtcgaaaccaaggtcatgcagatgtgtatttttctgttctgaagctagaagtcacttagatctgtagttccactctgccactgagggtcacgttgatgtgagtgctctgagctgccacctgaggcagtgttgatgtctgtggtccatgcaaactctgagagccttctctggggctgtggtcctattgctgaagaaagtaatgtttctgctctgcactgtcaacagaaagcaagtggaggtctatgatcctcacttcacacctccaaaatcgtaacagcttagagagaaagcaaagaaaaataactcttaggatatgaaagagaagcagatgagttgttctctacaatccacaacttctaatggagttgtgggaggcgaaagactcagtgctaataa

SEQ ID NO: 1703 - DNA, 1200 bp, mus musculus
tcattcaatttaaatcaatgcatctctatttaccctaccacactaaaaatggaataacctaatggcttgacaattgtaaggcaattaaaattgcaatttttgttttgaattagacattaatattaatattaattcttaaataatgaacttaatttttaaatactgaattgactatgcttcaatagtacctagaatggggatcacctgaggcagagggaagaacctgtgtgggagaggggagaggggaacagggtcaggtgcagggggcatgacagaagcccagatggccaggagagtaaatggaaacatggagcatctggtggtgggaggtgggaagaccctctagaaacacccagaagcctggcatgtgagagaattcaaggactcaatggggatgaccttaagtaaatggtgcagagagggaactcacagagtccacctccagtggatatacaatgccccgagtgtaggaacggagttaccaacccacagtcaaaatttctgacctataattgttcctgcctataaaaaaacagaatgacaaaaatagagaagagactgatggaaaggcagtcctaggataggccctacttggtatccatctcatggcagaggttagggatgaccaaggtatggcactattactgatgttctgatgtgattatggacaggagcctagcatggctgtcctctgagaggccctaccaacagctgactgaaacagatgcagatacttacacccaacccctggtctgaattttaagacgcctatggttgaaatagaggaaggactgaaggagatgaggggaaggcagcagtctctactaactgggaaaggacctctgggaactcccagagaccaagccatcaaccaggcagcacacatgggctggtttgaggcctgcagcacttatatagcagaggactacctgttctggccttggtggggaaaatgtgcctaatcctgtagagacttgaggggagtggaggagaggggagagaaccctctcagaagcaaggagaggggaatgggaagaggaagtgtgggaggggtactggaatgtaaataaatgaaataattaattaaataaaaatattgaattgactaaagagaaagtacataatttttaaaaaaggttgaattataagaacttttaaaggaaattcaattcaagtacttcattatgtcaacaatgggga

SEQ ID NO: 1704 - DNA, 1400 bp, mus musculus
aagcatctctgctttgaatttgttcatttaaattgatcagtagagtctgtcgaagcagagttttcatgagattgtatggaatgagaaataggcaagtaatgaaaaaaaaaccacatttaaactgaatttatttatatttctgttctcaatcatttgtcttattttgtcaaagaagaattataggttctttgaacataattactttcttttactagtatttcttcaaagttattcacagcctacgtgacttcttttaaccctcagacttaaaattggactaaagccttgtctctttaggagttagtctagtcttgtggtgttttttttttttcctttttttaaaattggttattttatttattaacagttcaaatgttatccttcttcctagtttcccctccacaagttccctatcccctccttccgccagcctgcctctatgagggtgctcccccatctgcatacttcagcagcctagcatgttcctctatcctgggaagtgaatccctgtgctcaatccaatgtgagctgtctaatctgcatctgtattggtcaggctctgaaagagcctctcagggaatagttataccaggctcctgacagtaagcacttcttgtcatcagtaatagtgtctgggtttgttatcagtagatgagacgagtccctaggtggggcagtttctggatcacccttccttcaatttcttctctactttttgtccctgcatttcctttagacagaaggaattctggattaatatttttcaggtcggtgggtggcaccatccctcaactggggagcttgcctaaccaatagatatggtctcagctggtaatacctcccctttgttgggtattgtggctaaagttctccccattgggtcctgtgaacttcttaggtccctggcatctgggactttctagtggctacccctcactgctacatagctactttcaaattcctgattgtacttctctaccatctcctctcatatctgaactgttctcccttttccctccctctcctcttttcctcagattcctctctcactctactctccagagattattctctttggtataatttttcttcttgggcttcatatggtctgtgagttgtattgtgggtagtccgaacttctttttgactaatatccacttatcagtgagtacatgccttgtgtgttcttttgtgactgggttacctcattcagaatgatattttcaagttccatccatttacctgtgaatttcatgaaatcattgttttctttcatctttcttctgatgatttttaaatgttgtattttaatagtaatatctttactttgaatattgatctaaatgctactaatagtggacatttttattctttataatgatatataattgtataatgat

SEQ ID NO: 1705 - DNA, 1200 bp, mus musculus
tcttcttcctcctcctcctcctcctcctcctcctcctcctcttccttccttccttccttccttccttccttccttccttccttccctttctttctttctttctttctttctttctttctttctttctttctttctttctttctttctttctgtactcactttacatccagattgctgctccctattagttcctacagtcacttcccccatgttcccatcccttttcctccaagagggagtgggtatcccccaaccttggcacaccaagtctctgcaaggctgtgagcaacctttcccattgaggccagacaaggcaaaccagctagaacatattacacagacaggcaacagctttagtgacaacacctgtttcagttgctatggacccacatggagaatgagctgcacatctgctacatatgtgctggtgttccatagcaactggaacaagggttccagcccttgtatgctctttggttggtagttcagtttttgagagctttcaaaagtccagattaattgattctgttggtctttctgtggagttcctatcctctttggagttctcaattctttcccccactcttctataagagtccccaagttccacccattgtttgggtctttacatccatctgagttagctactgggcagtctctcagaggactgccatgctaagctactgtctgaaagcataagagtagtgtcaaggattagtgcttgcccatgggatgggtatctagttggacaggttcttgtttacttacaagactctcaatcactatagatggtgatttcatttattttatgatttcacttagtgattgatgggaaagacgcagctcattatcggtggggccacccttggctctttttcctgagttatataagaaagcagtctgagtaaactagaagaaaaaaagtcagtaagcagtgcccctccatggcctcagcatcaactcctgcccccaggatcctttcctgtttgagttactgtcctgacttcttttagtgatgaacagtaaccagaatatgtaagccagataaaacttttccttcccaatgtctcttgatcatggtgtttcatcacagcaataataaccctagaaaagacagaatttttagtttttggtctgttgttttaattcaagtcagtctttggaaaatattggcagtagcttattacagtgttctattca

SEQ ID NO: 1706 - DNA, 1200 bp, mus musculus
taaagtcttgctattagtttcttccactaaaccttccttcttttctcattccaatcctttgagcaagtcaccttaaaaacaaaacaaaacaaaacaaacaaaacaaacaaacaaaaaacaacaaaaaaaaaccacttaaagaatcccattaagcacaacccaatattagaaaattgaggaatagacaatgtatttaattccaaaatattttttctaaaatagtataaaagaaagcacagtcacagagattgaaccaccacgctgagagcatacatgggactagccctaggccctctgcacatatgtaacagttgtgtagctgttcttcatgtgggactcataacagtggaagaaagggctgtctctgactatgttgcctgcctttaggacccttccctaactgggctgcccagtctcctcaatgaaagaaggtgctcctggtattactgtgatctgaacttaacttcactacgcagccctacactgcagctaagtagcctctccatcctgaccttgtgagagttgagtatatcctatctctgactcattctgtcaaatctctctcagatttgtcactttcaaacattgatgcttccttctgcaaacgttactttcattgtttgggattaaaggtgtatactaaggacatgtctgtattctacacagagggattaaagatgggtactgaagcttgatctcacacacacctagaatgtttttgggtgtgatcccttgtgagaacagctgtgttgtgggattaaaattcctgtatatctttccctttttctgcttaagctaaaatttgtacgtaaaaaagaaacaactattaactccataaatataagtctattttttataaagaactgttgatacaagttgatatgatgacccttcataattgcagtactgatcatcttccttcagcaattgtccactagagcattaaggttttccaatcggccaatctgatgaacaagctgtccattttcttcctatttgttgagctgtccccattacgcatgcaggtgggacatatcagttttttctgcatcacctgttctgctgtctttctgaaacttttccttcctttagtcatgcttttcatgtggaaggttctcttccttggattggatttttatcaattgtgatggaatccacagtccttcattacctgtggaaacaatttaagaatacaagttg

SEQ ID NO: 1707 - DNA, 1200 bp, mus musculus
aatactactcagctattaagaatgaggacatcctgagttttgcaggcaaacggatggaactaaaaaatatcatcctgagtgagataactgagacccaaaaagatgtgcatggtatgtactcactaataagtggatattagccaaaaataaaaaataaataaaatgtagaataatcaaggtatagtccacaaaactcaaaaacttcaacaagttggaaatgcccaagtgaggatacctcagtcccacttgggagagagaaaacgtagtaacaactggcgaggaagggacctgggagagaaatgaactgagagagggaaggagtcgcggggggtaggggggaggcagaaacctggtcttgtattgggtgagagaaacagaatgaagctctgaaggccagcaggaagagtggaaacaggcaacctcaggaaataggaggttggggtaaccctccagaatgcaccagagacctggaatgtaagagactctcgggaatgaaaggaccttagatgaaatgccagacagtaaggagagggaacttatagatcccacctccagcaggaagataggacatcaattgaggaatggggttgccatcccacagtcacatctctgacccataattcttcctgtctgaaagaattacaaggatgaaaatggagagcagcctgaggaaaacaaggtccagtgacaggcccaacatgggatccagctcaagtggaggtcccaaggactgacactattactgaggctttagagtgctcacaacaatggaactatcatgactgtcctccaaaagacccaaaacgcagctgaaagagtcagatgcagatatttgtccaaccaatggacagaagcagctgacccctgttgttgaattagggaaggcagaaagaagctgaggagaagggtgattctgtaggaggaccagctgtctcaattaatctggacctctgatatctctcaaacactggaccaccagacagcatacacccgctgatatgaggcacccaacacacacacagtagaggcattcttggtctgtgttcagtcagagatgatgcacctaaccctcaagagactggaggccccagggtgtttagaggtctggtggggtggggggacatccattcagagacagagggtgtggagaggaggtgtaggatgtggagcaatcagagagtggatgtggatgaggaatgg

SEQ ID NO: 1708 - DNA, 1000 bp, mus musculus
tattttcctcatttacatttccaatgctatcccaaaagtcccccatacccaccctcccactcccctactcacccactccccctttttggccctggcattcccctgtactggggcatataaagtttgcaagtccaatgggcctctctttccagtgatggtctattagaccatcttttgatacatatgcagctagagacaagagctccgggatactggttagttcatattattgttccacctatagggttgtagttccctttagttctttgggtgctttctctagctcctccattgggggccctgtgatccattcaatagctgactgtgagcatccacttctgtgtttgctaggccccggcatagtctcacaagagacagctatatctgggtcctttcagcaaaatcttgctagagtatgcaatggtgtcagcgtttggaagctgatcatgggatggatccctggatatggcaatcactagatggtccatcctttcgtcacagctccaaattttgtctctgtaactccttccatgggtgttttgttcccaattctaagaagaggcagtgtccacacttaggtcttccttcattttgagtttcatgcgtttagcaaattgtatcttatatcttgtgtatcctaagtttctgggctaatatccactcatcagtgagtacatattgtgtgagttcctttgtgattggggaaatgcaaatcaaaacaaccctgagattccacctcacactggtcagaatagctaagatgaaaaattcaggtgacagcagatgctggtgaggatgtggagaaagaggaacactcctccattgttggtggaattgcaagcttgtacaaccactctggaaatcagtctggcggttcctcagaaaattggacatagtactaccggaggatccagcaacaccactcctgggcatatatccagaagatgtcccaaccggtaagaaggacacatgctccactatgttcatagcagccttgttt

SEQ ID NO: 1709 - DNA, 1000 bp, mus musculus
aaatgtagaaagtctgggtttcaaccgcagtttgtctgatcgaagtcctttcacagtcttgctgctatgagttgggtcatagtccagggatgtagttgactgtttcccaaggcaggattcacaggacaataaggcaagaggtccatagcatggactcatgggagggtgtttgtttgtttgtttgtttgtttgtttgtttgtttttagtgtagatattgagttctgaagtgtgacccaagctcaacacttttctaatggatagtactaaagttttcaatttgcttctcacacattgaggactggcatgaattatttactattggaaagaaattaaccctttagttgacttttggcagcttcaggtcacatttgtgtacagagaataagaaactgaaatattcaacctgaaggtgacattccttcctgcttttcttttcttatttatttatttatttatttatttatttatttatttattattattgggtatttattttatttagatttccaatgctatcccaaaagtcccccacaccctcccacacccactcccccacccacccactcctacctcttggccctgacattctcctgtactgaggcatataaagtctgcacgaccaatgggcctctctttccactgatggccaactaggccatcttctgatgcatatgcagctagagacaccagctgggggtggggtactggttagttcatattgttgttccacctatagggttgcagatgcccccagttccctgggtacttcttccagctcctccattgggggccctgtgatccatccaatagctgactgtgagcactcacttctgtgtttgctaggccctggcgtagtctcacatgagacagctatatctaagttgcattttacaaataatatttttcctattgaaacattaaggccatccatccttctaattgtaagttgtgtcctacaaaatttctcgtagctgggataccattaagtttaattccaag

SEQ ID NO: 1710 - DNA, 1200 bp, mus musculus
accaggaaatctcataggagaaactacatcaagagaaacacttattgtttggtaagttagttatgataggagttaaaaagagacctctaggattagcattttagaggtaactggtaaacctgacaagtatagttttgaaataatgaccacaagacaaacctgaattcagaggataaagaaaaatatgaggaatgaaaattgtgttactcagtatagcaaaatgtctctaattagaccaaagtgtggatactccatcccttcttagaatagggaacaaaatacccatggaaggagttacagaaacaaagtttgaagctgagacgaaaggatggacacatccagagactgccccatccagggatccatcccataatcagccacgaaatgcagacactattgcatatgccagcaagattttgctgaaaggaccctaatatagctgtctcttgtgagggtatgccagtgtctggcaaacacagaagtggatgctcacagtcagctattggatggaatacagggcccccaatggaggagctaaagaaagtacccaagagctgaaggggtctgaaaccctataggtggaacaacaatataaactaaccagtaccctcagagcttgcttctctagctgcatatgtatcagaagatggcctagtcggtcatcattgggaagagaggccccctggtcttgcaaactttatatgtacaggggaacgccagggccaagacgtgggagtgggtgggtaggtgagcagggttgggggagggtataggggacttttgggatagcatttgaaatgtaaatgaagaaaatacctaatgtaaaattggaaaaaaagaaaaagaaaattaaacagttaaaaagtaagattatcagagttacaacttgtcagtaaattggtttttaaaggattatttttaatatggaatataaatagcatcttgttggctttgatcatagccattactacaaagtgaaatatgatgaagataaaaaggaaaatttccaatggaaggttcttgaatagatgctgaaattttgtggtaatgaacaggaggtttttagaaaagcaaatgctacttatttgtttttaaaagactaagtgagcaaagcatatgtgtacccctggaggttgatacacctgactgcacctttctgagattttctgtttcctactatgttatcagtagaaaaaaaga

SEQ ID NO: 1711 - DNA, 1000 bp, mus musculus
tcaggcctaccgtacaggagttctgataccaccgtgttggagtcgtagaaggacatagcaggaactccactcttggcatgtggagtgtctgcccacgcctaatggcaagctgagctcttcatcgcagtgcacagggattcttctccacgagtggatgttttcattgcccttcataagggctactcaatctaagggtctgatagaagaaaagccaacttctcatggtggcgattctcatagaaagcaaacccaaggtttgaaaagcagcaggaatcctaacttaatatctgattctttttgaaacacaggtccactagttcttgttatgtaaatcttacctgtgccctttagcagcctctgtgtggcagcgatgcggggcaagcatgaacgtcagttacattgctctatgtggtgttcagatagctgtgatttctgcacccctaatttcttgttctctatttgcaggtagtgaaatcaaagttatccagacagcaccacgttatcaagatgaaaagatccaagaaccatattgtggggaagtacttcagtagtcaaagcaaactaaaacaacacaattctgtcccaaatcttcattcaccgtatcatgtcagaggcccgataaaccaggtttgtgctgaaatcctgctcagcagaatgtgtgcgagtcagaggtctgcgcaggcgccttgaaagagagccgattgcgcagactccctggaggagagccgaattcactgttggagatgaacctttcacctcaacctgagaaccaaatgagcctcacacgtactctgcaatgactgtacaatcaccagcacaagcgcgcacagccaagcacacagctcacaaaaagcacaatgacacatttttctcatgaccgcacacacccacaagtgaccttgagtatccgttagtttcaggtcgaagcacagagctgtacggagatcacttgaagtgtgatctcaaagtatgaccacgtggaccaggtactggactgcaa

SEQ ID NO: 1712 - DNA, 1400 bp, mus musculus
agattctttcttctatctcttgtattttgttggtaatgcttgcatctataattcctcatgtctttcttagttttttttgtttgtttgttttttgtttttatctccaggcttgtctccctttgtgatttctttattgtttatatttccatttttagctcctggatgttttttttttttcaattccttcacttgtttggttgtgtttcccagtaatttaagggatttttttgtttcctctgtaacggcttctacctgtttacctgcgttctcctgtatttctttaagggagttgttcatgttcttaaagtcttctgtcatcatcatcatcatgagatgtgattttaaatcagagtcttgcttttctgctgtattggggtatccagggcttgttttgttggaagaacagagttctaatggtgcgaagtagccttggtttcttttgcgtatgttcttgcccttgcttcttgccatctggttatctttggtggtagttggtcttgctgcttctgactgtggcttgtccctcctgcaagcatgtgtgtcagtactcctgggagaccagttctttctgggagaatttgagtatggagagctgaggcacaagatcagctccaggctcagacagaaactggaaagctgttttttgttttgttttcttttgttttttattgttttttttgtttgtttgtttgtttgttttgagacagagttcatctatgtagctttggttgtcccagaaatcactaatccactctttagtcccactctctagaccaggctggcctccaacacagagatctgcccacctctgtgtcccaaatgctggaattaaaggtgcttgccaccactggctggcataaaaatcaagttcttaacaaaattttattttaccatataatgaattcatctacaaaaccaatataatctcatccttatctttggatttccagacctgaaatcagtgattttattttgagtgttttggaaatcacttctgactttcctttgtctaaagttattattatccattgttcataaatagattgactttgtgacatatccttgtggctgccatatattaattcacataacacttttcttttgtaatacaataagattacataagattgttagtgagcaatgggccttctctggatcctttctggatttgtaagtatgctgcattaattttttttctctttctcccaccatatctgattccttccatgtaactctcaaaataataataataataataataataataataataataaatatttaagaagctgaagtttgcatgataatgtatcagtgtctttatgtatatatgaaattactctctggccttaagtagctttggggacagaaatcaaagctcacctcttctctcacacagc

SEQ ID NO: 1713 - DNA, 1600 bp, mus musculus
cctgttagaccttctgtgtttgcattcctctgttttatgtaagaatctagtaacctctttgtaccttgttggtgtgtcacccgacttccttattgtcttctgcataaaaagtctgatgctcgatttgacattacattcagatcctacacaaactctcctgtgtgcatctgtctgtcaattcatctgacgctttgtccacccggtttagagacctgttccacgcagacaaaggggcccagagggtctgcagcaaacactgtcatggagagcccttgtggatctttgcctttgacaaaataggctctgtcagatcatcctgtgtgcatgtgaaagtcctccagaaggtgacatgaggacagaataagtatcaaacatttcaaggtatgacaatgtccttatgtaacaaagtactgtatacactgaatatacacaataaaattgtacaataaataatattaaaataatgacaagaccaataacaatgttgaagaggttgggggatgaggagatagctctgtggttagggcttgctactcaagcatggaatttggatccctagaaccatttaaatgtaggatgagagtagccgcctctgtagctctagcttcctagtgaggtagatctccagagagagctagcctggttagctatactagccatatctgagtatttgtgagttctgggtttgcttagggaaccctgtcatatggcctcacacaaccgtagtctgactccaagagtcagtgccttattgagtaagatgtaatatggaaggatgagtcccagcatcaacctcacatgttgccatacatacatgccagttgacctacacatgtgtccaacacatgcaaatgtgcacacacatacccacccacccacacacacacaccacaagcacaagcatgcacgtttgcacaccaaaactagaaaaagacaagaggaataaaaaaacaccaaaaatgaagtagtaatgatttgttgagagaaaccttccagagaaaaagcagtcgcagagagggggcattcccacaatgtgtagtgatacatgaggaagaaaagataaaaggaagagtgtcttggtaagatgttacaactgtttcatcactcctagaacatctctcctaagcccagggggtccctagaactgtgaaaggaaatgcactgggtggaatatggctgtatagtcaggcattgactggaacaatctcagggacagcatggacttaccctccatgcttcagcagctccttgatgttacggtagttggatgcagttagcttagtacatccctcttaacaaagctctctcattgattccttgcaaggatgcagtaaggctctgctgtcccaaagagtggcactgggcttctttgtagcttttgactagagcatttcaggtttcccctgtgaatgccttagatttaagatgcaccatataagcccctcctttctctgggtaaccttacccctgaatgctcatttctatatgagccatttcatactacaaaacaatccttattagcatataaattattctgaatttaacctgtattcctactaggaaaggtacaagttcaatatgtcctatttttcttctagca

SEQ ID NO: 1714 - DNA, 1200 bp, mus musculus
cctgaagttgacaacaggtatcttttaaattattgtctattgtgggaagccacgtgtgccgttgcagggtggcactggctactgctggccaccatgcataagtttgggcaaacaaccaatgtgtacatatgcagtaaagttttttgccaagacactgcctggcccgggcatgataatgaggttctgtgaggtactgagagaataaccaatcagatgtgagacatgcaaatgaggtatgttaatgaggttctgagagagaataaccaatcagatgaggaacatgcaaatgaggtagaatgcataaccaatccgggtgtgagacacgcctcgcctaggcctatataagcagcaccagttctgggcttggggtcttttcgcctctgcaatcaaactctcccaataaacgtgtgcagaaggaccctgttgcaggtcgtgtgcaagagtctacatgttttgttttgttttgttttgttttaatgcaaaaagtaagaagaatttattttcacagtgcactgtggtcatctgcgacccgaaggagaggcagcccatgatttttgttgaggcagagtctcactgactctggagctcatcaaccccagctagttcatgtatctgtcttctctcaggctccactgcctctgtcttctcagggatgggattatagacagctaccatgctggtccaggttttacacaggtttggggaatccgaatttcagtatttatgcttgaacaacaataaatactccattcaatcttgctgtcttcatatggtgttttaacaagcatcagaaaagaggtatataatatgaaacattcccagtatcattgtttttatttgttcaatgaaaaaaactacttatgttcttatcatgattccaggaaaccaaagcaaaccaaacaacaacaataacaacaacaacagccagcctctcttgattggtggggcactgtggaagccatactaatttagctgaaagcatgtccctaggaagtaacatgaggactgagatttaattttagcagaagaggacagagtttgaagatcttaagaccaagatagatgccttttgatatttcttctgagattaagattctgtgagttttcacacactcagaaattcatcttctaaaatatcttagtctaatcacttccctctatttttttcctctctacttcatgtgctagaggcttagataa

SEQ ID NO: 1715 - DNA, 1200 bp, mus musculus
aatggtggggttggttatggaagggttgttaacactcgtcagggttaatcagggttgctctacggctgactttgaatgtattttaagtttggtcttcaagttgtttctgtacatgctgaacagttgcccacttttgaaataagtagctggttcttagctaaccacaagtggccattcattaaaagactacatggccatggctttaagctagtagacagtcattattaggcagccagtaactatactgggtgtttgagatctcagtgtagcattgtgcctttctcagggtggcttataatcaaaaacaaacaaacaaacaaacaaaaaaacaaacaaacaaacacaaaaaccaaccagccaaacaaaaaaactcatgttctgggttgacatacttcagttatcaagaactgttagctaaagtagacctgcagaagctacaaagcaaagttagtacattttgagagtttcccagaattatatggattctgatggactagaattttgtttttatctgggtaggtgatgttgtctaaatgctgaattttacagtctgaatctgtcttatggtttccacttatttgaagagacaacacgaccaaggcaactcttataaagacacatttaattgagcctagcttatagtttcagaggttcagtccattaccatcatggcaggaagcatggcagcatccaggcagacatggtgctggaggtgccaagagctctatattttgatctgaagacagcaaggaagagactttgtctttggcaagcagccaagaggaggctctcgtccacactgggtggagcctgatcatagagtgcctcaaagcccatgtacactgtgatgcagttcctacaaggccacacctacttcaacaaagccatacctcttaatagtgctacttcccatgggccaaccacccacatgcaaaccaccacagaatggtacttccatcccatcatggagtcaattgtgctggggccttattaaaagactgaagctgtagccattctctgtgtcgctgtagcccatttctactttctgtatgccacttccttctcttctggctataaatataacatggccatgtggtgggacaggattctgtaccaattttgggctggagagattccaaatctcaaattgcttcaaaactcaattaagatctgcagaagttaaacttgttggaattttgt

SEQ ID NO: 1716 - DNA, 1200 bp, mus musculus
aataggcagatattttaggatatgtttatataatcttgaattatctgtgaaagccagatgagtaccggggacattgaaatgcaagagcatattcttgggactatttggtttccaaagttctttcagagcatctagttctgcaacaaaaacatccttttgctcctgaaactggctcagacagaacataatgaacaaagaacaatgtctgctggatggagcattggaggtaagcccatcatttgcttaacaaagcaaggcagaagtctacctctccagggctcttttcatctagaaactgggtttggaaccagctagacataagctctgtccagtgggatccatcacttcctgcttttagaaaggcacaaagaataggctcctttgtgtttccctaccattcacctttttttgtcagggctgctgctggaggtgtgcttaaataatgaaggcttgtacacatttcctttttccccaaccgggggattcacatcctcattttcccagagcaaggtgaagctgcttttcaattcggcctactttcaaaagccgatgtaaaataatatgaagaaagtctttcctaatgagacagttaattagaagggtacagtctcccatgtccctttcaatgcctttcattattattatttctcttatccttgaatagctatgacattcttttctgaaagcagggagcagagcaggtgctctttagctatctagatactattaaaatcaaacaagttggcccttgtatcttctagcaagccacttgtttctgtgttctaatttttgtataattaatgagacttttgtgtttgtgtacgtgtgtacacatcacaaggttgaattcagtgctcatcagcgtgaacccagctttgtctcttctgactaccagaacaggtccacctctttgaaatggaaatttacaaaacacaggacaagactgaagtcaagccacaggctggtgctgtggtttaaaaaggggtaacactccctttatagatctgactcatcgtttcattacctggtggacatttcaacaacattgttcttgcttaagtagactcttatcaacgttcacttcttcagacacctactctgatggggaagatgtccacaaagaacaaactaaaagcatctaaccatgaaatttttgtctagcttttgccagacaacttttaaatgctgtcaaaattcacc

SEQ ID NO: 1717 - DNA, 1200 bp, mus musculus
tgggaggtatagggtgggagggacttggcagaaagaaaggagagggagaggaaaaatgggagcaagatcaggtgtgggaggagacaggggagatgtacagaaggtcaggaattaaacagaggtgtgtagcaatgggggatggggaactaaggtgtagccaacagaaagtcccagactccaggaaaacaagaggctcccaggatctaaggaaaagagaggccgaggcatgagaatttctgagtttgtggccagcctggtctacagagtgagttccaggtcagccagggcaacacagagaaaccccatctcaaaacaacaacaatgacaacaacaacaacaacaacaacaacaacaacaacaaaggggagagagaacctgtagagaccatattgagaggttagacacagcccctgtttgagggatggggccatcacccttctcaaaattttaatccagaattactcctgtctgaaggaaatacaaggacagagagtggagcagagactgaaggaaaggccatccagagactgccccacttggggatccatatcatatgcagccaccaaacccagtcactattgtggatgccaggaagtgcttgctgacaggagcttgatatagctgtctcctgagaggctctgccagagccttatcaatatagatacagaagcagatgcttgcagcaaataattggactgagcactgggacccaaatggaggagttagaggaaaggctgaaggagctgaagcagtttgcaaccccataggaagaacaataacatcaactaaccttacctcctccccaagctcccagggactaatccacgagccaaataatacacatggagggacccctggctccagttgcatatgtagcagaggatggccttatctggcatcaatgggaggcccttggtcctgtgaaggcttaatgtctcatcataggggaatggtagggcagtgaggcaggagagggtgggtgggggtaggggagcaccctcataggggtgtgagggtatgcagaggggaaaccagtaagggagataacatttgaaatgtaaataaataaccaataaaaaagcacctaattaaaaaaaacatagggacatagacacaatgacacttcatgcaatagctatgtgattatgacatcattatggacactgtttaagcaacaatgtcatcacttgcttttagcaa

SEQ ID NO: 1718 - DNA, 1000 bp, mus musculus
cacagtgtgtatttaagaaaaagagggggcaggatcaggtgtgggaagagacaagggagatgttcagagagtcgaaaaattaaacagaggtgtttaggattgggggatggggaactggggtagttaccagaaagtcccagacaccaggaaagcaagaggctcccaggacacaacagggatggtattagctgaaatagccaacaaagggggaagagaactgtagagaccatatccagagattatgcacgggccccggttgagggatggagtcccccacccttctcaaaattttaacccagagttgctcctgtctataggaaacacagggacaaacagtgaagcagagagtgaagaaaagaccatccagagactgtctcacccggggatccatccaatattcagccaccaaagccagacactattgctgaccccaagaagtgcttgctgataggagcctgcaataaatgtcttatgagaagttggccagagccttaccgatacagacggtgatgcttgcagccaaccatcagactgaacatggagaccccagtggaggagttaggaaaagggctggaggagctgaaggaatttgcaaccccatggggagaataacaacatcaaccaaccagaacacccccctaacctccaaggattaaaccaaccaccaaagaatacacatggaaggacccatggctctagttggatatgtagcatcaatgggaggtccttggtccggtgaaggcttgatgccccagtaaagggaaatgctagggcggtggggcaggagtgggcaggtgggtgggggagacccttcggagaggcaggggcggggtactagatgggtagctctcagagaggaacccgggaagggggataacatttgaaatgttaataaagaaaataagcaatagaaattaaatcaaaacaaaacaagggaatgacatgttggcatagataggcccaaaaaggggatggttttaggcacccttcttattgctga

SEQ ID NO: 1719 - DNA, 1200 bp, mus musculus
tgaagagaataaggaactttaattagtatacaactatgaactacatctatttttttcttatatttggaactgcaatgcaaagtatattattaaaattctttagtgtgatacctacagtcaataaatgtacaatatccattgtaaatgttctactggggcagactgctggttagtctgcttccctggcagcacgatatcctgacccagcccagaagatctgctgcattcagagcatttggtaagaacactccagaaatcccacaactgcctctatgagtccagtggacatattaccacccaatcccttcccttttgcctggtcctttctgctagggcagactgctaagtagtctgctcccctggagacaccatgccctgaaccagcccagaagatccactgcactcagagtaactgacaccacagacagaggcataccaggaaatctgctgcccacagggcaactgatactgaagcctgagacatccaaggagatctgctacacacaaggcaaccgagcaactgatagtcagcttctatgctcccctgaagacaccacaggttgaaggcatcccaagagctcctctgtatactgggcaactggacatcagacactagagtgtgaagacctgctgaggaatctatggcatgtagggaaactgatacaacagactggaagcctccctggaattctgctgcacacagggaaacagaagccacagtcagtaggaccccctcccccacaaagaacatcttcacacaggacaacagcttgactgctcctctgaagacccaacagtctgaaggtcttacagcagatctgctgcatccagggcaacagagcagcagcctctctgcccctctgaagagcccccagttggacggccccacaggtagtctgccactgccagtgcctcaggcctaccaggagacctgaagcagcacagtgacaaaaacaaatatatcagaaaccaacagtcaactgtctctcaatattaatggagtcaacttacccataaaaagacataaactaacagactggatactcaaacaagatccagcatttttctgcatacaagaaacagacttcaatagcaaagacagacactatctcagagtagaaggttagaaaaagttcttcgaagcaaatggtccccagaaacaagctggaattgcaatcctaatatccaataaagtggact

SEQ ID NO: 1720 - DNA, 1000 bp, mus musculus
aaaagaaatgggtaggtaaggggttcaggagggaattggagggttaggataaggtatggggaaagccaggagaatgggtgaaaatcttcagctgctgggggtgagggagtgggagggaggtatctctaggaagttccagggaccaagaatgaaggaggcttccaggagtcagtgtaggtaagcttaggccagttgtctaaaagtggggatatggaacttgaagtggtcacctcttgtagacaggcaggatgccactgtagtgataaagataccaactcaccagcaaaactttcaacacaaaacttgtactgtctaaaagcaatgcagggacaaaggtggaacagactgaaagaatgataaaccaataaacaggcccaaactgagacccattccatgagcaaccaaccacctatttctgacatgattaatgatactctgttcttcttgcagataggcacctaccataactgttatctgaaaggttccaccgaaccactgaatgaaacagtacagacactcacacccaaccattggatggagcttggggactcttatggaagaactggggtaatgattgaagacaatgaggaggataggaaatccaaagaaagatgaagagagtcaacaaacctggacccctggggagctctcagaaactgagccaacaacataagagcatacatgggctggactgagggccctggaacatgtatgtagcttagtctcatgtgggtcccccaacagttagagtaggggatttccctaaaactgtatcctgatgttggaattggttcccattctccaacatggctgccttgtctggcctcagtgggagaggatacacctaatctaatcttgcagagaattgtagaggtaggggtacttggggtaggagcattatctcagaggacaagggtagggggcttggggaaggcactttgtgagagaggaggactgggaggagggcagcatttgggctataaacaaacaaacaaacaaa

SEQ ID NO: 1721 - DNA, 1200 bp, mus musculus
ggacaaacagtggaattaagaattaagtaatgaagaaagagaataatggaacagaaatatagctttagatttttcaaaacctactttatttagggttctttatttttccttcggctcttggattttattgtttttaagtggatattttatttgtttgcatttcaaatgttattccctttccaggttacccctctgcaaacctcctatcccttccccccttaccctgcttctattagggagctcacccacccacctacccacctattcccacctcactggtatagcattcctctacactggtacataaagccttcacaggaacaatggcctcccctctcattgactccagataaggccccttcagctccttcagtcctttccaaaactccttcattggggtccttatgttcagtctgatggttggcttcgagttcctgcatctgtactggtcaggatctggcagagcttctcaggagatagctgtatctagttcctgtcagcaagcatttcttggcatcagcaatagtgtctgagcttggtctctgcatgtgggatggatccccaggtggggctggcctttccttcagtctctgctccactccctgtacctgtattcgctttagacaggaacaattctgggttaaaattttggatatgggtgggtgtctcatacctgaaactggggaccatgcctaacttctagatatggtctcaacagatctcccccccccacctcctggtttgtgggatatttaagctactggcatccatgtggggtcctggaatgctcttgttttcctggcatctgggactttctggctgctaaccccagttcctcacgctccattgctaaacacctctgttcaatttccagatcctctgtacatcctctccatctcctaccatacctgattctgccccgtttttcctctctacctcctctattcctcccaagtccctcctaccctctactttccttgattatattgttccacctactaaggataactgaagcatccactttgacttccttcctcttgaccttcatgtggtccctgagttatatcattaatattccatgctctttacctaatatccacttgtcagtgagtacatatcatgtgtgctctttttgtgactgagttacctcactcagggtaatattttctagatccatccatttgcctgagaatttcatga

SEQ ID NO: 1722 - DNA, 1000 bp, mus musculus
cctcaaatatagtcacagagaagctagtcaccccacagtcatgccatggggttcttgccttggtaagatgactgatgcctgctctctccgagcagcttgtgtagtaccttccagcactatggttgctggccagccagcagggagcaaacttccagctcagttttagcttgagttttccataccttgcaaccaaggtatgtattgtcttcaggaacaggttctaattctccagttcttgtaggaaaacaaaaagaacagagagcacgtacactgtttctgggccctttggagactttctgatcaacaattcataaggagatagctagcacctgcactgggatatttatttggtagctttcaagtaaagtattatccagccatacaagaagctcgttccaacactctttttaaatttatatttagtaatgatttacaaattaaaaatactcagctataaagagaaatgagattacaaaatctgaaaataaatgaataaaactacacaaaaataactgaaacactacaaaataaaactacaaaataaaaaaaaaaaagtaaaacaacctgaagtaacccaggcttggaaagataaatgctgtgtattctctctctcatgctgatcccaatgtcaaatcaattacttctgtgttcaacttgaatcatctgtacaagtgagcaaaagcaaaatacaaaagttcgattggttggcatgcccttgggatggccgatagtgtaatataagagatacgaaaacagaaatggagcattttagaagtggaaagttcaggttggaatgagagcagagcaagggagagaaggagggaaggagggaggaagggagagaggaagggatggcggaagggggagtgagggttaaacaaagtaaaggatcatgcctgactgtttatggggaagataggatctgaacaaagatccttaggcttgcattgcaaactttttttcaattgacacacttccgcaacttcatactatcacatta

SEQ ID NO: 1723 - DNA, 1200 bp, mus musculus
gagcagagatcttgaagaagccataacgcaggtctgacatacctaggaaaggctagaggggatacagactgaagccgggagttctaaggaagctgtggccaggagttgaagggtccccaatagctcactgagggaccatgaatgtcacatgattgggccatcacgactttaactgtgaccagtcactgggaatagcccaagagaagtaagacatccatgtatagcctgggacagagggcctgggaaaaaaagaggggctaagccaacaagccttcccggagcagctatggaaaggcacggtcctgtggtcaccggcgacaatattctagagaggatcccgtttctaaggatggtgagtttaggatgacgagtccttggaaacaaggactaattccacagggagcaatggctattggcgataaagttacaggaaggggaaagcctgacgcttgagttcaattatagatgtgcatgatacaactctgggttgtatcatgaatttggaccattagaatcttctggcagatgggagtgggaggtggagcttgatgagagcttaatgaagaaaacgatgctggctttgaagaactaataatggaaagaatctgaaagggaacagagagtagttacaagaaatagggaaacggaatcatgtgcggtgaggtttttaaagaagccggggattttgcaggcgggctgaagaaacgcatcgcacggagcaaggagtggcccggcgtcccgcgtggcagagcaggctgcggcagcagcggggggcgagctgaggcgctccgaccagcgacgacgacgccgaggcggccgtggatgcagacgacctgggcgcccgaggtacggcggtgcgcgcggccgcgggagcgcgcggcggcgtcacggggcggctgacctgccgagggcgcgcgccgcgtgctggcgctccctggcggcgccgcggagcttggcgcggcagctggaggcggcctggcgcgtggtgacggcgcccgcgggcggacgcaggatggcggcgctgcggggcgacggcttcgccaggcttcggcccgcacgggcgcagcgaaccccagggaagaaagacaaagacacgccggttagcaacgggcgggaaccgcgcagcccggggccgaggcgccgcgtccccaccccgcacccttcaggtaaagctgcgcccaggagcccggcaccccgcgg

SEQ ID NO: 1724 - DNA, 1000 bp, mus musculus
agaatgtttgccaagtatgtgtgtgggcctaaattcaatccttagttccattatcactccccctgcaaccccttcaacacacacaaaaatggtgtgttaatgcccaggaagttctcaaggcagtctaacaaaggtctttatggcctagggccctcacacccacagtttaaagtcccacagacctccccaatcaattccaaataggggctattccacagttactgtgcagtacaggagctaattctacaggacatcactaaaatcgtctgaaatccttgaaaaggtaactcctgacctcttcagcggggacttctgcgtctcctagttgaattctgaaaagctgtagatgggtctttgttaagagggtcactatgagaaatctgaaaactcagctaaggattttcttatacatctggcctgttgaaaaattggttttcatcatctgcttaagcagttttatccctgaaagaaagaaatgcaaaggaggcctcttcttgtctctccaggttagcagagaagcatgttcccttcacagcgattagctgagcctgcctgcgacttttgtgcctgttgtggcctgccagttccctgcctgccttccctgtggcgttttagctgatctgtgcagtttgtagccatatggtcccctgagcacgtggcttggcttccctgtccttactgctggatctgtgggcattgcagatttcacagacctgaatagcattgttgggggcagggggaaagcgcttgtcatcaagagatgtcttctcactgccctgcttgttagagaccttctctgcttgatagcataaacaacactcaacattgtgttttgaaaagatgtaaaattacgcaaactccttccttcaagctcattctttgagactttgcttgagagctcacatagttggctggcattgagagccaaagccaacattggagagcaggttgtaaggtaactagggctgcagcatggatctgctggagtgcaggtatttag

SEQ ID NO: 1725 - DNA, 1200 bp, mus musculus
tgtgtgcacgctcactcacactttctgacacacctgctcattcttgttgagtagcatccagtgtacagatgtaccattggttatccattctctcacattctctcatcaccaggacatttggtttgcttctaatgtgagacagttatggatagagatgctctattcactcaaatatagattcctgtatgaatgaagtgatcatttctcttagatcagagaggaattgatgagggacgtgataaaccaatggttgatcttatagaaaagtgttaacgtgcttcccagagtcgtacaggaagctcccgagtgtcccgttccagcagctctgcctgtttccagccatttcacagagttaggttggtcatttgatctttgccattcagatagatgttatgacgggggagggagggtgtgctttgaaagcagcttcacccctgcctccagagtgttgcaggtgtggctgctgtgtcacatgtgcatcggtaggtggcagcaggaggagagaagttaacactctgttctgacctatgagcatctgaatgattcgattagtaacctaacattccctgtaaaaggcaagcccaagactaccaccagtccagcgccaaggtcctgcatgcacagggaactcacctgagatgaacaccagtcctgttccagacaggcctgtatagacttccaggacagggaacaagccagagactagaagaactctacctgggaccagagggtccccaggtaagcctgggacagaggacccttgcaaggggccatttgggtgggtcaggcaaggagccagcctgagatggccaccagactaacccagacatggaggtagcatgagatgaccaccagtccagtgccatgcaggcttgggaggacagaccaagcccaagatgacccccgcctggtgccataatgcacaagtggaaactagcactcctgaaaccactcctgagatgaccccagatgctcagagactctgggtgccactaagaggagcaagtgagtgatgaagaaatggaagagtaagagaattagaagcatgtaggcacaatgaagaggggcagagctggagactcgagggtagtgagggacagcctgatgtgagtagccaaggatgccacctggaccaggatgggatcctaacctgtgctgtcaccaccaggagctacatctaggtctgaggccctcagcaac

SEQ ID NO: 1726 - DNA, 1000 bp, mus musculus
ggactggggtatgcataggatacctcagttaaagtagctattttagcaggtataaaggccctccttctcgtgtgatgctggagcagctccagcgactttattgtttgcctcattgtcccctactgttcagctggctgttctgaatttgttttctctagggcctcagagcctagatacatagctagtctgtgagtctaaggaagcaagtttagtttataacaacttggttttgatgtgacacattggggtcttttaaagttattatgtgagtgtatgcacacttacatgtgtgtgcacactgtggtatatgtgtggagatcagaggacaacttagggaaatcagttctgaggagtgaactcccctcagtaactgaggtggtgaagactctgcctactgaggcatcttgccagccttcacacatttcatagggaacggtaaggagctctgcctgccacagacatcctgacagcacagttgtgtctatgccacagggcatttctgctgcctctctgcagagctgacatctgtacgctcttactctggatgctcaaaaacagttttttagatatccagaagagatcatctctaagcagtatacctttcttcaaaccttaaggccatttcttataactgaaagtaattgcttcccttgttttgtgttttctaggtttgaagaaaaggcccaaatggatccccttagtgctctgaagtatttacaaaatgatctttatataactgtggatcattcggacccagaagagacaaaagaggtaaagaaagatggataaatgtttttcttgtgtaagtgcttaaaggaaatgaagaactatgatgcactgcccttaaggatgctcagttggataaaataaaagtgaacagctgtagtgctaaactgctgcactccagcattgggaaggttggtgcaggaggatcgatcactaattaaaggctagccgaaatgacaaggtatctcattacaccatctatctgaggggaaag

SEQ ID NO: 1727 - DNA, 1000 bp, mus musculus
gctgcctagcttttgcaccatgctaagattcaaagggatggttcaagtatggcccgtttgctcactggagtggagaagtcactggggtctgcctgtctctgaggcctgcagatgattctgatggaattgctcatagtgatttgggcctggggcaggtagggtgatgtgcaggagggaagtgatctgtacagcacatgctgcccatgtccccatcattaggctacatggtttctttttgctttgctttttatattccccatggtcctgcaagctctcatgccggaggaagaggagtcactctattccggtcaagcaggtgattctcagcacagtggaccatgggggtgaccagctgtgcagagggacatggcagtgggtgtcttctgcttacagaatgaatgaagccacacggagtcagaagctgtatggatgggatgggggcaacacaagaaagacttcaaggcatgacagggagggtggaatctgcacttgggactgtcagctaggctagagaacgttctccttgaggtctagcttccagtcctctaggttagtaagcatactggtgcccttgattgtagggctacagcagtctcagtggcatctgtgaaataacaatgagctactgattctgggctgcagtgtcaaatttctattgcaaaactccccttggagttgtgcaatgcacagcctgtccagacatattcagcagccatggttgtgagtcttgtccagtaattatgtaagcaaatgggagtcagtctgtttgcatgcccccgttcaaaagaaatagggcagaaaaaggccaagtctccccaggggcacagactgtccttggagtaagatactgatgatactggatgtctaccaggagggcccccacagtgcataggacacaggaagcccttgacaaatagccatgcaatgaatgaacaagtggacacacaagctactgaagaaagggcacgtgtgacttggtaatggttgcctgttttatcat

SEQ ID NO: 1728 - DNA, 1200 bp, mus musculus
tgagacaaggtttctcatgaaaagtagagctcatcattattctgtctgacggcctgtttatccatccattcaatcacggtttcagatggcacagtctaatgtgatgagaaggcatggcagatggcaaaggtctggtttgtgaccataggagcttgcaatatggcatcttggttgatcaggacctagagagcatggttgcaagtgactcttgagtatagtcttcagagtcctgctaaatgtgaccctcatctccagccatgacacctgacccccatcccccaattcacaatttacccagatagtgccaacagctggacctgaggtattcaaacaagtgagcctttgtggctgtttaacatgacagcctctggtgtttacattgttggtggctaagcagaggttcgctcacctttcttcctgacttggcactggttgaagaggatgaaacctctttttccttgtagatgggcgtcttagctagggtttccattgctgtgaagagacaccatgaccaaggcaactcttacaaaggacaacacttaattggggctggcttataggttcagaggttcagtctattaccatcaacacaagaagcatggcagcatctaggcaggcatggtgcaggggatgctgagagttctacaacttgatctgactgcatccaggagaagactggcttccaggcagctaggacaagggtcttaaagtccatgcccacggtgacatacctactccaataaggccacaactactccagcaaggccacacttccaaatagtgccactttctgggtcaagccatccatccatccatccatccatccatccatctttctatctatctcagctaggtttatcacagtacaggatgttccaggcaatgtcctgtctgttccagctcttccccattgcagtgctgtgattaaagcacctgcgagggcacttctaggtttttgtgtagacgatagggagccaaattcatactggctcaactatatctataagtcatctcctcacacccttcttttagtgactcattttttacttggatgtagactgtatcttttagactttaagcttaatcttatagtaactcatatgctacagagatattttaactttaccattgcccattttcccttattgtttcatatatatcatttattccaagctaatccttgtggtgaacttctaaaag

SEQ ID NO: 1729 - DNA, 1000 bp, mus musculus
cttggttgatcaggacatggttgcaagtgactcttgagtatagtctccagagtcctgtcagatgtgaccctcatccccagccatgacacctgacccccatcccccagttcacaacttacccagatagtgccaacagctggacctgaggaattcaaacaagtgagcctttgtggctgtttaacatgacagcctctggtgtttacattgttggtggctaagcagaggttcgctcacctttcttcctgacttggcactggttgaagaggatgaaacctctttttccttgtagataggcgtcttagctagggtttccattgctgtgaagagacaccatgaccaaggcaactcttataaaggacaacacttaattggggctggtatacaggtttctcctttaggccaggagaaggccgatttccagccagctagggggagcgtctcaaagtccaccctaacagtgacacacttccaccaacaaggctacatctaatagtgcaactccacggaacaagcatattcaaaccaccacagtgatcaagggcaaacttcctgaatagttcatttaagcacttcaatgaattttctaccaaccatatacaagcatcttattagtgtgtgaagcagtttatttaagaacattctcagggtcagagtgatgaagataggaatgctgtgaggaacagggatctttggaagtaaacacttatggacagctagaagagcatgagaaaatcttcatcttctctgtcattttcttggttttatatctactgtggctgggatgcagttacagcaccaacacagcacagtatctaaaggaataggtatttggaaccccaggatggtagctctgaaaccactgagattaggtttagctccttgggaactctagaggcaaagatgaaaaaaaacaggaaacctgtttatatgaaacacacacacacacacacacacacacacacacacacacaaaatttaaaaagggaaaggcttcctgctc

SEQ ID NO: 1730 - DNA, 1000 bp, mus musculus
cccaggtaaaaaccagacatggtggtacaagcctgtgatcctagtgctgtctaggcagaaacagaaggatcccttaggcttgctggctggccagtgtttgcagtgagtgagctccaggttcaatgagtgacactggctcaaagcatgtcagacccgtgcatgtctgctctctagaggagaaagtgagtccatctacactgttgctgaagatgattacgtccttcactggcatcaggacccaccttcttcagccttccaacatgggcctaaatgctagtggctcttcaggagcccccagccctccagcaccacattaggactgctgacgcatccaacatcgtgatctgagcagctgccatgttctctgcatcttcagcatttagatagccatcgttgcactaagcagtacatattgtgtaagccaggttaaataaatcctctttcctacaacatgcccacatgtgcctctacacacaccctcaagatttagtctctaaacctgataaagccgaaaactcattggctaaagtataataagtcatagctaaattaggcaaagtttatactgatgactgttcccttttgttccctgtggcctagcatcagagtatataacctcaggaaagagactaagagaatctcaacatctcccaaaaggggcagagcagccaaagacactaatgttagaagttgtccagtgaaggaggcctgccacaagaacatggaaagaggccttgagggaggagggaaagatggaacagaatgcatgtgacatggggaggagcttcagcaagtggaggagggagaccagcaggagtgggcagaaggatgaggccctacaaaaacaaaaacatgtatgaaagtgtcatctgagccgttactttgtgcactaatttttaaaactatttttacatttattgattgattttttttttgtctgcatgtgcacatgtatacatgtatcatggcacatatgtggaggtccttctaccacgtgagt

SEQ ID NO: 1731 - DNA, 1200 bp, mus musculus
ggggaaatgagctgtagttctcacaactgcacaaccacagccatctccccaacacttaagagctgcttgtccgatatgctgtcttagcaatgagaaagcgactcgcacctattgagatttttctcatccttggtttgggattatgaaatagcttgaacttcactcactcaccctcttctccttcactaacacctcaaaatatctgtgagtcccagctgggcccatggcagaaacttcgtctaagcaaatgcccttcattattaccacgggcccactgtcatccagccagggggtagtgccctgctctgccagaggtgacttgtgccctgtttcaagcttattactttaagtcacccagtaccattggcctgaggagcaaggagtggggtaaaatgaccttctgtgtatcttactgacctgggtcctagaccttcatccacagcagtctcgtccaatgaccacaccagcacagaaagatctctgtgtgtacttattggcattccataggagcttgagtgacggggctggtggaggggtcttatgcatcacgaatatgaatatcattattcaaatcactctggtagatgttgaagataaaaggaaatgttttattttgtgttcattaggcactagagggtacgttgcccctggctgccgactcattatgcctgttatggttaatgggagttaaactccaatatcacatcaagggggagaaatgatcccataagtatttggaaattttttcctcccaattgcagatcaaagctaggttatgaacttctatgctgtcttgctaatggattagactaatagcattctttgaatttcccccatatgctaactctctgtgtggggatgattacgggaagtctgcgagcctgggagattgcaaggtctaccagagtctgctgtcagagtgaattctcctggcagggaagaaaaccagcaacgcctaaatgcctgctgtaagtcagaagtttgcttctgccctctcacctgtcctcagcaagacttagatgaggggaacagaggcaagggtggttaaggaactcatcaaatcacatgggtcacaggtgacaggcccagggctttggggttcggaagcactgtttgggggcttcctcctgaatgtctttcatcttcaacaagatgtgcaaaaaggctggagtgggtatttaacgagagcagtgtgatagt

SEQ ID NO: 1732 - DNA, 1200 bp, mus musculus
ctctccaggaaattcccaggcagtttctgggccttcagctttggactaggactacttcactaatccccgttgatacgtggcttctagcttctttaactgagtacccactgggtatctgccttgccagtgtggagaaagtcactgtgggactacccaacctccaataatgtaagccaatctactaaaccatctatctcttgggtaatttttttttttttttttgcaaaaacctaatacagcacttttgcatctcatggttcaacacacagatgtccaagtgataattataaagttgaagagttttatcttaagctaaataaggataaagtaatcaacccaaacacacacacacacacacacacatacacacacacacacacacacacacacacacacacacacacacacacacacgagcacaccctcgtttcccttgcagggcagcatgatagttcaaagtggaacactgtccgtgcagaggagtcttgtccctgcatggcctctcttacatctggaaatctgaccagagcagctcaaaaaggcagtaatctaaccctggtcacattgtcagtgagttctcaagtgtcacacagtcttcctgacacatacctacagctgagtttcccttcaggtgaggccaggccagctaactgtttcagaatgagatcacagtacctgccagggtaggtttagctaaaacccaagttttgagggcaagctggcctgctggagacttgctttatcactatttgttacaagccaaacagaccatggctgatgagtctgcgaggaagccatgaggaggttgtatcatttcctaatgactcataaacagtctggtattggggcaaaagcctccgtgggtgggccccagtaatgtgagtttgtttgtttgtttttacaagctttctgggagattctggaactaagtaacctagagaactgctttagtaagactacttactatttgttcttctcatatactccaaggtcacagtcccttccttctccgggtgagatgctcaccctgaaagggctcagcttcccacccagccaggcctaggaatttaactgtaggcaaagacaaagggctctgactggcgtatctcagtcccctgatacaaagtgtcttttttttttttttttttcattgtatattctctttattttcattttttttttccattttttattaggtat

SEQ ID NO: 1733 - DNA, 1000 bp, mus musculus
taatctctggagtcagttgttatagttgtctctggttagagattgttcctctcgtgattctgttagcctctatcagcagaccttggagactagctctttccctctgagtttcagtggccagagcactccctgcaggcaagctcccctctttcagcgaaggtgcacagatatcgggcgttcagacatgcctcttggcagaagatgaaggcccgaaacaggacctgtcccagaagctgtgttgcttaggcctgtcccagaagctgttagtttctgtattccacactttcaccagagcagactagtctcggagtgatccgggaaccaagatggctcccccaggtgctctggcaaagcctttctgggcagagcaaacacctctcctctggcagggaaggtgcccgaatgtctggagcctgaaatggggtctgcctcagaagctgtcctctagggaattgggagtgtctgctgactctgtgcccagatgaccctgtgttggcgctgaccagaagggatttgcaccctggtcaggctgggttttctgcttccttaatgctgtctcaggtcccacgattgggttggaacagaaattgtgttcactcactggtggtcctaagattgcgtggagagtcctctaggggaccttgggggtgttcgctgactctacgcccaaggtgatctggtgctggcactgaccagaagggacttgtcagcaatacattcttatggcaacaaaaattcaagtagcccagacaaccggccaccttcctggtgagagcacaggggtccgtccggcctgagaggtttctgcctcaggttccggcgggagccaccttggctccgggactccgcggagggcaggctgcacaggtgagggtgtggaatacagaggccagccgtttctgggacaggcgagagccagagaccttccgaggtggcaccatcttcggctccagacaactggccaccttcctggccaaagcaacacagcttctgggaaaga

SEQ ID NO: 1734 - DNA, 1000 bp, mus musculus
tttaagggaattgtgctgccaacgaagttacatgtcctaatttggagagcaaaggtgcttggatgtaacagctatggtttttagtgtaaacatcaccttcagtccctttcagtaatttagtcatttgctatgtgtcttgacagcaaaatgatttatttacagtggttcccttcactccacccccccaagttttgctatttttctaatgctggaaattgatatggaacataaaaaaatgtctagagttgcctgacagctccccaggaaacttttaaaagccattaatttagaagcaattttgcttctatatttcatttctcatttggttgtgatagaagtaattgtcctattcaaagggagagtcgtgaccacaagcgatccataggcatcaggtgctttggggacagctttatttggttaaaagacctcagttacaaagggaagcagaagggaaccctagaagcatgactcagtgacagatctcttttgcaaaaacagtccaagtaccaaggccagagccccatatactgaagtaagagaaaagggttcctttctggtgacttgattagacttagtcagccatgcacaggaattaagactcccctctaggtatgtctgtgtgtggtcatttccagagaagcttggctaggggagaaaacacacactgagtgtaggtggctcatctcataggctggggaaaactgccagggcaggcatgctatacctgcttcgggtccagtaagacgtgagaagtctttgccacagactcctgctgctttgatgttctgtctcagtccaagaccaaaataatggagctggctaaccaccgaatgaaacctctgtctgatgttctgagctgaaatatgtttttcatatctgaaaaattgtttctcttagattatctgtcacagagataagaaactgttcatcacatacccaacccgtttaattagacaaggttgtgtccttatattctaccgtcaagcatattgagtacttc

SEQ ID NO: 1735 - DNA, 1200 bp, mus musculus
taaaaaggggaccatgagaggtgagagagtgtaatgaatacaggtgactggaaagcagaagagagactggttgaagagaacaagtaagaaacaagtacaatgaggtgtgtatggaaatgccactatggaacccatttactttttatgctaacttcaaaacactcataaacaatgaaggaaaataaatcccttgtggaacgtctataggtgtattgaaaacaatgcaaatgatagagaggctcagatgagccctgcacagcgcgaggtgtcaggaagtcaaacccaggatttatttagataaatggaaaagatgagacctgttcctctctcagatgccaagtagatggattgctttagtgatgcttagtgggtgcgtgaatggcaggatgagaagactggctgtgaatacggaggagcccaggtttagacctcaccatgacaactctgtgcctccaaccaagttccttaagttgtgtgcttcagcagctaagcaaagctagcttctgaaaccacatcagctaacaggatcatggaagaatcactctgcctggggaaatctggtttgctagagcaaatgcatctctgaaaggcgccactgtttcttcagtggctggcggatgaagagagcctctttctcgggaaggcctcagaatggatacattattttgaggtgatgcaggacattctgtgatggcagtggacagctgtcatcaagtgcaggactgaaaacttgggtggcaagaatcaggcaaccagcctgcaggacttgatgtaaggaaagctatcaaggaaacaaaaactagagctacaaaaacatctataaaaagcccagtggcgtctccaaaactccatacgccctgctcattgctattgtattttgaatcttgtgagcaaggccaattatggcttaatgaattcttgggcttctgggatcaaggtcttaatttagagggagaaacattcttaacatacatttttatctgggccaaaggatttttcaaaacttgttaaactggagtgtccagcttgattgaaaatgtatattcttgtcctaaggtgaagtgtaaaaataaacttagtggcttatcttcatatatatcctggcaaaagagcagtcaaggggagctacagcctgggcccaaataaaacatcaccctgtatcccacacagcacatagaaaacaaacaaacaaaaacctgg

SEQ ID NO: 1736 - DNA, 1000 bp, mus musculus
ctaccctctgccttcctctccccaccaggtccaagggttattgctgagtgggtgtggcacagtgaaaatgcagcatcaggtccattctgttcttcaggcagtattcatactgtacacacaaactgctccaggcagggggagggggaactccggcttccacgccccgagaccggcatccaaagggaagagtgactgtaccagcagctctgtcacacgaagaagcgagcatggccatttctgttcaatttcagaatcttcccaagacgttgtttggctgttgccattcctttttttggacgtttacctataaaacaccaacaacactcttaatactcataaaaagtatatttgtcatatgtcatataatgcctggagacttaaaatgtaaagctttgtggtaaacacgcttgttgcgtgttccaaaagcggtcccatctctgagcgtcatgctttagagccctcccactttatcacacacacagagagagaaggccactgtccttccagactgtgtttcagcaaccacgtggactgcaactcgatgcattcccaggaaccactgtcctccggtgtctcagtcatgctctctcctctgctctcattgtttattctgcaccctctctcacctcaagcctggcaaactcctcatccccttaaggacctgcttcctcctgagccacagaaaggcaatcctttcccttgggatttgctccagtacctctcatcgttaccgcacccacaggtggctcgtacccatcactatcatgctgttgttagagtactggttcttaacctctgggttgcaaccccttttgagggtcaaataacactttcacagggctcggtggagaccatcaggaaacaaatatttacatttgtttgattcataacattagaaaaattatagttttgaaatagcaataataattctatggttggaggtcaccataatgtgaggaactgtattaatcagctgcaacattaggaaggttgagaacca

SEQ ID NO: 1737 - DNA, 1200 bp, mus musculus
ggttgtacaagcttgcaatcccaccaacaatggaggagtgatcctttctccacatcctcaccagcatctgctgtcacctgaatttttgatcttagccattctgactggtgtgaggtggaatctcagggaacaaaacacccatggaaggagttactgagacaaagtttggagctgagaagaaaggatggaccatctagagactgccatacccggggatccatcccataatcagcctccaaatgctgacaccattgcatacactagcaagattttgctgaaaggacctgatatagctgtctcttgtgaggctattcttgggtctagtaaacacagaagtggatgctcacagtcagctattggatggatcacagggcccccaatggaggagttagagaaagtacccaaggagctaaagggatctgcaaccctataggtggaacaacaatatgaaataacaagtacctcctggagctcctgtctctagctgcatatgtagcagaagatggcctagtcggccatcagtggaaagagaggctcattggtcttgcaaactttatatgcctcagtacagggtaacgccagggccaagaagtgggagtgggtgggtaggggagtggaggaggggaggacatgggggacttttggcatagcattggaaatgtaaatgaagaaaatacctaattaaaaaaaactcagaaaatacagcaaatatatctaaactctcatgtcacagaacagtaaatagaaattaccacaaaagattaattttcaattgttatttgaaataaatcatcatcagctgaagttatgagacctgaattcaagattaccagataggaatattttctaaagaattgcaatacagaatatgtgttgaactctggacagcccggaactgtgttaactacaaaagaaaattacagccacaacaaaaatctcttcacaggatgctttgtgacaaacatcacttctgtatgttaccaatgcatctgatttggttgtggttttgttttgttttgttttgttttgttttgttttgttttgtttctctctaagtgtctccctggaggattcagtttcttttgtcgttttgtctttctttgtccctttttaaatgcttatgattgtaatgaaacacatgataacaaaaaacgttcattttgatgcttgtacatgaggtatatttgtttactctatgcc

SEQ ID NO: 1738 - DNA, 1200 bp, mus musculus
gttcattagaagcatttaactttgatcagcttctctagggataaagacagacaaatagagtactgccttctaagtgtgaggcatgatgggaaggcaacacagagagtaaaacctaccttgatttcttaacaatgtcttcaacagttggtgtctttttttcatgttttctactctattaggaatgctttccattacatttttgtttgatttgttgtttttttttcttctatgatagattcttctttttataatcacctttttttgaattttttaaaaattttaaactacatgttttattcccctcctggtccaccctctgactgttccacatcccatacctcctccctgctgccctgtttccacaaggatgtccccacgccccatctccaccccaccagacctctaaaatctctggggcctccagtctcttgagggttaggtgtatcttctctgactgagtccagacctggcagtactctgctgtatatgtgttgggggtctcatgtcagctgatatatgctgcctggttggtggtccagtgtttgagagatctcagggatccagattaattgagaccgctagtcttcttacagggccggcctcctcctcagcttcttccatctttcccctaattcaaccacaggagtcagcagcttctgtccattgattggatgcaaatatctgcctctgaatgtttcagctgcttgttgggtcttttggagggcagtcatgctaggtccctttttgtgagtgccccatagccagcataatagtgtcaggtcttggagctctttgtttaatttcataaaaaatgtcttcaattatctttgcttcatttgatgatctatgttaactcttcttaaagttgctgattgtttttttaattagacttctaaattctttgcccaatattccattatattagcatatttggatactctcatctgctgaagagtggtggacttctggtatggttgtgttcacttgtctattcatgtttcttgctcatatggtaagagttctccaactattggtatggatatttttttctggtggtttactggtgccttctgagcaaagagctttctcttggtagttcaattcctagcactgctcagagaggagaaaatgagccattggaatgcaacaaaatcaaaatcaataagttatgaaatcttaataaacaaacagaagaactca

SEQ ID NO: 1739 - DNA, 1000 bp, mus musculus
aaatgttttcacaatcttctgcaggacacctctccttttgaaaaatttcttctaattctttgactcaatgttcttcatcagaactcgcctgaaagcagccttcacatccttgttcctcagactgtagatgagaggattcatcatgggggtgaccaaagcatagaagatcactaccaccttgtcctgctcagcagaggctgtggaggcgggctgcaggtaggtgaagagggccatcccataagacatggagaccacagtcaggtgggaggcacaggtctcaaaggctttgcggcgtccctgggtagaatggatcttcatgatagcagccacaatgtgggcataggacagagagaccagagagcagggtatcatcagcaccaccacactagaagctagtatcaccacttggttgagggtgatgtccacacaggccagtctgaccagtgtcagtgtctcacaggccacatggttgagcacattgtgcccacaggtaggaaggcacatggtgactgctgtctccacagcagaattaactacacccacaaaccaagagacacctgctagacccatgcagagccttgggttcatcaccactgtgtaccgtaatggattacagacagccacagagcggtcataggccatggcagccagcaacagaaactcagttcccccaagagtcagagcaaaaaggagctgggtcccacacagggcaaaagagatggtctttttctccatgaggaagtgtgccagcatctggggaaccccactggaggtgtagcagatgtccaccactgacaggtgacagaggaagaaatacatgggcaggtggagtcgtgggtcgagtgcaatcagtaggacgatgagtccattgcccagcagagtcagcaggtaggtgaccccaaagaggacaaagagtccagcttggatgtttttgtcacttgttaaacccataaggataaactcacttacccaggtcatgttttctctcatggtgcaattg

SEQ ID NO: 1740 - DNA, 1000 bp, mus musculus
accaagatggcgaccgctgctgctgaggctgaggctgcctcccgagccaggtggaaacctgtcctctggtccggatggtggccggctgtctgcggcccgcaaagggtgctgcctcggcggctctgtgcttccgcctgtcccagaagctgttcggttctctggcgcaccctctcacctgttcagactaatttcctaagtgccatggagtcccggaaccccaaaccacagattcttaaacagcataacgttgctacttaaaccatagaaacaaaacatgagagaaatatgaaagagaaatcagcccaattcttacctattgcacacagataaaagcttatttaaaaaaattgtgacccaggtctaccatacaaaatgagtatatgttatgagaaaatgcaaaaattgtttgacatttaaaaatataaatattttgctgcagcaataaattagaaaaatacaaatgttttagtggctacaattaagagtgtaacaaaactcaacaaacattagggataaaacttgatgtaaggcaatacagtaatcaatcctcttccagagaatcaactcaaactcaggtaagggaaaaattttcccctttaagcctatgatgaggatacacagtgacaccactgtatttcctttatttcacttttctcagccactctaatgagtataatttaaaaaaaacagaaagaaaaacaaaacctgtgagcaagcacacatttgagaacaaagattcaaattgtaattatccacaaaggatatgattgtatgattgtaataaatctcaaagtatcttctgataatttaccaatatataagaaaatttaacaaagtcacttaatataaaattgataggttacttcttagaaattgatgctgacagtccatgggtggacatcacatagttatgccatagacacagaaaaccaggctggtgctcacctacaagcatcatccttaatggctggctttcatagtactacaaggtgctatgcat

SEQ ID NO: 1741 - DNA, 2800 bp, mus musculus
aacaaaaaaaaaacaaaaaacaaaacaaaacagttctgtgctgaaagacagggaaaatattgtgatggccacgtcagctcacacggatataccaccctcttgggcatgctggcaatgagctgtgtaggttaggttagcctctgggtatatctgtgaggggtttcctagatcggattgaggtaacgagatccatgctgaatgtgggcaggacccttccctgctcttggagtcctggaatgaagaaaacaaggaggcaagctgagcaccagcactcatcaattttgctgtgccagtgtgaggcagcattaccagctgcctcattctctgtctctgtgactctcctagtatgacatagtattcttgtaatgtgagccagagaagactcttcctccaatagggcatttcagttattttgcttcagcagtgcagatagtaaacgataaggaaaaccagcctgtttgagtccctgggattggttaccttatcaaatagatcagcaatattgattgtgaaattaataaatactaaagtgctagtattaatgagtgtatttttgaagttcaaatccattaaaagttatagataccatacagcccttggatcctagcattcttattactgaagggctaatatagtaatgctcttagaagaaccatacaaagtgatgttaactatacattttcctaaacagcctttactgagtgagagaaatgtagttgtattcctcatcaagaatggttttggtttttgacaaatgctggttttttttttttaattggctattttgtttattgaaatttcaaatgctataatgctttcctgtttcccctccacaaacccctatcccttccttccttcccctgcctttatgaaggtgttcccccacctgcccacccacttctgcctcagcaccctagcattctcctaccctggaacatcaagcctccacaggaccaaggggctcttctcccgttgatgcctgagtagagcagagactgaaggaagggccatccagagactgccccgcctagaaatctgtcccatctgcaaacaccaaactcacacactattgctgatgctaagaagcacttgctaacaggagcatttttaaaaaatagagattgagatgaacactttttagtgttttaatgtggcaagttgtattaattttaattttaagtctttgttttttgaaatataattataattacataattttcctctccccctttctgttcaatgcctctcatgtgcctagatccttctgcataacccctttttctttgttatatatatattcctaaatatgtaaatatatcctgcttgattcatatgtttcttacatataatttcagagcttaatacttggttattataaacatattcataaaagtcacaatttttaacaacttaaaatacaatttatacattatgaagtctacctatttaaacaaaagtaagatgtaggtggtttgtagtatgcggtccagtggtatacattaaacctaggattgtgttacacttagcagaaaaattttgggtcatttttgtttttctccaaagcaaccccaggtattggcaatcactctccatttctttctaattttttccccacgtcttcctctcaaccatcactagcctactttgtatctctctaagtttgcttattgaaggggttccatataaatagaaactaaaaatacggtctattacaagcatattcacttatataacatagtattttctgttttattttttattaatccttttattcatttacatttccaattatatcccccttctcagtttcccctcccataactcccccatcccatcttcccttttccccctctcctttgcctctatgagggtgctcctgtacccactcacctactcctacctcaccgctcaagcatccccctatgctgcatcaaacctccacagggccaaggacctcctcttctattcatgtcagataaggcaatcctctgctacttatgtgtctggagccatgaatccctccatgtataccttttggttggtgatttagtctctggaagctctgtgtagtctggtgagttgatattgtcttcttatgaaggtgcattctccttctgctccttcagtccttcccctagctctttcactggggtctccagtctcagtcctacggttggctgagagtatctgcacctgttttggttaagtgctggtagaacctctcagggaacaaccatactaagttcttgtcagcaaatgcttcttggcaacagcaatagtgtctgggtttggtatctgcagatgggatggatccctaggtagggtggtctctggatgacctttccttccgtttctgttccattttttgtccctgtctttcctttggacaggaacattgctgggttaaaaattttgagatgggtaggtggttccattcctcaactaggagttgtgcctatctactggaggtggtctctacaggttctatctcacctttgtttggtatttcagttaaagtcatccacgatgggagcctctcgcttccctggctggggctttctagtggccacctccactgctacatatttttatttaatttcttaccctctgtacttctctcctgccccttctaataactacctccttttttccttctacccttcatctttcctcataggttcctccttccctctacctactatgactattttgtttccccttctatgtaggattgaagcatctacactttggtcttccttatttttaagctccatatggtttgtgaattgtatcatgggta

SEQ ID NO: 1742 - DNA, 1000 bp, mus musculus
gaatattaatagcacctgaagttgagctactgagtgaaagatgctgatttcaaaacaaacacgtgatctagatttaaaaaaaattcaactcctgtacctcctgaagagcttgtatccaggatatagggataacccctataataaatgatcagagggcagataaaacaattgcaaagtagcaaaaccttgaatacaacaagattatattggacagcgttctctgggataacaaaagccacagaatgtagatattatgaggatgatttgcaagaatggcttagagcctaaaggtctgggtagcacagaaaatacttgatgcacatcagagagattaagaatgcaatgatgtccagtctatgaatttcaatgcttctttagtcccagtttagtgctaaagacctggaagattcctagagctagtcactagtctttaatctatgtttgactctgatgatgctgggatctgatgtcagtgaagaataaaatcattcaccagcaagcagtgaagataggcaggcagcaggcactacttttcactgggacctatttatagctggtccaccaaaagtttctgcccacactagttagggtcctcttctatcagttaatccttcatgaatatgatctaacaggaccacccagattcatgtctgaggattcgttccattgtcgtgggaaagcagcatcgcagtgggaacatagtgtcagtatgccggaagcagagactggatagaaagccaggctgggctatgacatgtcaaggcatagtgacacactttccccacatgaatctccatttcctttagttttcataatttccacagtgtctagctagaaatcatatcaacataagaacttaggggctatctttgattcgaatgtcactgggacatatgcaatggcataaagaaatcagaaagatattatgttgaacataagaaagtctagagaattcagtatgtttgggttcatttgcatgatgttataggagctccaaaaa

SEQ ID NO: 1743 - DNA, 1000 bp, mus musculus
taggatagtcaacagtttatctttgtcaagatagagaaaactagtccttcatagtttctgcttcatttcaaggtctgccagatagttctgggccagaaggctgaagacagatgctccaacattttgagtaataggggactatcaaggtagtcagatatctctgcggcttgtttatccctatgtttttgtgcttcctacatattcaggtaatatttaattcattctcatatttctaatggcgttgaagactaattatagtcttataatcaaacctaagttatttagaattgaagaagatgatatagaaaggatggttttcagatggtaatacaaattaaagtcagaacatattcaggtatacaattgcaaagtgtttaagtcaggatagatggtagagtactttatctaactgaaaaatatgatggactggatgttagttgtgtatcatacttagtaatctacataattgttatggttttgctcaattgatgtctgagagaagagcctttttaaaaaatttggacagaaagggtgagatgttgaggattagttctcattctttgtcctattttgactcccaaatgccatgcttccagatgctgaaggtccctgccctcagctgacattgattgataagaaagaattgcattacagccaatgtctagacagggagatggaggtagaacttttagattatgcaggcaaggaatggaggagatatagagaggagagtcaccatgatggggaatcagaaagatcaaactaaaaggctagatgatgtgtaagaacctggggaagcagccagtggggccactcccctgcttgagtctggggaaccaaaggtgaaatatacattttaaaagatgctaactcaagattactggaggggagtgtgtgctagctgcagagagatttagaagaggcctaacattgatctagtcaaggcatatcaaaattaggtggcatgtatatgtcttttactcacaaatccagagctttt

SEQ ID NO: 1744 - DNA, 1200 bp, mus musculus
attgatgggtgaattttcaatgaagcatagattttagttttatatcctgcatctgatacatcataaaagttagaattgttgggggtggggacagactgctagctagtctgctcccaagaagacacagtatcctgaggcattccagaaaatcctctgtactcagagcatttggtaagaaccctcctgaagtcccacagctgcagctgggagcccagtggatttaggtacccatcactcctgaagaccactccattttttccaggtactttttgctggagcagactgctagctagtctactcccctaaagacagcccagaagatctgctgcatgcaaagcatttgatataaaatcatgagaggcataccaggagatctgctacactcagggcatctgacaccacagcctgagggatcccagttgttctactgcacacagggcaactgagcaactgattgccagcttgtctgctctcctgaagataccacagcttgaaggcatcccaggagttcctctgtacataggacaatggggcacccaacaccacagtctgaagacctcctgggggctctgtggcatgcagggcaactgacacaacagactaaaagccttcttggagttctgttgcacacaaagaaacagaaaccacagtccataaccccacttcccccgagaaatcttcatgagagacaacagcttctctgggcctctgtagaccctttagttggaagaccccacaggagatctgctacagccagggccacagacttaccaggagacctgaagcaacccagtgacaaaagaggcagactctaaacagagtcactcagaccagcaaacaccaggaaaaagagatggcaagaggcaagcacaagaccataagcaacagacgccaatatatgtgggcattatcagaattcagttctccttccacagcaagccctgaatacaccagcacatctgaaaatcaaaaagctgacctaaaattctatctcatgaagataatagagtcctttgaggaggacataaataattcactgaaagaaatacaggataacacaatcaaacaggtaaaggaattgaataaagcaatcaaagacctaaaagtggaaatagaaacaaaaaaactagaaacaaaaacaaaaacaaaagcaaaacaaaaacaaaaccacaagaggaggtaaacctggaaatataaaac

SEQ ID NO: 1745 - DNA, 1600 bp, mus musculus
atcataaatttatgagatttggacggttgtcagaaccttacttctcgatagaaattaacacatacacacacaacatcttcattccttgtacaaaactaaaaatttattcacagattatttttattctctctcttggataggtgtgaaatttagtcatattaccaccatagcaataaggtaacaaacatatctgagtatagtaaaagcatttgttattttggcttttaaaaccacagaaatattataaaaatgtgggggtttttttgtttggtttggtttggtttttgtttgttttgttgttgttgtttttgttgttgttttttgttgttgtttttgttttggtttttttttgggggggcgtctaatatggggttgctacacattgtccacaaaagctgactgtggtttgcctcatgctctagtatgagcataattttgtcatccagatattttatgcaattgagtaatatttggaattctggggaattttgagagggcattataattatgaccaaccccaacgaacaaccaaccccaaaactacagcccaacagcaataacctcacttctcagggtccaaagctcatatcgagcttcctcaacctcttgcagcttgctccatcaaattgccaatgactgtctaaatctgtgccttatttctcttgcctgccttattcatgaggatgggaaacaccagacagcattaatattttaaagttagccagataactcaatggctgggtgaagaatatcttgccccatccttcttggcctctacccacagtataagtggccctgagacctacatgtgtgtgctccctctgcttcatatcctgctctgcctcctccctctcatccccttctcttcctcctggaacccggaagccccgcctttttccctttgcttggcttctggtttcttaattgacataaccatgaactaattaggaaattgatgctagagattcacagaagcatgtgttatagtgtaattttgacaatataaactttatagagtacacatggagggactcatgactccagccacatatgtagcagaggatggccttgttgggcttcaatgggaggagaggcccttggttctatgaaagttcgatgtcccagtgtaggggaatgccatgtcaggacggcagagggagggtaggtggaaaaacacactcatagaagcaaaggaaaggaagatgggacagggaggtcgggggggggggagaccaggaaaagggataacatttgaaatgtaaataaagaaaatatccaataggaaaaaaaaaagaaaaataaaataaaatttaggcaattgtatattatcagacaatgttgaatttttctgatcaaaagcaggtttttcaatcatatcattcctaataggttgatacgattacaacttcctaaatctcagattagtttttataagtattactataaatatgttaattttacctaatcattttcttaattttgttgtataagacagataaaagcaaatgctctttgagtggttcagtaatggaaggaaacaccatccatgcatggaaatcatcttgtgaggctgctagaaacaagaatttaagcaaagttg

SEQ ID NO: 1746 - DNA, 1200 bp, mus musculus
agagatatgtttaatataaaattagctaaataccctctactagagactcattttcttcttacatgctatgcaatagacatattgccttggaatgagagttagctatattgtacataatgtatttgtttcaatattaatgaaaatcaacagtgaaaattgtattgatataaactctttagaatttttaaagtatttcacattttaatcatataaataatatataatataatggtaagaagactctacactaacattctactaatggcaattgccaaattcaaataatccatgaggttgctgaaatcagagtaactttcatatatacacataagtgcataaatgtcttaaaacaagaaaaaaagtcttaaggtccataaaaaacaaaagaaaacaaaacagcagaacgagggcattagctggggtgcggattgaggaacctggaggggatattgactcaagaagatgaacagaattaactaacatgaacccttggaggctcccagatactaaatgcctaactaaaatacataaaaggcctgtgtctaccccctccatatatgtaacagatgtgcagcttgattttcatgagtgtcccccaacaactttagtaggggctgttgctgactctgctgcctacctattgatcctgctccccaaatgcagctgccttgtctggcctcagtgggagagaaagtaactagtccttctgtgatttgacatgccagggtaggtttttgcccaggggtacctcctctgcattctcagaggatggggaggggaatgattgggggcccatatgagggtgcctaaggggagagggttgcaaagatcatgatataaaatgaatatgtaaatcaggatgagaagtgttttctaataatgtagaggagcattggagaaaaaggcgaaccagcatcttataaagtaaccatggaaataaaaagttagaatcacaggaaccacaagggccttaaaatacacttctcagaaaacttggtactggatgtacttggagagaacattgaaagttgaatttgtgaaacacatgatgtctaacatggtgatttctaattgaaatatatgaaaatagatagtttatccaaacactacttccctgtgaattttttttttgactaagcacacttaatagtattcaaagctttaatcaagttgttgagatgcgtgaagtcttcagatcct

SEQ ID NO: 1747 - DNA, 1200 bp, mus musculus
gcatatgtggagtgtacatataaacaagtagacacacatttatataaatacaaatatttagttagttagttagttagttaggtagttagctagttaggtagttagttagttagttagtttttcaagacagggtttctttgtatagccctggctttcttggaactcactctgtagatcaggctggctttgaactcagaaagatgactgtccctgcctccaagtgctgtgattaaaggcttgtgccaccactgcctggcaatgattttaaagtttaaaaaaattaaatataaccttggtgtgacattattacttttacactttaaggttatttagttggaaattgaacagtttctcaaacgtttaaattattatccaaattgactataatttcactgctttcaaatcctatctttacattttttaaatcctattttaaagtgttcttaaatgttttaaccttccttgtagcccactacccaccaaggtagtggaaaagaaaggatgcaggggaagtggaacactttaggaaggttctttggagcaactcccatttgtgttgtctggaagtaagtcagcaattcaattcacaggtttgcagcggcagctcagtccactcacaaacacctcaaggatagaccagtagtccaattcaggttagcaacagtggtgacatgacctggcagagacagccaggcctcagcctctgctcaagtcagcaggaggaccaacaggaacaccaggagaaattttcagctgtgcctttcacagggaaactaagagcaacatagaagcaagaccaacaagcattagctatactagcaagccaagctgtgtcttcagtccatggtggcttatttataccttccaaacatcacgtgtcctccatgtgccttgccttagtactggtcttgcctcagcgtgtgcatccaaccaggccgagtctggggaagtagaaccaaactgcagcataccaccagaagtttgtagtgtgtttcgagatcaatgttgtatcgacaatagagctcatctacacaatatacggtagaccaatacatgaatgttcttagcaaagaatcttttaccatgtgtcctttcacatgcttgctttagcagagcattctctctccttcctttgtctgcttcagcaaaagttccttcccgagtctgctttagcttttcacacctgtgtcaactttaatg

SEQ ID NO: 1748 - DNA, 1000 bp, mus musculus
aaagtataagaatctatatgtttctcagtcccacgaggctagttgtttaagctgatcttctgtagaaataggtgccaacaaatgtactggcaagtaagggcaagcactcaaagaatagtgaatctcccttctttccaatgtccttatgtaggcctccagcagaaagtgtagcccagattacggtgcataccatcacacctggatataggacttgctttgtaccaagctgtccttgaactcagaaaattccttgcctcggtctcctggggttaaaaacatttacttccttgccttgttctaagattttcatggccactatagctcaagatctctgtgtcaagatccaggtcagaaacttgcatcttccagactcaagatctttatcacaggtgtccccttcaattcgggattgtagttcattcaggatatggttaagttgacaaccaggaatagccaacacattaagtatggctacataagccttgtaccagaaatattgcatgcataggaatcaaaataagaaagtatgtataatgcaaggagtcacaatttgctatattctattgacagattcattgtattgtgaaacatgcttgtgaatatcacagtataatatgagaaaccaagtctttttcctttttgaaatcataaaaataggagccggaaattttgatggcatggcatttataaacttatttcaacatacttgttctgttattctttctgttgctgtgattagacactgaccagaagcaatatagaagaggataggcttgctttgcttacaattccaagtcactgtttatcaccaaaagaaggcaaagaaaggaatccagcaaacagtaaaccagaagaatactgcttgctggcttgctgtgaggctcatgtttatctatggttttctttctctatttctttccttccttccttccttccttccttccttccttccttccttccttccttccttccttccttccttccttctttccttccttcc

SEQ ID NO: 1749 - DNA, 1000 bp, mus musculus
aaataaatacataaagaacactacctttaaaaaactaatttaaaatttaaaatgtgtcagcagcaaattggaaaggagaagaaaaatataatgtcaaagtatacagtagagaataatttacaattattttggttgaactttgacaaagagtttttctccctgaagcaatgagaatggtagggaggtaggaaaaattggtgtgaagcacagaactgaaaaaagtcatatagaaagacagtttgctgacattaagggtctgtttattacttaaacactgacacacacacacacacacacacacacacacacacacacacacacctcccaatcacagaaaatctctttagcatttctttctcaactttattagtatccagtaaaaaaaaatgttttaacatccaaaacacatgggagtggaagctgattgtaaatgatacagtgcattttcacagtaaaccttgatatttcaactcatttttaaaaaattttattagtatatgttttctttatttacattgtgaatttatccccttccctcatttcccctccaaaccccctccctccatcacatccttccctccccttgctcactaacccacccacccctgcttccctgtcctggcattcccatacaatggggcattgagccttcacaagaacaatgaaaggacatcatcctatcattgatgtcccacaatatgtaaggctacatatgagactgctacatatgagactgaagacatgggtccctccatgtgtaccctttggttggtggtttaatctctgggagctctgggggtactggttggctcacactgttgtttcttctatgaggctgcaaaccccttcatcttcttgtgtcctttctctagctcttccactggggaccctgtgctcatttgaatggttggctttgttcatctcagtcacttagttaaaacatttcacagtgacttgagaaccatagatttggatgattgaatattgcatgcaatatttt

SEQ ID NO: 1750 - DNA, 1000 bp, mus musculus
tcacacagcatctcccccattccccatccctatctcccctgataagaaggagcctcgccacctgggtaccaaaccaccctgtcacatcaagttggtgcaggactaaggacatcctctcccactgaggccagaaaagatagcccagctaggggaacatggtttcatagtcaggtaacagagtcagtgtaagcccttctcctgttgttagtggacctacatgaagaccaagtacctgagaccagctccagacctctggttctcacttgaggagacctgggtgaaagaattgaggaggagtggcaaaggggacaggatcaggcatgtggggggagggggaaacagaagagaaacctagagggctaggataataaatggaagtatgcagctgcaagaggtgggaggtagggagtggtgtgaacctctagaaagacccagagacgtgggatgtgaaaggctcacaggactcaatgaaggtgaccttagctgaaatgcccaacaatagaacctgaagagactagccccagtagatagactgggcctccattggagggatggggtcaccaacccaccttcaacatttttgacccagaactattaggtctaaaagaaacgcagggacaaaaatgaaacagagagtaaagtaaaggccatctagtgaccagttcaacttgagatccatcccatgggcaggcaccaaactctgatacagatactgatgttatgatgtgcttacaaacaggaaggtagtatggctgccctctgagaggctctaccagaaggtgaatgagacagatgcagatactcacagccaagcattgaattgaggtcagaaacccctatggaagagttaggggaaggattgaagcagctgaaagatatgacaaccccaaaggaagaccaacagtgtcaactaacttggacccctgggggctctcagacaatgagctgccaaccaaagagcagaatacatgtgttggtcctaggccccaggctgccttgt

SEQ ID NO: 1751 - DNA, 1000 bp, mus musculus
aaatctgattatatcacatctgtacttaaagagagttaataaggttacattgactgagaagtctaaaataaatttgaaatatactttttctgtgccactatgaaataccacacctggctgatgagctattggcaatagatgtctgctagagttcccgagaggctactcatgttccagtggtcatatgcccattaacatacaggtagaactgaatagaatcagtcaccttaaaaatagttcacaggaagttggaaaggaaaagtaatgggatggtagggaagacattgcatgggatggaatccaacaagacttggtcaaagcacattacaggtatactaaaaattcggaacacacatacacacaaacacacacacacacacacagagagagagagagagagagagagagagagagagagagagagagaggctacattttaaatacaagaatatgtaacatctgcccagccatcaggagcctctgttagcttcagccagttacatgttgcaacttatacttcattcattcaaactatgtgtgtttacagacacacagatgacatacttctttcacatgtgttcattcaggctgttcaactcgcctggaaagtcatccccctttcccttcacctggacaagttttcttgccttgcaacatagagatatattcactattcagatataacttcactaagaattatttttaccctgcacctgtttaccttgagcacaaactcagcagccagtctaacatcccccagaggaggctctactcccaggtgctctagcacacccaggatcttaggatcaggggtgagtagaacacaacacctattccaaaaccactggaagtaactgggaccatcaggatacagggatagaggaagcctgccccaccagtggctcaggttcattccagtctgtgctggtttaccttgggcacaaactcagcagccagttccacagtccccagaggaggctctactcccaggcactctagc

SEQ ID NO: 1752 - DNA, 1000 bp, mus musculus
ttgggaacaacaattattacaatgggtatcacagcaaaggcagttgtgtttccatttgtattttatactacatagtaattatagtctcttttgtgttctttaaataaatctaggtcatatttaatagtcagtataagaacagttgttcatacttccttgatgtaagaatatagtaggtagactcctattacactggctggtaatattaacttcaaatttaacataatttacattttgtgcaagtcatattgagtctataaaagagatagtcctctcatgttcacaaagaccatgtcctttccccttaaactatttgactttcgttcttgcagattggtctgaaacaaaggacagtaaggcttagtatgggaagactcaagaggctcttgctagagtggaaaaggggggaatgcactagtttgatattttaactctcatagtgtaaacaccttactatggtaacttcatgctatcaattggattttaagggtgtggcttctaaaaagatgcccactgtcacaccattacaaaacaaagtacttgtgttggataggtgttgtataaataacctaagaatatatatcatagtaagtgttgagattatttcaaagtagatattaacattctctttatatagtttaattcaaatgctctcatacttgtgtttcaataatggttctatttaatacacgtcctgatgaaccaactaatacaagctggatccaagagaacattgttgggttagactgaatacacatgttcccattcttatcagtgcacatcagcaaaagagatgtgatgtatagctttgcacctttgacatggctcagtgttgacattaccactgtgtataaaagtagccccaaaattttccctgtctcttcttctctgtagtgttattatatcatgaactggagagatcactattagcagtcaaactgctaactagatggtaccctgagatggaagaaatatatattttggttttttttccaagaca

SEQ ID NO: 1753 - DNA, 1000 bp, mus musculus
aaaggacataagctacccctaagatggatgaggaaagcaacaaacacaggggggagctggtgagtgggagaaggggggggggttctcaatcaaactaacaaataatcccatggccccagttgctggagaaaatgactggaaggagagaagaatgagtgagaggagtgcttgagatcaggatgtagatgggccactttttatatttactaatcatcttatttgcttacaattcaaatgttacaacccatccaggtctttcctccatagacctcttaccctattctcttccccttgcctctaagagggtgctgttccacccactccctcctcacccctctagcatacccttttttggggcatcaagcctccacaggacccctcccctaccactgatgccagatgaggcagtcccctgttgcatatgtagcaggaaccatggactggctcatgtatactctttggttggtggtttagtccctgggagctctgaggggttcagttaattgatactgttgttcttcctatgaagttacaatcccccttagctccttcagctcctcccctaactcttccattgtaaaagatcacactgtgcttataacacatgtgtgaggggagggggcaggtagtttagaggacataaatgttggaaataagatgtcaggacttgaggtgccaatctccctggtgggtcatcatgcaaatgctgacctaacagaaatgattttagggaaaggtcagacagagacctgtcggcaggagacaggtactacgaacaaatggagtcactcagatcaaacatataaaccaactctgttacctctgttgcctgcactcactgcttcaatgaaagaatcgaattaattttctcccaacttatagcttggaggtttctcattctgtttctctacatataagaccctagagatcgtcgccatctgctaatcacagccctttcagaccaactaatcaaaaagcatgtgacaatatgaacattgga

SEQ ID NO: 1754 - DNA, 1000 bp, mus musculus
aaagatgaagtccttaggctacatagaaaatctgaagaagctggatggaaaagttagtgaaggatgacagcaagagctgtcaaaacaaactcaccagcaagggttgacagagcaggtgaaagcaatatcctttctctcatacctccttatatctgtgccaccagccatgctttccctcagacctctatatatctgtaccacaagcagaaggtgccacctactctaggagagaggttttcctgctctgttgatacttacaataaatacacatacaaccctgtccatcagagtgcctctttgttgatttcagatctttaataaccaatatcaaccacaatatagggaagtattctgctactacatatggcaggaagtaagcttaatttgctatattgcagttccactcaccatgaccctctcttatccccatctaaatccaccaacatcccaccttcactgatgtgatgtggcatgggtatagagctattcattgggactagaagagcttacctttaccacctcgcctcttcaagcacccatctattgtcaacagctctcagggaggacctaggtccatggagctcctgctctagacattattgagtgttgaaggtaatgctcgtcttaatgcttgtcaccataatgtctatgatctcatgagtgtaaccaccatgtcctgtccagaagacagcatttcacagctctgctcttacattctttgtttcccctctttgtggatggtcctgagccttagaaagggtgatgtggatgcctcctcgaaagctgagcactcaactgcccttattcttagcacttgaatgagtcaaaaaaatctctgcattcattgacatcattcactgcaaaaagaagctcctctggccaagcgagggcagtcttactgatgctggtgaacacctaaaagaaacaaaagggtacaaagaataacctgtcatggtttggtttgggtttacttacattcagagtattggcaatgtccaaa

SEQ ID NO: 1755 - DNA, 1200 bp, mus musculus
agttatacagcaagtattttttttacatttactttttgtattaattgcttattatattcatttacattttagatagagtctcccttcctggtctacccttcccacccaactcccaccccccacccagtccattctccctctcctatgcctctaagagagtactcccccacccactcacccaccccatctcaaccctctaacatcacccaacctactctggggcaacaagcctacaaatgaccaagagcctcccctttcattgatgccagatgagacaatcctctgctacatgtgtagcatgagccatggacccattcatgtatatactctggttagtactttagttcctgggagttctgagggttccattttgttgatactgctgttcttcctatggggttgcaatccccttcagctccttcaatccttcccataactcttctataggagtcctgacctgattccaatggttcgttgtaagtatctgtatctgtttcaatcagctgctagtagaatctctcagaggacagccatgccaggcttctgtctgcaagcacaacatggcatcagtaatagtgtcagggtttcctgcctatgcatgggatctcaaggtggtacagtctctagatggcctttcattcagtctctgctccatctttttgcccctgtgtctcctttagacaggaacaattctgggttaaaattgaggtggatgggtggccccgtccctcaactgggggccatgcctatctactggagttggtctctttaggttctatgtcctctctgttggatatttcggcaaacatgggtcctggaagcctctcatatccctggtatctgggactttctagagcctacctgccccaactccccacccctactgctacatacttctatttattctccctgccttgtataatctggacttccatcctgtctcttctcatatctgatcctgctacccctttttcttccccatcccctctccttcccaggtccctccctccctccctttatctcctgtgattattatgttccctcttctaactaggattgaagcacctacactttgctttcccttcatatcatctgtgatatgtatcatgggtattctgagcttttggacttatcagtgagtacataccatgtgtgttcttttgagtctaggttacctcactcaggatattttctagttcc

SEQ ID NO: 1756 - DNA, 1400 bp, mus musculus
tagctccctaagtaatattaattccacggaggaaggattcccacccatctgtttacacattcgatagctacatttcttctgatgacccggaaaagtaaaaatgtttgaggttctgtgtaacgtgaaagtatgcctaggtccgttaccgctgctgtagccacaggttgtgggcaaagcaaagggtggccctagggctccctggccggggcctgacaccctcacgccggtgggcgcgtttcactcttctcgagaaccgctcctctgaactctgttcaaaccagaggcgagatccgagacctgggtctgctctcactccggaatctgtcacttctatctgtattaaacatggagcctgggagccgagaagatggggcggtttgtttcctttcttcagctccgcgcagagaagaggaacccgtcgaaacgcacacaagagaaagtcttcatgggccgctggagcctgaccacacggctgcatccaagcatggagactgcgtgtaaactcgcgaggcgggcgcacgctcgaggatgctccgtccccacagagaaataacgaaggctgcttctgctctgtctgggcggggcggccgccgatggcgcggaaaagcgacctagggcggggctccgacgctgacgggctgccctgcaaggattcagaccctcacccagcgccgggagaggcgccgccctcgccggagccgctcgccgattggtggaggcagcgagcctatcatcgacagttgccgcctctggagtcttagctggtctccacccattggccctcgggccgcccctgtatttacatattttgtggcgcgaaaataaccctttgctcccttgttggctgggctgtgggtgaggggtgggcttccgctcgcagcgctcagccctttaactgttcgccccaagtccggcagcgcgtggtacccggggccagcgtggaggtcggggttttggacgcgcacgaccccgaactcatcttttatttttaggtcttcgaatgtgtcggtctattttccttttacttttttttttttttttcatttcaaagaagcacaaccaaattatgttcccaggtgcctgaatttaacaaaacttctagagaactcgttcaaccccctccctccccagctccttttgtggtccgcacggttgttttaaccaaaaccaacctctgaaagggggggcggggggtcgagagcaaacgaaaaattccgggtaaaaatcagctttgctaagaccacgttttcgttgaagctgccctaagaccggtgaagttgaaaccgaccttgaaggattaacgatttctgtagctgaaatgtactaatttcactgacgtttggtggagatggtgagaaaaaataaatacgaaattggtttggaaacatacgaaacaaacg

SEQ ID NO: 1757 - DNA, 1000 bp, mus musculus
ttttgtggaatagtttgcagagtattagtattagctcttctctgaaagtctaatagaattatgtactaaaaccatctagccctgggttctttttggttatgaggcttttaatgactgcttctatttctttaggggttaggggactgtttagtttacctgatcttggtttaactttggtaagtggtgtctgtctagaaaattatccagtttgtttagattttccagttttgtgttttgtggagtacaggcatttgaagtaagacctagtgattttttaaatttcctcaattttgtttgttttgtctcccttttcatttctgttttgttaatttggatattgtctctgtgtcttttagttagtttggctaagggtttgtttatctttttgattttctcaaacaactcttgtttttttttttttttgattctttgtattgtcctctctgtttctaatttatttcaggtctgaatttgagtatttcctgatgtcttgggtgtttttgattttgttatagagctttcaggtgtgctgttaagttgctagaatgagatctctccacatttttcatgaaggcacttcatactgtgaattttcctcttagcactgctttcactgtgtcccataagtttgggtacgttgtgccttcattttcattaattctagaaagtctgtatgtttcctctagaaaggcttcttgtacatttatagccatctctttctttaggttatggaagttttcttctatgaaattgttgaagttgttttctggccctttgtcctgggcatcttctccctcttctatgccattaggagttgctttatggttatgttcacttagcagacagaatagtagtgggttttccccaagggtaatgctcgttctagtttttggttcttggcttcattaattaaacaatgtcagctgtaagtttcacttactaggtgggtcttaaatccaactaaaaagtggttggttattcccataataatttgtgtcat

SEQ ID NO: 1758 - DNA, 1000 bp, mus musculus
ttatatttagatctttggtctattttgaattaaattgttgtatattttaagaagtaatattccagtctcagtcttttatgtgtggctatctgtcccagcactattggtggaaaagaccattttgtaatcattagagcgtcatgtcattgctgtcaaaatcaggagatgatagactctgaattctcttctgctgtcttacagaagttcctctattattataggattatggctttacaaacatattttaagtttaaaatgcatatggtccacattacctgcagagtttacagcttagcacacgatagactgcagagcattgcttgatgatcttgatgagcacatgctgatttagagtgcagatcacagaggatgcccagcatcactgagaggattatactacacattatttgggaaggatcaaaatttgaaatttgaagtatagttttagtatgtgtctgttcctttgccagtataatgttgtcttgatatcactgttaatagatatctgaaattgggatatatgagttatacatgttgttctttaaaaaatggtcagaattattattctgatctataaatttcagaggtagcttgccagcatctacaaaagagtcagttaatctaaggcttttttcccctgtgtggttccttattagtgttgattgctgatccacaaacattgatgattccccatttatttagaaatttatttctttcaactataccttgtggttcaaagtatatgtgtttgaaactcttttgtttaatcttcattttaatttattttatgtatgtgagtacactgtagctgtcttcaggcacgtcaaaagagggcatcggatcccattacagatggttgtgggccaccatgtggttgctggaaattgagctcaggacctttggaggagcaggcacggctcttaatccctgagtctccagcctcctgcgtaattattcttagttattagttctaatgctttaacatatctctgtatcattt

SEQ ID NO: 1759 - DNA, 1000 bp, mus musculus
cagcttcacaggtgctggcaaccgtggctccttccagacctccacggttggtgcattttaaatgatagtgaaggcaggaagcacatcacaaccgtcagactgtatggagaccatttggagagtacatgtgaagaccccatccattcagggttggggagacagttcagtccagaaagtaattgtcatacaaacatgaggcttcagatttggcccccagaacccaagtaaaaagccaggtgtgttagcatgcactgcttaagcactgagaggggtccctggggctcagcgaccagccagcctagcctaagaagagcccaggtccagccagaaaccccgtctctaaagaaaggcagactgtggctgaggaaaatacccaaggttatcctctggcctccaccccaagctcccataagcagtgcttgttaacccccccccccaagactatcccaaagactattgcctatccctgagatatgttcttttagctgggctgccctgtctggcctcagagggagaggaagtgccaagcctcacagagacttgatgtgccagggtagagggatacccaggggtctcccagccgctcagaggagaggaggtgggcaaaggattgtgggagggagtgaccaggaggggagtaatgagcaagatgtgatcatacaaacactggaaggtgagttcttgctgggacaaggtgcccatgaacctgggtctagcctcagagccctttcaaaccaaggagccaattgaccggaggtggaagccttggcaactctgtataacatccttggcaatgagcatcagggagcagttaaacactgacagagggttaggtcccagggcagtaaaagctatcccttcatccccagctgagctatgaggccagtatgcctgtaactagccatgctggataagtcatgccatcctttgacttatgtggggatcctggtactgagacccacgaggggaaaagaagccaggtaaagcctgtcagttacct

SEQ ID NO: 1760 - DNA, 1000 bp, mus musculus
acagtcccagtggggttgcctgacccctgtgtcaggcttcaaccctgatggaaatgggcagaaattgtcacaggtgtcacaaaggtctgtcattaatggctattctaggagagaaagcagacccaagcaggctggactcaggattagtatgagatcagaagatgcaaacagctccctcctctggagtcgggtagatgtgcattttaggaaaagctactgcctttcccattagttctaaagaggttatctgtactatgaagaaaagactaagatctggaatgacagctggtagaagggctaaggacctggaccgagactctaggtcacctgcttctaggtacactcctgaacttctaagttacctgggtcaataaactccttctttagtctgagctggtcaatgctaaagagtcctagctttgtgtgcagccaggtagaccttgctcagctgtaagggcttactagtgcagcgctaaagaatggtttaaagtctgtactcttaataaatggctagtgcacagagacatatgtagcaggcacaaagactgtggagggatcagatgagcatccagggtcagggggatccacagagccctccagtctgtcaggagaagttaaatctacacctacagctggcgtccaacagcccttcctgctattcaaggcaagagccacaagaaacgatgacatgaatttagactgcaaatcactgcccatgatgttgggacaatttggatagtagctgtacaacccagcagagtgacaatacttcaagaggaacaggtgacttgtaaggtcaaaaacgcagggcctgaaacagcatcactgtggcaaatgtgaagggtctggttacctccctgcctgaaactcaagacttggggaggaaaaaaaaaaggtgctgaaatgtctgcagttggtagtgacacctgagaactgagtgtgcacgcccaccccatacatgaggagcaagccttttgctgcaaatagctttgaaccttct

SEQ ID NO: 1761 - DNA, 1200 bp, mus musculus
caaattgaccctttcataggagtcacatatcagatagcctgaatattaaatatttacattctgatttataacagaagtaaaatcagttatgaagtattaacgaaataattttgtggctgggggtcaccactacatgagggactgtattaaagggtccctgcactaggaagattgggaaccactgctcagatcccaaacagagaagtagctgtcagctcagagctgggtcacatatgcctatccccacactcctgacaccctagcgtctctcacatcttcctctttcctttcagcctccctgtctcccaaagtcaaggcacacaatggcaccaatacacatcacttgtgatattgcaaccccttctttctcctgggttgtcagggtctaaattgctaccaggtacagagactcactgttcaagctttgagagcctcactgattgcaatggattcaaaaccctctctttaaaccaatctgctctctgttcaataagcagggtttcttgaatctcactctgagagcagtaggatgagtgtgaggttctggaccaaggggaaggttggatcaaaagagcttccgagtcccttccagccctgcagagctcagtggacagttataatctaatacgctttagcgcttacaatatggtaaacacttccagttgtctgtgctttaggtctcttccttcctctaattctcacaatagtgttgtgaaggaagtgccatcccattttacaaatggggatgctgactgagtcttggagaatatatatgtattgtaggtccaaaggttcaaggttactaagatgaaataagcaggactcaaatgcagactctgtttacaagctgcctgtcctggcctttccctacctgtccttggctccaaccctcactctctgtgctcacaggcaacctaaaacaccagggattcctccccagggtagcacattggaatcactgtgggacaaactcctgcatcctgactcagattggcttccctacagatacacattttgcaaggtgcttctttgtaaccctgccagacacctttgttacaacatgatggggggcctgccctgctggactccggccttcctatccagctggcatcacctggctccttcaattgctcttaatcccgttgtttttcaggagaaaaatattttgacagcacagaagaatggtacatctggaggtct

SEQ ID NO: 1762 - DNA, 1000 bp, mus musculus
cagcaccccactcctgtcacacacactgcagtaacacagaggcagcaccccactcctgtcacagacactgtagtcacacagaggcagcaccccactcctgttactgtcttttgctctcaatcggtcccaactcattctggacccattaagctaatcacactataaaccctgaagtgccttctcattgtgtggctgccctggaactgactgagaaacctgttttcacgcaatttctctggaagaagtcccctgcagcccatttgcaaatgtgtgcatcgataaatcaaaagtggcagtggagggctggcatttgtgagaaggagaatggggaggtgggaaccacacaaccctcctatttctgagacaatcccctgatgcaatcacatagctttatctgaaacagtctctgagtaggaaggtctcctccagctgccttattaggtctttctctggaccaatgcttccagggctcctcatttcccaagcctggcaggaatgtttcctcctctcctgtcactctccactgagccaagggatggaaaccggctctcctggatgtttacagggttcctcttcggttgtcacttacccaggtagaacacatgccatctttcatttgtcttcattagccagtccccaaattcctttccacttgctcctctgtgcttccaccgtgatggcttatcctggagctgaaagtcttgggatgcgcagcgttccagctgcagctgacagaacacctggattttcccatcaggtcacagccatgttttcaatagagcttcctgtgtctccatctggtgctctgcaaataagtcttagctgtttggtcttagaggcatcgcagaataagatccaggttgacaccagcctgtgggggtctggagctcacacaccagcctgtaagggtgtagggagctcagctttcttgcacatagttctgaggtttccaatgaacacaaccttttctgtaaacaaaagcttttttgatacatagacc

SEQ ID NO: 1763 - DNA, 1000 bp, mus musculus
gaagattgccaaaacgccagtataaaaagatcaatgcgatagctcgagtcagggtctggaggtaagctcgctggtgaaatggaaaatctaggctggtccctaaggaccttgtgctataggggattttgagctggatgcagaagagcagttctgagacagaaatgaattttatagaggaaagtgccatggtaaacctcatgcccgtttacccttgaaaaggtcaggctggttgctatgtggaggagggctggacacaagcatgagagcttgctttatgacacagccccaggagacaatgcaggaatttgtgaaggaatggggcagggaacgaagccgacagtggcccatctagacagcagagttgcaccattgcataagataacctttcatggggtagcaaaaagtccagacatcacctgtattcttcagcaccagcgaaggggccgctcatcctgtctccaagcaagaagcgagcaagtacagttctgcgcatgtgttcgcgcagccttggtgtggatatccggcttttgcagaggttagacaggccgttgattctgctcacgaatttgaattgcaatttggaattctaaaaatgaaacataagactgtgtatggcaaaaacgcctcgttcttgaacagcatgacttaggtaccatttggagtgcagagaacatcgtgtcgggcctgatgggggagagtgggtaggccacccctccttcacaggatatttccgtctctctcctggattcagagttccctgtgttcttccgcgcaaaaagcacagcagcaggtgggaggctattctagctgtccttgtgatccaggcttggcaataaactgccaaagacagttataagctgctgagacctgtctgcccacgagtctgaggctgctggggtagcctagggctgagataatgtgcaggccccgtgtgccagggaacctgtgcaccccttttcagtgcaacagccataaagagaaaagcataaatctgacatct

SEQ ID NO: 1764 - DNA, 1400 bp, mus musculus
ttctgtggtggaggaggagcttcaactcaaggccatggaagagccaccagaaatagtcaacccagatatgaccctcatcaagactatcatggtgggagaacacccagagagtgttgctggacctgtggtcacttctacttctacatgtaataacacaatgggggtcttggtgactcatgtcacagaaaaggaagataggtctgtaggccacaagggtactcgaaaaatgctgatacaaaggcaccactttgagtcaccaaggtcattcaggattgatcagccttcagacaatttctatcatgtggactctgagatcaccaaaacagaggacaactgcaaagtctgccctgataccaagcaaagctcactggtgcaggagaggccagcacagcactctcaccagcacagaggagccatgccctataaaggcgaccttgttcaaacctctgaaaagtcaattccccaccttgataagccacctggacatgttcccactgactcaaatgctgccagctcttggtctgtgacaacccagatgtcctccaatctggtgtcagctgctcagagggttgcagacctagggacctataataaaggaacagcttttgaatgcactccatgtgaccctcttaataccacagacctaaaactgcagacagaaacaaggcaggtcaaggatgttgctgttcagacttatgcacatgaatgcaagctcaggccatcacataatgacttcattcatgggcctcggcccctcgccaaatccatctctttggatacaggttttcctagtatctccgcaacaggcttctgccacaccatacctgcccactgttgtgtctgctgtcatcactgccccaactgccaatggaggaggcaaagccctggcccagaaccctctatttgcaggcattccctgtattcacaagcagaggatcctaaagtgcagttcatgaagacattgaaaatactccaagacactactgtgagggacctgtgttctgtaagtgtttcctctacaaactgggatggcagatgcaccaaccacattctgacgctacaaagatagtgtttttcctcctttatagcagagaaaactcagagcatatctctttttttaagtgttagtcatgtttgttgagtgttttatagtttatgagataaattcatacattcaaggttataatatcaattaacctgtatcatctccaagtcagtataagtgagaattctgacttttaaatccagtaggctatataatcttgactgagctatttagagtctctagggcagtcatgaaaaacagtggaatggggactatggatgtagctcggtggctaagtacttgcatacggccctgggtttaatgcatttacatatatgtacatatatatatagga

SEQ ID NO: 1765 - DNA, 1000 bp, mus musculus
gtttcaacctataggaacagacaaggactttctgttttcagaatgtttgcctgcatgagatctacagaaggcagtaaatattcagtaacacttgagtatgggactcccagggccctgctctgcttggttcaagggggtgatgtcaatcaaggtctgctgaatgaaagtcattgtcttcagtgatagagccacaggtagtgagtgactcttgctctggtgaccagcttcactgaggtctatgttatccatagttaaattcagtatgtcagaaagcaaaacacaaagataggaatgtgggatgtggacttggtaagaaggagggtcaatgtgaagaaggaaggtaaggaggcagataggtggtaggaagataatgatggaatgtaggtagcaataggaaaaggggatgcacaggatgcaagatggagaggagaagaatgagtgtgactacagtgtattgtttatatctatgaagctttcaaacaacacttaatgttaaaaacaagaaagtatcaaggttttgccgagaaagcaagatagactggatcatgtacccactttaaataaaaggtttagttgcaatgttgaaaaatattgctgcctagtattagtaatattagtagtaacttgaactaattgtaatcattctatgctgtcatttctgtaaagtgcttatttgtatggtgcactaaatctaataatttatattcatacttcatttaatattcacaagtatctaagatacatattatcagtctgatgacaagatgagaattaaaacacatatatctttcaaggttaaatgaggtgtggagagttggaatcctttgtcccccgaatctcacctctaaatggcttgattgtaccaacactcaaagcttatgaaaacacaccaatgaaggaaatgcaatttgataatatttaacttttctttagttaactttgtatgtgattgccttggccccttctaaaaatccttcagattattttgggcagacttgat

SEQ ID NO: 1766 - DNA, 1000 bp, mus musculus; identical to SEQ ID NO: 1765

SEQ ID NO: 1767 - DNA, 1000 bp, mus musculus; identical to SEQ ID NO: 1765

SEQ ID NO: 1768 - DNA, 1000 bp, mus musculus; identical to SEQ ID NO: 1765

SEQ ID NO: 1769 - DNA, 1000 bp, mus musculus; identical to SEQ ID NO: 1765

SEQ ID NO: 1770 - DNA, 1000 bp, mus musculus; identical to SEQ ID NO: 1765

SEQ ID NO: 1771 - DNA, 1600 bp, mus musculus
ataaaaacagacttagtgaccaatgacatagaattgagcattgtattaatcagagttctatatatatacacatttatgcttacacatacgtatacatatgtatacacacatattaaagtaatttattaaagtggcttacaggctgtaaaccagctaatctaacaatgactctctactattggaaagtccaagaatacagtagttgttcgatctacaaggctggatatcatggtcgattgtcagtatacattggaatcctgaagaactaggttctcataccagtgaaggttctaataccttacagcaagaaagaggaacttgtcagcaacaaggagggcaaacaggcaaagaccgaaagcttcatttttccatacctttttatattggctgccataagatgtagcccagatttaggacaggtcctctcatcataaatgatccagatttagggtaggtttacgtacctcaaataatccaaacaagaaaaggtcctcatagaatgcccagctgcttgggttccagttatttcagaggtattcaagttgacagccaagactagccatcacaaatacccacacatgagtctacgcttgtgcaccaacctgatttttaacaaagagagaacaacaatatagatcttcaacaataaatggtgctggttaagctagggagccgcaggatggagaagaacaaaactagattctcatctctcaagttgtacaaaacttaactccactgagtgttttgtttgttttgttgttggtttttggacttgttgaccagaggggccaaaagctctcaagtatgataggatactgacaacgttcctggtttctctccagaacttgacaagaagactctatgaagacaccacaaactcaagtcttagaaaacagagaaatcaagctggtattcaaccactagatatctagtcctggaaggtgctattcacattaccagagaagaaacgtattatcaatcttacctagctgtgaggcctgagagtgactatcatgactttcctagcaagacattctcactggtacaaggtggcatgaatagcatgagagcaagtaaacattttctggatttaagtcccaagccacaagatgaaacctatacctagtaccattaataggatgagcatttatggctagacagttcctaggccatagggagaacctactactattttatgctgctaaatgggcatgttatcacactaactcctaatgactttatcattataacccctgaaggggataggaactccacaagaagaccaacagagtcaatgaacctggatccttggggctctcagaatcaccaaccaaaaaaccatacatgaactggacctaggcctccctacatatatgtagcagatgtgtagcttggtctttatgtgggtcccaaacaactggagcagggactatcccaaaagctgttgcctatacatgggttatgttcttctagccagattcccttgtctggccttagctggagaggatgtgcctagcttcacagagatttgaggtgccagtgtgaggggatatccagaggacccccatccattcagaggagaaagagagggaggtgaggg

SEQ ID NO: 1772 - DNA, 1600 bp, mus musculus; identical to SEQ ID NO: 1771

SEQ ID NO: 1773 - DNA, 1600 bp, mus musculus; identical to SEQ ID NO: 1771

SEQ ID NO: 1774 - DNA, 1600 bp, mus musculus; identical to SEQ ID NO: 1771

SEQ ID NO: 1775 - DNA, 1600 bp, mus musculus; identical to SEQ ID NO: 1771

SEQ ID NO: 1776 - DNA, 1600 bp, mus musculus; identical to SEQ ID NO: 1771

SEQ ID NO: 1777 - DNA, 1400 bp, mus musculus
gcttaggccgcctccccagccgggcgggcacctgtcctccggtccagacggtggctggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgccgcttctttttgttctaaagctttcagctttcaggtttgctgtcgttagttgagctttctccactttttaaatgaaagcatttagtgctatgaactttcctcttagcattgttctctataagtttggatatgctgtgccctcattttcatttaattctagaaagtatttaatttacttctttatttcttccttgctcagtaatcatagaggagagagttattcagtttctatgagtttgtacgttttctgttgtttctaatgttgttgaaattaggctttaatccatggtgatcttaaaagatgtaagggatgcaatagcactccatagccaaatacctccgggaaagcactggcctatcaggagtgtggaaacacctgtgaacacaagtaagaccaccacttatgctcagagggactagcccagagccctcataacacaggacctgaggaacagcctgggacaggatccttcctgtttccatctgcactgggagctgatcctgtgccacagtgatccatgcctgaataccttcaggagagaattgaactcccaagagcgccaacgcacctgtgagcacaggtaagaccacaacttctgctcaaaatcctggcccaagggtgacatacccagagcgatcaggacacaggaaccaaggaacagcctgagacaggatccttctggtttccatctgcaccccagagctgaccctgtgccatagccctcattacccaaatttttcccagagagaactagtctcccaggagttacacagacttgcaggagggacaaaacacagtcagagacagaaagaccagctaacatcagagataaccagatggcaagaggcaagggcaagaatataagcaatacaaaaccaaggctacttggcataattagaacccagttctcctaccacagtgagccatggatacccccaacacacaggaaaagcaagattctgtttaaaatcacatctcatgatgatgatagaggactgtaagagggacataaataactaccttaaagaaatacagaagaacacaggttaacaggtagaagctcttcaagaggaaacacaaaaatcccttaaaaaatagcaggaaaacacaaccaaacaggaaggaattgaacaaaaccatccaggatctaaaaaaatagaaacaataaagaaatcacaaatcttggagttagaa

SEQ ID NO: 1778 - DNA, 1600 bp, mus musculus
agggaaccttcattcactgctggtgagattgtaaactggggcagccactgaggatatcagtgcagggaattctcaaaaggatatacatagatttatcatatgatttagttataccactgattggcataagaccaaaggactcgacatcctactccgcagatacttattcagccatgttcactgcttctctaagaaatgaaaacaacctaatgtcatttaactgaagaatgaataatgaaaatgtggtaaatgtactgtagcatacaattcaactgtaaagaataatgaaaccatgtattttgcaggtaagtgggtggaactagaaaagataatattaagttagataattcagattcccccccaaaataaatgttgcatgctctctcttattagaaactcctagtgtcatttcatcagatgtgaatgcatatcccaatggaatggcagaaaccaggaaagtgaaaaagagaccattgtcaagcagggatttagggagcaatggagaggggaacagaagtggggaggagggtaaaataatagtaattatgtctgaaatcacactattggttatttacctaaaaaaaccaaatatatacaaattctctcacaactctatagaagacggagtagccaccagtacccaagagagccacatggaggcttcacgggagcttgggtgatggagcatgaacctgctgagcacacaatatccatggaccaactcaagaaagacaggttttatcagagatgcctttaaaaaatggtttaatggaattggagcatagtagagggaagtggaactaatgacatggcaaggctgcagtagacaaaggacaatgtccttgggtcattatcaggtcttctcactccactgttgcctgcttggccagtgtcaccactcaaccacaatgaccaacatgacatgataatgccaggagtgtagtagtggcatgtacaccttagcagtacccagaagctctctagttggatttaagaccttttcaacaagaaaacaaccattcctggtactggaaacccagccaactagacagggatagtaaatcatggatcttggaggaaagcctacaaccaccactttactaaacacaaacaatctctaaaattactctctaaatgtttgttcttatatccacagatatgtttaatctttgtcctttgtcaaagaaatttctctttgtaacagagaccattacagataaaccacaatcaattaaacgtagagcctatttccaatagatacatttatgaaacaagtactacatttaattctcagggggacattgaagaatgcggggcagaaagagtctatgagccacagggttagggagactgtctcctagttatgtcagcaagaatatctgtaaagcctcaccgacatgattgcctaaacatgagctgaacaagggcgacaatcaacatgccaaagtggatggagtaggggtgggaaatcctgatacctgaaccatacacaatgaactagaagcaactgaaaaatgctgagtgggagaaataggcttccctggctgagagcactggtattggttatccaggaccaaatgggatccctgaaaatttacac

SEQ ID NO: 1779 - DNA, 1200 bp, mus musculus
tcaattgattggttgattgattgtggttttgtgtgccatggtgcacatgtggtgggcaaagaaccatttgtgacagttgcttttctacttccacaatgtaaattctggggactgagctcaggttaccagacttggtgacaagtgcccttacccactgaaccctcttgccaacccctctccatgactcttctttaaaaatatctttattattgcttattttacatgtacatgtgtatatgtctgtatatgtgcatgtgcctgaggttggggggggggcatctgctggagctggagctacaagcagctgtaagctgtgtaatgtggatgctgagagttgaactcaggtccttggtatgaacaatacatgctattacctactaaaccatctcaccagtttctcttcgtgactcttaaatacaatttctctccaaaattgttgtccgttgtaacaactgagaaaaattaaacattttgtgactttttttttaaatgttctgttgtttgtggaggctcacactggtaattccaaggccagcctgtgctacaaggtctcaccctgtagcacaggctgccttcaaagttatggtgattctgctgcttcacacatattgggattataagcctccctacattgggattgtaagtgtgagctaccattcccaggtcaaagtgttcttttaacctaatttcagggcaaataaaatagttatgtttaaatatcatacacatcaacatgccctttaattgcacaattctaattacctttcaatatcagaacaatgcctttgattatttatgtattcatttaactttggagagttgaaaccctaacaccaaaaagtataaccgcatgacagattacataacgtaccttaaaaggtaaaggcacggctgactgcaggctagcaagcgatgcgatggacactgtgtttacttttcaagggttttgttttgtagactatggaatctacttaccatttcaatccttttcattgtttcctttatcctaagcttaatatcttggagaacactatttccgcagcacatacagcaggggtttctacctcagccattcaggccaccccatatcaggtgacccttcctggctccacatcagattgtgaccaggtcagggagcagtcacacaaacccagagtgtccttctacactgtttctttgagggggatggaggctgagagt

SEQ ID NO: 1780 - DNA, 1200 bp, mus musculus
tagtatttgctcacacctgtagttcttcccagcaacccctttcaacctttccttctagcctgccaatgtcactccctgcccatgtcactcctctaccaggaactccaaagctaccacacttaggtaggactcaaggaacccatagctaccacacatgactatgacccagattgggcaaggaatagaacacctcccaaaaaagatgagatgccactggggaccatggtggtgtcctggcctgtgctgctacaaggggccacctcttggtccatggccctacagcagcagaggtctgctgccaccaaagttctggtgtacatccctggaatgttgatatctgagtgtgtgcagaactgaccctacccattgtgagaaagctggccttggcagcaggagagcagaagagatgacctcacccctaggcagctgcagtattctggagagcagccctgcacattgtaggtgaattggccttggccctggccctgaggatacaagcatgggacaggtgaccctacaatttgttttccatgccatggtatagataagggagagataccctccttcctcctcacccttcaccacctacagcagggaggaggcttggtcctgggatcatgagagcaggagacctggtcctgatcctcagcaggtgcagcactctggagagtgagccctgtgcctccctagacagcacagtagagctgaccctgatggtggggatgtgggagagctggacttgagggtgtgagatggaacttacctgttatgtggtgttattggcaagggagagatgccccttgccacctatggcaggcgggagagctggcctcagggttaatcagaacagtggagttgtgctgaagcactaaggagagcaggtcctgcacctcatctgggcagcataagcagactagaagacagaaacactgggatcatctcactagatgcagaaaagttatttggcaaaaatccaacatctcttcttgagaattgccctaaagactaagagtataaggggcatactgcaagataataatgacaatttacagcaagcccccacaggcaatatcatcttagatggaaagaaactcaaaatttccattgaatcaagaacaggacaaggacatccattctctctatttaatacaacacttgaaatcttagctaaagcaataaaacaactgaaggaaatcaagg

SEQ ID NO: 1781 - DNA, 1200 bp, mus musculus
agtctttcaagggttaggtgcatcttctatcactggggccagaccagtcctctactgtctatgtgttggggggcctcatatcatctggtgtatgctgcctggttggtggctcagtgtttgagagatctcaggtgtcctggttagttgagactgctgatctttctatggggtcaccctcctcctcagcttcttttagctgttccctaattcaaccagaggtatccccagtttctgtccactggttggatgtatgtatctgcctctgactctttcagttgtgtactggctggttttgtgtgtcaatttgtcaagctggaattatcacagagaaaggagcctcccttgaggaaatgcctccatgagatcgagttgtaaggcattttctcaattagtgatcaagggtgggagggcccattgtgggtggtgccaaccctggtagtcttgggttctataagaaagcaagctgagcaagccagaggaagcaagccagtaagtggaattcctccttggccactgcatcagctcctatttcctggcctgcttgagttccagtcgtgacttcctttggtaatgaacagcaatgtgaaagtataagatgaataaaccttttcctccccttgcttcttggtcatgacttgtgcaggaatagaatccctgactaagacaagccccttgttgggcctcttggatggcagctatgctaggctcctgtctgtaatcacgccatagcatcagcagtagtatcaggccttgcagcccttccttgagctggaactcaatttgggcctgtcacttgacctcctttcccttaggctcttctctatttttatccctgtagttctttttgacaggaacaattctgggtgagagtttttgactgtgggaggggaaccccattcctccacttgatgctccatctttctacttggggtggactgtacaagttccctctccccactgtagggttaatttattttcttttcttcaacccttggtaaactttgaagaagaaatatgatcctaggaggtcaaactaagtttttgttttaagtagaagagagatagtcacctactttgtcttaatgatactgatcgtggtagacattaatgtgaaggcgatctagaattgtaggttattgtagataacctctactctaaactgacatccaaagcttcttcctgcctattccagaagtgaac

SEQ ID NO: 1782 - DNA, 1000 bp, mus musculus
tctattcgctttctagttgacaatctatttcccgtgttgatttttttatttttgttttgttttttgagacaggatttctctgtgtagctctggctgccctgcaattcactctgtagaccaggctggccttgaactcagaaatctgcctacccctgccttccaagtgcctggattaaaggtgtgttccaccactgcccagctatagtctatttcctacttatactgcttaagaatttcctgtactgttgactacagttcaaatatctttttctttcttttttccatagatgattatattgaagccatattcacctttagtggagaactgaacatctctgctgagttatgatggttaattttagatgttggcttccctagataacaagatgtgcagatagatagtaaaaatgcagtgcacagctcttattcctgggatagatttaggatcctacagcccattcattcctacctcccagacttactctttattactctgcagtactatttactactctccttttattcccctgaaattctgcctcttgttcctaattagttctttccttcttaactactcaaccttcccttctagccaatcgttattcctttatgtcagtaactgatatacagaaacactttctaccaggaactcccaggggccatattgggctgggattcgggtaggtgattttcactatgcttcctcacccccatctaaatctctccaggcttattttagttcttcagcaacctgccaataggagcctctcctcccaccctacctctattatctggagatgccttccctgggtgcagacccagacatcacaccccacccccagctctttcccactgcttctcacaggctttactttcagctcatttgctattcctttgaatacctacctacacagaaaagcactcttgaccccacagtaacaatgttttgtctaggatccagagtgggaaacaacaaccaaagaatgtaacacttacccaa

SEQ ID NO: 1783 - DNA, 1400 bp, mus musculus
tttgtttatacaatccaaactaaattataaaagattgtcatgtgccttacctgctggaagcagagggtcatcattagctgattttccatatcacaacttccatacatatggtaatgaagaaatatattaactatgaaagtttacatgtctacagacaacactgaagtcaaagaggccctgaaaggattcatccttgaggatgctaaaagaatgctcagatgctcagatctattgctaatgctatgatgttctatagtgttcttaaaaaaggaagctagcatgactgctcaatgagaggcccaaaatgatcactgatagagaagcacatattaaaccaaccaatggtctgaaatagagatccctgttgttgaaatagggaaaatctggaagaagtttaggagaagggcaatcctttagcaagaccagcagtctcaatgaacctggaccccagagaactcttagacaaaaagccaacaaccaggttccgggactcctcagaaagttgtctgcacaggcaagagtgtggactacagaagctaacagcttctggtacaggcgagagccacagagcttctgaggcagcaccgttttctggctccagacatctggccacctcccggccagaggacaggggtctgcccagcccgggaggctaggattttgactcaggatgggtgggagccaccttggttctcagactcggcagaaagcagcctacacaggtgagagtgtggactacagaagtaacagcttctgggacaggtgagagccacagagcttctgaggcagctccattttcaggctccagacatccggccaccttcccagccagaggacaggggtccacctggcccgggaggttcctcaggatctgcggaagccatcttggctccgggactccgcagaaagttgtctgcacaggcgagagtgtggaccacagaagctaacagcttctgggacaggcgagagccacagaattctgaggcagcactgtttttgggctccagacatccagccaccttcccggccagaggtcaggtgtccacccggcccgggaggccctagcttcaggatccgctggagccattttgttccaggactccacaaaaagtagtctgcacaggtgagagtgtggactactgaaattaacagcttctgggacaggctaaagcaacacagcttctgggaaaggtcctgttttggcccttcatcttcggccaggaggaggtcaaatgccatataactgtgcacctaccctgtaagcggtgagctcgcctgcagagactgctctgaccactgaaactcagaggagagagctagtctaccagatctgcttatagaggttaacagaatcaccagaggaacaatctctaaacagagacaactataaacactaactc

SEQ ID NO: 1784 - DNA, 3400 bp, mus musculus
gttgttttcccttgtagaaaggaaggatactaagtttttccagctaattttatattcataaatattgctgaaattgtttatctgctgtaggtgttctcaggtaggactttttgggttgcatatatactattgtatcatctgcaaatagtgatatcttgagaaaattgtagcaattccactgaaatcaaggacacatcaaagcttcctaccctatccttatctatttagtatagtacctaaattctaattaaagctattagataacaagggacatctagtggatacaaattgaaaagtaagaagtaaagataatcactacttacagatgattgttttcttgaaattactttatctgaattaggtaaaagaactcctgtttagtgttgggagctattaagacaacacaattgtcctgatgtctgaattggtcctctccccctgaaaagaatagggtgccaaaagcgggccaccaacgcaccacttcgagaacaaccacatattgttccagccctaagtaagtgccggatgtcctgaccccaagatgtaccctgatactaccaagttcctgcttcccagtgaaatttttctattgtcccacccctcctgctgataagtacctgtacttccccttttgcttgtgcaattctattgccccaccctttcttctaaaaggtacttcctcttttgcttgtgcatttaaaccttgggcctggctaatacagtgggaccttaatgccactcagaatgtttctgtgttgttcttgcacaaggttctcatctctctctatccccccatttcattcttaggagaaggtcccctctagaccctcgaataacaggacctgctggacaggtcagtttagaccccaagggaaaatagggttaatctgaaaaaattcaaaaagaaagtaagaaagaatgaatgaactaagaaatgaactttagccttagtatttcttgcctcaactttgtttttgtctatgtgttcaccagacagtcatgtgttgtttagtcaggctatttgttttacatccagtctatgtgttatttgtcaagtctaggtgttgaccattttctgtgtgacagttgtttgtgatagctgttttgaagttgatttgcatgcatatggtagagaaatcagtatctgagaaagtctgtgagagtaaatcatctgggctctttttttttttttaatgtattcatgtcctagctgatatgagattttccctggtcagatttaatctttatgaattttgttgatatgtgtattttcatttactgtacatacaggaacataaccacattctcaacttaaaactattgcaggttttcattctaatgtcaacacactcttttagtatatttgttgtcatatttccttagatttttagataatacagtgtctctcatttgctgttctttcttcacaatcattaagacaatttagtgttaacaaggcattatttagtctgtcccttgggatttttactctctctttttgattaattagcatctcacttaaggtacatatggctcttcctataactgattgtcctttgggcttgtgtgatactacaataccatgctttatattgtaatatgtaggcaattgtttcctgttattatctaatatggaacattatcagttttaatttgtgcaggtaacaccaaaactttcattatttccaatagctgtgtaataaaactatcaggttttcagaacttcaaggagttgcacacagaaaacgtgagtacatgcctattttatggtgtatatatgtttgttttctaacttctgcaaaatggaaaacttccatctgtcttttgttttgttactcctaggtacaagcaggtaatcaaattttgtggtatagagaatatttagggctattattactattattattattactattattattattaattttattattaattttatttggcttgttttcaagtgatggagttttaattctttaagattcttccaagtataggttgttttcaggaaaatttttggtttatcactcattacctaataatatctggtcaatttcattatttccttaagctaatcgacatggcaaacctgtatgagactgaataggagtaatatatagtgaatggtttctacttctgatggcctgttgtaattgtataaataataggattaattctgagttataaggtacaaactcaacaatttctacatgcagaaaaattcttcatgcatataaagagtcagtgattataataagagattaaggataatctgttaataccataaggcctgcatatatttctgacttttgaaccatggtagatggactttttagctccttctttatttgatctaatttataacatgtgatcctcatcttgtttataactgtatagaatgttggtttctttggtatttgtgtgctctttacaatatgaaatggtacaattccttcctttttattggctactttctttatttacatttcaaatgttattccctttccaggtgtcacctctggaaagcccctattcctacctgccactcctgccttcctgtcctgacattcctcttcactgaggcatcatatgcccttaggcccaagggccactcctcccactgatttccaacaatgacaccctctgccacatatatggctggagcctgggcacctacacgtgtactgtttggttggtggtccagtccctgtgagctccagggggactggacagttgacactgtttcttctcccatggggcagcaaactcctttatgtccctcagttctttctccaactattccatctgcaattctgcactcagttcaatggttggctgcaagcatctgcctctgtatttgtcaggctctcacaaagcctatcagtctccagacatcaagcacttcccagcatttgcaatagtgtccaggtttggctactctatatgggatacaattccttcttttataaattatattcatttgcttttctggtatttggtactagttttacccaaatgattactatagtttctttgccaatctccaatgaccatgctatatcagcacatataagaggtactacaatttaactggacctgtccctgaacattgacctaatctaatactacctattataagtaacttggaaatcttttctataaatgtcttcaattttttgttttatgagctaagaaaagccatttgatagtactatcttctctttgcacaatgagcccagtaggagaatgaatttaggtataatgactaaaatatgatcaagtataggaacaatttgatctatgtatgcattgtgcagttcttattctacaataattaattccctttttgcttcagctgagagacatcttgggctgtttaagtttgaataatgtttgg

SEQ ID NO: 1785 - DNA, 1200 bp, mus musculus
ctttgtgtggcatcagtgtagctgaggcttcatagaacgaattgggtagtgatccttgtgtttctatattgtggaatagtatgaagagttttgatattaggtcttctttgaaggtccaatagaattctgcactaaatccatctggtagtgggcttttttgcttggaagacttttagtgactgctttgatttcatgaagggttatgggattgtttacatgctcttgctgactgaagcctgatatacttgtcccctgagaggctccaccatatcctgacagatgcagatgctcacagccaacaatcagaatgagcacagggaccccaatggaggagttaggggaaggactgaagatgctaaacaggccttatcaatggaatcaatggaaggggaggccctggattctgtgaaggcttgatgccccagtgtagaagaatactaggatgatgaggcaggagtgggtaggtgggtgggggagcaccctcatggaagtggggtctgggaggatgggatagggggtttgatgaggggaacccagtagagaagatagcattcaaaacttaaataaaataataaaaaataaaattctaataaaagaaaatgagaaaagtcttttgttggtgagggtttttgtttgtttgtttggtgttttggtagcctggttggttttgttatttgaggaagttgtcaaagtgatttattctgaaatttagaatctagaaagttacagagatcaacagttgctggtgcttccatgcataattgttcgaaacccagacaatctgcattgcttagactcttgtgtcctggatggctctgtggattcagattgccatggtagactacaatttaagattacttagtgagggactgtggttaaatcttcctgagggcaacagacactggaatagcattcccataatcagcatacatcataatcacacatatgggcaacaggaattggatatgatggcaaagaaaggaagtgtagctgacttttgatgttctatacgtacttctatcttctacccttgtccatttcttttttacacactcaaccctctaacaatggataagaggaaagaataatagaggggaagagagagacagagagagaaacagagcaagagacagagagacaaagatatagagcagcacagaggacactgaatcctttcttgttttatgtttgagaaataca

SEQ ID NO: 1786 - DNA, 1000 bp, mus musculus
gactagctctctcctgagtttcagtggtcagagtatactgtgcaggcaagctctcctcttgcagggaaggtgcccagatatctggttttcgaacctgcttactggcagaagttgtgttccactcaccagaggtcctaagatcccatggagagtcctctggggaccttgggggtgtccccagactctgcacccaaggtgccccggtgctggtgctggtgtcgaccctggtcaggccgggttttctgcttccctaattaatgctttctcaggtcctgaacaattggattagagcagcagttgtgttccactcaccagaggtcctatcatcccgtgtagagtcctgtggggaccttggggatgtccccagactccatacccaaggtgcgttggtgctggcaccgaccggaagggacagagtgtttctcttttgtttcctgtttttcttttataattttttggaaaagatttaggcaaacattcgatttatgttagagaaggtcgttgcattggataagagtttgcaaatagaggtagaactgcttcaaaagcaatgaagagccagtggaaggaaaactacagcgtttagaccttgtgtctgacaccagaaatatactacatgatgaaaaaggaagaaaaatagtctggaaggtaacctactgccgtgaggtgctgcatgcattttgactgccattttcccagagaactatcctgaaattaacagttgagaaaagtaggagatgatacaaatagaacctcatagtgctcagccgagtccaccaccagaggatctgcttagacctacccaggtactttcagccttacaagtctttctgcagcatatgccttataatgagggtgctcccgattatagctagctaagctggtgtctgatagaaatggcagacctaaagcattttgaagaggccacagaattgtgtgcattatactctgcatttatttaaaaaatattaaatacttgggctatgcagaatagagttat

SEQ ID NO: 1787 - DNA, 1000 bp, mus musculus
aatgtgagagctatggggattttgtttgtttgttttcattgacttgtcttattcagctttctactacagtgacaaaagcaatgaaaaaataaacttaaagatggaaacatttgcttggtcttaacattgcagaggactcaattcacagttaattagccccattgcctttgagcctgtgaggcaataacatcatgtcaaagagaatgtggtagggcaaaattgtgttcctcatgtctgggaaatgaagacagacataaaggaaaggctactactgacattaacctaatttcatcccactaggcccagtcctttaaaggttctgtcggtcactgagcaacacttctgggcaacaacagttctcaagaagtggacattatccttcagggcttgcccttggccctgccaacataaccttaaccatagcgcctcaggctgaagagagaccaaatttttatcttatgaacttccagaagacatttaagattcaaaccacagggtcctagaagcagaataaatgcttagggcttaccgttttaaataaaacacagtgtgatttgtagcattggccatcttctgtggcatcaatgcaacacatacctgatcacaaattaccaaaccaagtcactaaatgcattgttatgaaagcagctgcttctcttgactgtcttttctgagagcttctgctcaggattggcatcccatcatccaccacactgtgcctttggtggactggtgtatacatgctttgttactgaatgatgcctcctgtctgccttcccacagccataagaggtgacagatattcaaaatggagagtttatatttaagttgcactctattgtctagaataaaacactgagattattgttccccttagtaagctcctttaagactatttgcaggtggccttggggctagttttgacaccgtcctctcagcgatggtaaacatctcagtctcctgatatgatcaaagaccaccagttaaaaacacctaaaag

SEQ ID NO: 1788 - DNA, 1000 bp, mus musculus
gggcagagaggtcaattccactgcggttttcatgagggcactaatgttgacatggcacccgagggaaatcaatttcctggtgaccacaaaaactcaaaatgagagaggaatgtggactctcgttggaaagacagcagtcaaggaaaagaaggtgtcagcttcagggatgttaaggatgttaagggtgtctgctagcttgtaagtgagtcttttggatttgcatgggctctagtgcaggttattcaatagagtggtacattttagactgtattctttgctttaaagggactttctcatgtaagacagatcagcatccagatcatcactggagacatcctgtgataatattgtgtccttctttgtttgttttccctacttgtgaaagagacaagtgacacatgtgttccacaaattgtgaagaaggaagaatagccacttttagtgaagaacagatcttatggattgaggttttatttcatcttacaattccatgatactatctattatcaaaacaagacgaagccaaaacttaagtatcaggaacatagaggcagagattgtatagaaaccttggaagaacacttctttttttttttttttttacacatttttttaattaggtattttcctcatttacatttccaatgctatcccaaaagtcccccatatccctcccccctactcccctacccccccccactccaactttttggccctggtgttcccctgtactggggcattgcaagtccaatgggcctctctttccagtgatggccgactaggccatcttttgatacatatacagctagagacaagagcttcggggtactggttagttcataatgttgttccacctatagagttgcagatccctttagctccttgggtattttctctagctcctccattggggccctgtgatccatccaatagctgactgtgagcatccatttatgtgtttgctaggccccagaatagcctcacaagaaacagctatatc

SEQ ID NO: 1789 - DNA, 1000 bp, mus musculus
aaaaaaagaaaagagaatgctaaaatggagttttatattttatgtgtcttataatgtttccagtcttaagtgaacagttactaaagatttatgcagttcttaattttaatttttaatttttttttacactccagattttattcccttcccggtccatcctctgactattcctcatcccatacctccttcctgcactccctgtctccacgaggatgtccctagctttcacctcaccccaaaagacctcttaacaccctgggacctccagtcttttgtgggttaggtgcatcttactgaatccagacctggcagccctctgtatatatgatggagacttcatattagctggagtgtgctgcctggttggtggaccagtgtttgagagatctcaggggttcaggttaattgagattcctggttctcctacaggttggttgtgtgcaaatatctgcatctgactctttcagctgcttgttgggtattttggagggcagttatactaggtcccttttgtgagtgctctatagcctcagtaatagggtcaggccttggggcctccccttgagctggatcccactttgggtcagtcactggacctccttttcctcaggctcttctccatttccatccctgcagttttttcaaatgggaacagttatggctcagagctttgactgtgggatagcaaccccatcccttacttgatgctctgtctttctgctgaaggtgaaccctacaacttccctctccccactgaaggacatttctaaggtccctccctttgaatcctgagaggctcttatgttccaggtctctggtacattctggactgtcccccaacttccaagctcctgaggttgcctgtttccattccctgctccccacccaaccaataccagatcatgtttccctcttcctccccctcagcctgcctcccacttgtgattactttcttctccctcccaagtgggagtgaaacatcctctcttgggcccttcag

SEQ ID NO: 1790 - DNA, 1200 bp, mus musculus
tcccctccccaagttcttcatcccattgtatgtccaacttgcctctgagagggtgctctcccaccaattcactcatgcccaccttatccccaccgtcatctcccttccttgaggcagcatgtctctctagcattaggcacatcctctccctctaaggctagataagccagtcctctgctgcagatgtgccaggggacatgaaccagcacatgtatactctttggttggtggcttagtctctggaagctaccaggaatccgaattagtagatactgttattcttcctatggggttgcaatacccattcagctctttcaatacctcctctaacacttccgtgggcatccccgacctcagtccaacggttggctgtaagtatctgcatcagtctcagtcagcttctaatagtaattctcagaggacagccatgttagactcctgtttgcaagtacagcatggcatcagtaatagtatcagggtttggatcctaggatggatcctaggatcataggatggatcccatgttgagctggtcactggatggtctttccttcagcctccaatccatttttgtccttgtattttctttagaaaagaacaattctgggtcaacaaatttgaaggtgggtatgtggcccccatgactcaacctggggcaatgtctatatactatatatgatcttttcatgttctaactccctactgttgagcatttggctatggtcatctctgagtcctgggtgtctctcatatccctggtctctggggctttctagacaggttctcaccctctgacaccatttctgcctctcctccctctccccccctccgcagcatattttcactcattttcctggccctctgggcttctctcctgtctccccccatacctgatcctgctcctcctttccccttcctctctcttctcccatccaagttcttccctcattctgtctcccgtgacacctaatttaaaaacttggttaataaacacaaagttggaagggagatatactaaatgtccaaataaggctgtgcctaagagtaataagataatacattaaaaatcccagtgccagatgagtgagtcaaccatagaaattatgggtaagagactccatattggtcactaagataatatatgctcttacatattttttattgttttcataccagaactaagtgataataatctcttgt

SEQ ID NO: 1791 - DNA, 1200 bp, mus musculus
aattcttacccagaattgtttttcactaaagaaagctgcagagaaaagaatggagaagaaacagagggaaagttccagtgactggtccaaattgggatccatctcaaggggatgctccaaggtctgacacttttactgatgttatggtgtacttacagacagaagcctaacatagctatcatgagaaacccaacaagcagctgaccaagatagaagcagatacttacttacacgcaatcagtgtactgtaattggggacacttgtagttgaattagtgaaatgcttcaagaagttgtgaaggaaggtgaccccaaaggaggacgagcagtttcaactaacctagattccagagatctcttgggcactgagccaccaaccaggaaccatactcttgttggtaggagcccctgcttccctatccccgacacatatacagcagaggactgtgtggtctgtccgcagttagagaagaaacacataagcttcgagagatttgagggcccagggagtggggagacctgtctgggtggggtattgtagtgtggggtgggtgggcattgggttggtgtgatggggatatcctcttggtgacaggggccctggaggaatgggataatgaactgtcaaagggtgaactaggagggggataatgacttcactgtaaaaagatattaaagagattttctctctgttgtctctctaaagcgagttcactgaggagaacacaggccacagaagcagcagagcagctggaatagggtcctaagggcctacatctatagcaaggaggtggggctgatcctcagtcctctgtgcgccttccctgccagaggagagcttgcctccaggaagtgtctgaccacaggactgaggtgagattgccattttctctctggtgactctctaaggatcatccactcaggagtgcagaggctgcagaagcagtagagcagctgggacagggtcccttggacctaaatgcagccaggagaacaggacgttcctaagccctctgcccactgatcttgccaggagagagctagtctcctaggagtactgacacaggattacagacttatagaaggaacaagctcaatccagagacagcaagaatatctaacaccagagattagcagatggcaaaagacaaacacaagaatcttaccaacagagaccaagactaattgggatcatcagaa

SEQ ID NO: 1792 - DNA, 1000 bp, mus musculus
aagaattggaatccacgtaggtagctttcaagagaatgtgatacttatatacaatgtaaattactcaatataaaaacaaataaaataaaaggatttccagaaaaatggatataacagggagatcattagcataaacaagataaaccgattcatactctaccacatcacatagtctgcctgtctcccaggaggtctgctctaactaggcacacagtaggcttgctcttggcaggcacattgaaggctccctcaaacaagtcatagcctggtctgtctcccaggaggccaggcctaacctaggtcacagagctctaccttcctccaaaggaggccagctcagatcagagacatcaggccagttaacataagaaataaacaaatggtgagaggcaagtacaagatcaaaagcacaaaagccaatgcgtcaaccgaaccatcaaaacccagttctgtaaccacagcaagccctggatagcctaacatacctgaaaagcaagattctggcctaaaatcccatctcatgaagatgatagaggcatttaaggaggatataaatcactctcttaaagaaatataagaaaacacaggcaaacaggtagaagaccttaagaggaaacaggtctcttaaagaaatacagactaaaccaccaatcaaagaaaacacatggtgggactcatggctctagctgcatatgtagcagagaatggcctagtcagtcatcagtgggaggagaggcccttggtcctatgaaggctctgtgccccagtgtaggagaatgccagggccaggaagcaggagtgggtgggttggggagcaggggaagggggaggggatagaggattttcagaggggaaactaggaaaaggggtaacatttgaaatgcaaataaaggaaatatctaattaaagaaaaaagaaaaaaaaagaaatacagaaaaacataatcaagcaggtgaaggaattggacaaaatcatccatgtcctaaaaatagaaataaca

SEQ ID NO: 1793 - DNA, 1200 bp, mus musculus
ggcatttcctggaaagagtgtgctactactaagagaagaaagcacagaggagagataaagtcaaatatttccacaaatgtaaaaaacattaactaacatatagcttggttagcatagagcccgaagagactcacttagtgttctttccactaatattctaatggggcctggggctttgtggatttgaagcaattatataatccctccttttatcagaattttagctatgatttaccattttaaaaatgaactaatgtggtccaaaattgatttacctttgatttatgtacaataaggttttatggaactttgaaaaacacactaaaggcacgttagtatgtaaattctatgatgattaaaaggtgccatgccaatgcatgtataactaggcattgcagcttatgtaattctataaatactaagatgaaatgctaaacaaaatcaatcatgaaaatgcaagataagtgttttggtttctcaggtccaaagagctcctgggcaatgtgtattcaaaggctaaggggtaatctccaagaacagaagcaaatatgaaatatttgagaattaataacagagtagacatagaagagactcaccgctgtaaatgagacatgatggaatttgtacaaagggattttcactgctaatggcattatcatttcactgcatttgcctttatctgaaagtaaagaagatattccagaagtttgtggttgtgctttcttttgttttgtttttctgcaagtatctgatggtctgagataccccattttatctcattcacaatggctattgtcaagaaaacaaatgacagaagatgctggtgaggatatgaggggaaaggacatgtacacaatgctgatgggaatgcaaattagtgccacactatgcaaatccctatggtgattctgacaaaagctaaaaataagtccactatatgatcaaactacactatttctgggaatcaaaacccttttctaaaaagattaaaaacatcttcattatgtagtctttcaaaccaaattttgaggtcaaaaacactaaggattcagtctctggtatcatctgaaaaatgtgaatcctaatatatatatacttcagactattattcctgagattaaatgacagaacttccagtttttctgtgcttgtaaaagtttcttcatatgcagtatttacctccccaacacaccttctctg

SEQ ID NO: 1794 - DNA, 1400 bp, mus musculus
atgctttgcacctgcatttttgttgttattgtttagatttaacagtttcattgattgatagagccatttcttcttttttcttgtcttttctacccaacattcagtctcacacttctcacacttgattaaatctgttgctgagttttccctcttagcttttctttttaaaagattcttgagtttttcatttatttcaaattttatttgaatctagcttttctccagagagtggacatctttattaaattccattttcatatatttatgaagtaaatatatatttcatatatttaagtgtttttttttctcgctcaactctggtctatctatctgtgttcagaaatgtattcagatcctcttatggttccttgagtatatttgtaattgttatgttgaagtcatcgtttagtgcagaagctaagctgcttttacagggtaaactaggatgacaatgctagttcctggaagagacagtgtgtcgctttttcctgtttgtgcttttgtggtatgatttaggctcctggagttctgtcatgaatggcattttttggtatgggcatctgcactagcctttttggtgtgtttatgcatgcttttactccagtgtacaaggctgtagatcagcttgatgtcactgatttttcaaaccttggctactctgggaatgtgcataagacttgtcttggttgcaggttggaacacagtttttgtagcagacaggcaagagtgagggacttgctctggagggcctctaacgaggtgaggccccacagaagagaggaataggaaagtgattatcaggtaggcaggccagtggatttgtactacaagtttagtcccagatctttgcagtagatgaaatacctaataaatgggcaggcaggagattgtattggctctggaagtctctaactcaggctcaaggtgaaggttcacacagtctgaggacccacttatataaaaatgtattccttttttctagtgattaaattgctgtttcaccgaaaagagttttatgcaaggcaggcccatgaaaataaagaattccctgggctaaatagttttagcaagagagtcaggcaccatctttcatgaattttttttttaaacttacactgcactggaaaaagctacaactgaagatataagttcattttttaaatcatcacttaaaaccatgatgcaagattgcaaagccctattaattattagactttgatcatatatacatgttcctaaaatttgatattaatttataattttcatattttttctgtttctaattacctcactggctacttcagaatgtttgtcatatgtagtcactggttagtcatgtgttctgtcccaaacacaaatgaagagtataatgctttaacatttgttaagaagttgtattt

SEQ ID NO: 1795 - DNA, 1000 bp, mus musculus
ttaattagcattttaaatataaggagtattttttagaaaattcttgtttaaagtgttaggttctgctatttcaaatattcagtattcaaattattcaactattactgctggattgttattttgttgttgttgtttttcaagacagggtttctctgtgtagccttggctgtcctggaactcactctgtaggccaggttggcctccaactcagaaatccacctgcctctgcctcccgaatgctgggattaaaggcgtatgctaccacgcccggcttgaattgttattcttttaattttttcccccaataagtgtattctgaaaaattatgaaaattgtatgcttttaataatttttctcttgtattttatgttatttttatttttgcactttagggatcatacccatagttttttacatgctaggcaagcactctagaactaaaccacatcccagtcctaaatttttttcccctgtaaaaaatattcaaggggggcttcatctagcagctgattgaaacagatgcagagacccaaagccagacagtaggcagcggtcagggaatccttctgaagaggggaggattgcttatagaagccagaggggtcaaggataccacaagaaaaacctcagaatcaactaacctgggcctatagggaaccacagagattgaatccacaaccagggatcccatgtagacctgacccaggttgtctgtatatatgttatagttgagtagcttggtgttgttatgaagctcctaacagtggagttcagactctctctctctgactcttttgcccacttctaggacacttttcctcatattggattgtttcatctagccttaatacaaggggcagtgcccagtcttactgctcaataagccatgtttgcttgataaccatggcaggcctgccctttctaaagagaaatggaggaagagtgaagggggagagaggaatggaaggtaggagatactctgagcaggatataaaaaaat

SEQ ID NO: 1796 - DNA, 1400 bp, mus musculus
aactgtgtgatcattaatgtttatattttaataatatttgttttaacagtttactattagcaacttttataatattaaaattttataaactaacgtaatgaatcccagttaagatttctcagcctaaataattaaaatttttttgagttcaagcttttttagtaccaaaatatactttacaccacagttatcgtccatcaagaaactgggaacttcatttttcatagcatatttttacaaaaatcttaatttatttaacagattgtgtatatttagcagtttactttatcatagggatatgattacagatgagaactttacaagaagatatttataagaatataaatcactgcaattagtgtttatcataacttttgttatgactcaatttttctttcttttttttaatttatttattatgtattttcctcaatgacatttccaatgctatcccaaaagtcccccataccctgcccccccacttccctacccacccattctcattttttggccctgtcattcccctgtactggggcatataaagtttgtgtgtcccatggacctctctttccagtgatggccgactaggccatcttttgatacatatgtagctagagtcaagagctccggggtactggttagttcataatgttgttgcacctacagggttgcagatctctttagctccttggatactttctctatctcctccattgggggtactggttagttcataatgttgttgcacctacagggctgcagatctctttagctccttggatactttctctagctcctccattgggggccctgtgatccatccaatagctgactgtgagcatccacttatgtgtttgctaggcccctgcctagtctcacaagagacagctatatctgggtcctttcagcaaaatcttgctagtgtatgcagtggtgtcagcgtttggaagctgattatggggtggatccctagataaggcagtctctatatggtccatccttttgtcgcagctccgaactttgtctctgtaacttcttccatgggtgttttattccagtcttcattcttctagagtttcatgcatttggcaaattgtatcttatatcttgggtatactaagttttgggctagtatccacttatgagtgagtacatatttctaatttttctaaatggttaagacttaacaaagtttgcaagaacataagtgattaccatgattatatatgcacttataagttagtttttatttccatgaacaaatcgctagagccttaagaaattataatcttaatcctcaaacatagcacccttaaatcccatccatcataaatcatgtttaaattattcaaaggttttataacttgatttcaagcttttataattttttgtcctcattg

SEQ ID NO: 1797 - DNA, 1200 bp, mus musculus
aaaacctttcaagttacactttactcaagcacaatagccattgtggctgtgttcctcctcaggcaacaagttatctgaaaaagattatttgaaggcaaaggccagtattcttgaaagagttacattctcagaacaaaagtcttcttgcttaatgtattagtcagggttctctagagtaagggaacttgtgtgtgtatgtgagagagagagagagagaaagagagagagagagagagagagagagagagagagagagagagagggagggagggagggagggagggagggagggagggagagagagagagagagagagagagagagagagagagagagagagagggagggagggagagagagagatgaaagcaagcaggcaagaagcaaaaacttcctatttccatgttcttccatctgcctccagcagatggcgtgtcccaaattaaaggcaggacttcctatctcaaaagacctggtcttcccattcaaagatcctgaatagaaaaaaatcttcccacttgaaattaactaaaaatccctcactggtgtgccatgtttgggggttttaccatttcagaatcagttaagttgaaaaccaagaacagccatcacacttagggtcagggcataaaagtgactaactactaagagtcacagaaaacgtgaagaactggttgcactgtgaatctgtgatctatgcttcatcagaaaggagagcaaaagtgggtttccttacagaggctggaagaggccactgaaatcattaccctggatgacatgtggatggagcaggtattcctgcttctctcaatctttctcagcgttcataacacagaaatagaaaagaattgtgttcttccagtgtctactgtggtcttcagacaagcagtcttctgtgaccacgagttctttttgtctcctagagtgctgagaaatcttaccaactgtgcttctgtcctgggtgtaaggaagccccatatctgcacgcaggtaagcatcagggatatctgcatcagggatatctgcatcagggatatctgcatcagggatatctgcatcagggatatctactgagagaccaatggagctcaggtttgtaacctgagctttagagtatgaaggtttggtgttaagctttaaaaaaaaactataaaaacaaagatcttgaccaatattcattcatacatttaagaacattta

SEQ ID NO: 1798 - DNA, 1200 bp, mus musculus
tgtagctacaatcattaaataaaaaacactttaccattgtcaaacacattaatcatgaaccatttattagcttttttactccgaaacttagaggctgtgcactcgcctttatttcctaaaacgaacagtttttccagcaggggccctcccgccatgtgtctgattcctgtatgaaacacgtggcagctctcggctttgcagataaagtttttttataccatctttattatccaacacaaaacatagaacattcattcatacagactggacatgaacatacatgaattgaacacgagaacagattggtgcaccggacattagacaagacacaaaaggtaacagagtactcctgctacaaggcccagagagaaatttctctctactttttgggacattttcctcccttatgatgcattttttattaactggggcaatccgcctattccttttaataaaccctttcttttctcacacctcatgtagcttcggagagctacggcctaccgcctgatacccagctcctcactgctgaacctaagtgaaccagcgctcgggtttaacgctgtctcagcttagcccataccttttccggtatgaatttcctttattctttattttatggagctccgaaccagcagcgtctctttcaaaaatcctttgccgtttctcagccccacgttgggcaacaattgttgtgtccggccagcagaccacaacctgggttctagcctggaaaggcattttggaaacctggaagagaagaggggctaggtggcgagagaaaagaatgtagctaagacaattactctgatcaaggctcaaattttattgttgcgacactagttatgaaggaagggggaggagacccgattcccgccgaataatctctggtccagtagaaaggtgcacgtgtgtggctcctcaggttccagcagtgggcgtggcagaacgaatgagcaggaagctccaccccgagcaagcaggtttcaggctaggggaggggagactacaattctgctgcttacaagaaacccatctcagggaaaaaggcagacactacctcagagtgaaaggttggaaaacaattttccaagcaaatgttctgaagaaacaagctggagtagccattctaatatcgaataaaatcgacttccagcccaaacttatcaaaaaagacaaggagggacacttcatactcac

SEQ ID NO: 1799 - DNA, 1000 bp, mus musculus
gggtgattttgttcaattcctttgcttgtttggttgtgttttcctgtaattccttaagggatttttgtgtttcctcttgaagggcttctagctgtttatctgagttctcctgtatttctttaagtgagttaattatgttcttcttaaattcctttatcatcatcatgagatgtgattttaaacagagtcttgcttttcctgtgtgttggagtacccaaggcttgctgtggtgggagaactgggttatgatgatgccaagtagtcttgatttctgttccttatattcttgtgcctgcctcttgccatctggttttctgtggtgttttctggtctttctgtctctgactgtggcttgtccctcctgtaagcctgtgtgtcagcactcctgggagaccagttctctcctggtgggatttgggtatggagagctgtggcacaaggtcagctccgggtgcagataggttctagaaggatctggtccgaggctgctcctcggttcctgtgtcctgagggctccaggagggtccctcttgggctgagcatttgagcagaagtggtggtcttacctgtgctctcaggtgtatcagcactcctggaagaccagctctctcccagaggaatttgggtttggagagctgtggcacagggtcagcttcacgagcagatggaaaccggaagctctatattatttttaacttattaacaaatatatcgagtttttaaatatttttttaaataattttttataatatacttcagtcttaacattcttcttgttatcataaaatttcgaaaacaattttaatgagttaattaaaaatggaagaccaagaggctttatgtaaaacacaaaaaacatggtgttttagatatctaatagttataagtagttaaaatacattagtagttttgtgaccaaatttaaattaagtatgtgttaaaatttaagcccttatgcggtataagatgacatggaatttggttgttagaaacatcattt

SEQ ID NO: 1800 - DNA, 1000 bp, mus musculus
aaaatccataagcaaatacactggaaatccaagcacaatccagcattttgctacatacaagaagcacacctcaatgacaaaggcaagcagtacctcagagtaaaagactgaaaaaaaagtcttacaaccaagatgtcccaagaaacaagctgaagtagtcattttaatagtcaataaaatagactttcaaccaaaagttatcaagcaagaaggggaaggatacttgatatacatgaaagaaaaaaatccaccaagaaaaagtctcaattaagaatatctatgcctcaagtgcaaggttacccacactcataaaagaactttactaatcttcaaaacatacattgaaccccacacaataatagtgggactttcaacaccccactctcaccaagcaacagagtggagagccgtgccacgagcaatcgccattataagatggtgctggcttccactgcacctaactagtaaacaagccttatgcgcaagtgcaagagtgaactcacacctagtcactgcccatctcgcggagtagtaatagggtgatgggcgagcaacgaatcaggagctgtcacgccacatcaggtgctgaaacgtcacgctgctggctatataagcagcgccattttcccggttcggggtcttccctcctgataagtaagcaacaaaaactttgccgaagaagattccagttgtcctgagcgtgttcttgcccgtggggacaaaagctcgggatacaacagttcattgaaacaaaaactaaacagagacacagtgaaactaatagaagtttgaataatgtggacttaagagatatctacagaacatttcaccctaaaagaaaagagtataccttcttctcatagcctcatggtaccttctccagaactgatcaaataatcagtcacagaacaggctgcaataacaagaagattgaaataataccaagctccctatcagatcaccacagacaaaggctagacttcagtaacaaggaaaacaa

SEQ ID NO: 1801 - DNA, 1200 bp, mus musculus
tctagggactagtcttttgagaagatatagtaaatcaagagaataaatattgcaatactgataaatgataaggtgtctattgcctttaaatccatccctgtcaaaccattcaaaatatcatcaagtaaagccaaaaggatatgtattatttttcccatctttaagtatcaaaaggttatatatctctttttatatcagtaaattgcctggttgggggccctttgtacctttatctccatgactctttatggataagaagacactgagacctgcgtggtcatctgcgtggtcatctgtgtccctggtttgggtttgggttgcagctggcattgtgtgcttgtgtgcagatttcaggaaatccacagcataaacaagcagtcaggagctccaatctggctgtcctagacatgagagtgggggaggcaaagtggggggcgaaggatacggagaagcgaaaacacagaaaggcactctcaggcatagatgcccctattagttcactgtgtctgccccaaaactacctcacaggcagttgtgttccctacagctccaggctgaggtgctaccctggctgtagctctcagtcagggagttgggggaatgagcctctctgttgttctctgtaggccactcagactcagtctgtttccaatgcacactgctgcagcctatattgttgcccaagccctattcagggattggggggcagtaaagttttatctcaggttagctgagttcaaataaatatgttgggtgccattttgttgtggtaattctcctcccaaatatgccccaacaatgaaaacacaactcagttaatatggttacatgatgtgcatctagattgggcagatctaccacagaactaccatcttccacatctatgagacagaccccttagaacttgcagtttcttcaggccatgtgcgtctgctctgcctttcttcttcctcctcctctacctcctctctctctcaaacatccttcttttctttctttctgctcctccttccctctctaccttctccctctgtgcccaatcatcagctcactttactttaaaaattaaggtgggaagaaggtttacaagaaatcacctgagtgctgactcatttcttgttcacagcccctcacaggagaacagtattgtcatcaaatatagtaagtcccagggctagctactacgtgtgtgtttgtgtg

SEQ ID NO: 1802 - DNA, 1000 bp, mus musculus
ccacttcttgacccttgtgttcccctgtactggggcatataaagtttgcaagacctaggggcctctcttcccaatgatggctgagtaggccatcttctgctacatatgcagctagagacacgagctctggggggtactggttagttcacattgttgttccacctatagggttgcatacccctttagctccttgggtattttctctagctcctccattgggggccctgtgttccatccaatagctgactgtgagcatccacttctgtatttgccaggctctggcatagcctcataggagatagctatatctgcccctgaaaatcctcttaacatattttggcccactaacaatgtatataaaattgaaaataatagcacgtcttttggtgcatacttctttagttttcaagggatccttgatcccttgctatggtgttctcatcgttatattaattttattttaattagcaaatcctctaggctatcaatcttggaatttgtcaagtaatttttcttcatgtactgccaaactttccttcagaaagggaaaggggacagtttctgtggagagccgcaataacatttgccgtcacaagatggcgccagattccgctgtgccagctcggcctttggagacaaactgtgcacatgtgcaggagtaatgcgggccaaagtcacaagcccacccccagggcctatgagatcgtgggtaagcaaccagtcaggcatggacacgccacaccagggggtatttaagcagcgcctttctgaggcttctttgtcttcctcatcaatatgcaataaagtttggctgcagaaggatccttgtgtcccttgtgcgttcttgctagcgagaacaatagctcgggacaagtttcttctgtcttatatactatcactcaagttttgttttttaattctaaccattttgccaatgtttacacgatttatgtaaatgaaaagagactactgttacattggtgcataagagaatgatttc

SEQ ID NO: 1803 - DNA, 1000 bp, mus musculus
tggttaagacaaagggtaagaatttgtgggcaacctagcctctcacttctgcttccctgggtggtttttgttatgatttgtatcactgtgggtagaagattatcatactgtagacaataataagttgcaatatcttcaggctccaggttgctgatgctgaaggaataatctctcccagacccacttccactgaaccttgatgggatgcctggctgtaatgtagatgtgtaatgtatgagcagcctaggaccttttccaggcttgtgttggtaccaagctatatacttgttaatgtcttggcttgccttgcaagtgatggtgactttgcctcccagagatgcagacagtgaggatggagactgtgtcatctggatgtcacactgagcacctataattaaaaagaacacaaatccctatgaaattaattatattcaaagaagatttttctgaaggaccagaaattcctgatcacatactctttttagcatattcaatgttaaactccttaccatgaagccagaacaacaagagccccaggaactgaatagacggtctcatttctacaacgtctcctgaccaagaatgactgttggagtgtgtatgatcagattattaaatctctggggcagtagaatatgatctcagcacatgcaaatcagcttcatctggacagtgctgggcacagctgcagaataggcttattttagtaactcaaccaaagcgtaacaacctctgatttgttacatcagaccagcacagacagatttttctccaatgaaggtgctcatctttggaggcacaaaaaatagtcttaaaaagcatttatttaatgctttttaaaaatttcccccttgttcagtacatcattctattcctatatgttgtatatgctagggagtttcaggatttgcatgttcacagaaacttcaaaatgtccattaatagttatctgtagatatcactggcataaaaattcattcttgtttatgattatacctag

SEQ ID NO: 1804 - DNA, 1000 bp, mus musculus
aaaatcacacacacacacacacacacacagacacacacacacacacacacacacacacacaccttatcacctcaaacctcaaaagaacaggaactaagagtgtgagtgaagatgcttcaatagaaagctataaagggagacagagggagggagggacctgagtgggacgggagaggagagggttgtaccagagacctgtgaggtgagaaactctcacaactcaaagggagggactgtagatgaaaagtccaacgtggaggaagggaacttgtagagtcaacctccagtagaaagatggggcatcaagtggaggagtggggtggccatcccctagtcaaaatctctgatccagaatggttgccatctaaaagaactgcagggacaaaaatggagaagagactgagggaaaggcaatccagtgaccggtccctggatcggtctcaacgtgaggaatccctctcaaggtgaggatccatgacctgacaccattattaatcctatggtgtgtttacagaccggagcctaacatagctgtcctccacaagtcccaacaaggagctgacagcaacaaacatacacacttacatgcaaccaattgactaaagtatgtgacaactgtggttgaattaaggaaagcctgattgaagctgtggagaagggcaaccccataggaaaaccaacagtctcaacttacctggacacctgaaaacactcaaacattgagccaccaatcaggcaacatagaagagtttgtctgagcccctggacacatatacagtaattactaggattgcctggtctggcctcagtgggagaagatgggcctaaccctagagagacttgaggatccagggagtggggagacccagcagggagtgtgggttatatgtgccatcctcttggagacatgggggagtagggatgggtgaggaactgtgagagggtagatggggcaaggtacggactagactgtaaaaataaaataataaaaaattaaaat

SEQ ID NO: 1805 - DNA, 1400 bp, mus musculus
ggtttaggagttctctggtggaatttttagggtcacttatatatactatcatatcatctgcaaatagtactattttgacttcttcctttctaatctgtatccccttgatcaccttttcttttcttttcttttctttctttcctttttttttttttttttttttttgtctaatttctctggctaggatatcaagtactatattgaacaggtaaggagaaattggacagccttgtgtagtccctgattttagtgggattgattccagcatctcaccatttagtttgatgttggctaagggtttgctgtatattgcttttattatgtttaggtatcaatgaatttatgaaattcttaaagaaatggatggatcttgagggtatcatcctgagtgaggtaacccaatcataaaagaactcacatgatatgcgctcactgataagtgagtattagcccagaaacttagaattcccaaaatacaatttgcaaaacacatgaaactcaagaagaatgaatacccaaatgtgggtacatcgtccctccttagaaaggggaacaaaatacacatggaaggttttacagacacaaagtttggagatgtaggaaggaccatccagagattgccccaccaggtgatgcataccataatcagccaccaaacacagacactaattcacatgccagcaagattttgctgacaaaaccctgatatagccctctcttgtgagggtatgctagagcctgggaaatacagaagtggatgctcacagtcatccattggatggaacacagttcccacaaaataggtgctagagaaagtacccaagaagctgaaggggtctgtaaccctataggaggaacagcaatatgaactaaccagtaacctctgagcttttgtctctcgcttcatatgtagctgaagatggcctagttgaccttctttgggaggagtggcccgtggtgttataaagattatatgcccccacactgggcaatgcaaaatccaggaagcaggagtgggtgggttggggagcagggctaggggggagggtatagtggactttcaggatagcttttgaaatgtaaatgaagaaaatacctaataaaaatcgttttttttcttttttttaaaaaaacaaaacaaacaaaataaagaaatgtgattgtgctgccaactactgttaagatagccaaagtgaaggcagggttgcatcatgtctattttggagtctagaagaaatactgcatttacagtgctgtgtgccaagtagtagtatgttaagaagaaaaatgtactgtggcaattctttatttccagtggttacaaacataaatgaaatagtgttcacacagacacattcacacttataccacattttatgacttcatgaaatgaaaaaaca

SEQ ID NO: 1806 - DNA, 1000 bp, mus musculus
aatcaggaaaaatattgagaataaataaacactggcaaaaaaagattacttgagaacagcactgaattatttgagaacagcagtggattattaaagagacattcatccaaagatgcaaatgactttgtgaagcagaacacgctgtgtggacttctgcaatcaaaccactggccacagtttatctctaggaggaagtagcagggccctaaggagttacggtgtttttgtttcagtatgtagcactgtgtgaatgggtaaccactccactgctggcagtaataagttgcatcatcttcagcctccacgctgctgattgtgagagagtaagaggtcccagacccactgccactgaagcgagctgggactccagaagccaggttggatgtcctatgaatcaagggtttgggggaagcgcctgacttctgctggtaccagtgcaagtaactggaacttacacttgagctggcactgcaggtcatggtgaccttctgccccagagaggcagccattattgctggagactgggtgagcacattttctcctctggacattatgactgaaaaaaagagaaatagaggaagatggattagtagaaatataggtaaaaaataattttataccatccaacatttagatgtaagaaaaagaaaaaaagtacattttagactcaaattccccaggaataagaattttagttgcattctaatctcaaactccctgccctctgttacctgtgacactgattagcaggaagctgataatctgcacctgtaaatccattgtgtctttgaattttagttcctggctaattactcctattctcacaagtactttgctttaaaagaactgtgagatatttgtggttacagaagatgaagtatgcaaatagcaagatatagtatacgcagttcttggcttataacttggtctgttaactaaggtaaatcaggttaaaccaggacaatatctatgtatttgcattcactacactgaaaaagaa

SEQ ID NO: 1807 - DNA, 1600 bp, mus musculus
gtttggttttgttttttccattttctggctattataaataagggtgcagaggtagcatctccttcaggactttcaatatatctaggatcactggtgagaccctgactccctccacaaaacctggcctaaatgggacacacacacacccaggacccagggtacacagccagaagcaagagtactcccagcttgcacttgtccccaagaacagagcctgtgctttgccttcattaatcgactcacatccagatgtagcctgtcctccaggatttctggcagatccagagtcacaggtaagatccccagactcccccacaatatatgtcctaactgggagctgccaggacctaggggacacaggcaaacctacccaactagaagcacaagcttatcctgagcacacccaatcctagggacataccctgggctctggatctccacccactctgccgagaccaagaagcagcatgtctcccaggacttctgacacaccaaggatcacagagaaagcagctccccaaggagttctgacataaccagggtcactggatcacaggttctcaggagggacaggctctagtcagaaacagcaaagacagctaacactagacacaactagagggaatgtaagcaatagaaaccaacgctgcttggcaccatcagaacccagctctcccacaacagcaatccctggataccccaacacacctaaaaagcaagattttgaattaaaatcacatttcatgatgatggcagagaactttaagtaggtcatatataactcccttaaagaaatacagtagagggacggggcaaaacaagaacaaaaagaaaaaaagaaatacatgagaacacaagtaaacaggttaaaaaacaaaaaccttaaaaaggaaacacataaagagcttgaattaatacaagaaagcacaaacaaacaaactacatcaaatagtgctggcttcctattgtgtttctgtttttgtttttgtttttgttttagtgtttctttttttttttttctatttttttattaggtattttcctcgtttacatttccaacgctatcccaaaagtcccccatacccaccctcccaatcacctacccacccactccagctttttggccctggcgttccactgtactggggcatataaagtttgcaagtccaatgggcttctctttccagtgatggccgactaggccatcttttgatacatatgcagctagagacaagagctccggggtattggttagttcatattgttgttccatctatagggttgaagttccctttagttccttgggtactttctctagctcctccattgggggccgtgtgacccatccaatagctgactgtgagcatccacttctgtgtttgctaggccctggcatagtctcacaagtactaagactgtcaaaacaggccactttgcccttctctgcctatattctggctccctctcctggccatttgatgtagtgtttgtagttgacagacacctgtgcatgcttctttacatatttcattgaactgtgagtacaatataattcaggtttttgcatagctggagtcacttggaaagaacagtacctcaa

SEQ ID NO: 1808 - DNA, 1400 bp, mus musculus
ctcctatcacttttcctatgagtaattggtcaatatcatcatttccttaagctaaagtactaggcaaacctgcatgagcctgaagataaataatatataatggatagtttctgatgacttgttgaaactgtataattaaaaaaattaactctcagttatcaggtacaaattcagcagtctctatatgcacaacaactctctctttgcatatagaacaccagtaattatattaagaggttcagaataatctaataacaccacaaggatatcatacaattctgatttttgaaccattatgtacagacttttgaccaccttgtttcttttatctgacttataacctgttatccctatcttatttgtacatgtaaaaattttggtgcctctggaatttgtatgctctttattatacgtgaaagaaaacaattagtcgtttttataaactgtatttgcttggttttttttttttttgcatatttgctattaatttcacccaagaagttactacaagcttttagctaatcctcattaatcacccacattgacacaatcccagcatttgtaagaggtactgtagcctcccccagcctcaaagcaggcttatccagactttgaccttgctaccactaagaaggagattacctagggtggagccttccaacctagatggctctattgttctgtcacctgccactgctctcctccaagacactgctacctactgagaggcccctgagatattctggaggaacaccctatcttgcactgttgcctacaggatggctccagacaccaagaatggactggtgggggatgggccttcccccttataagcacagtctcttagtaaactggcaggctttgaacagaatcatgtcttggtctccattaatctctctcacagtctaagtctctttcagccccagcctgcctcccaggtgtacctggttcatgtaggccacaggccggcatacaacaaggtacaacaatctgttcctgccaactgacatagacttaatctaccgtttataattaattcagaaatctttactatgtacatcttcaattttttactttgtttatgagttaagaaaatgcattctgtaatactatctttcctttgaaaagtgagaccagtaggagaatgagttgaaagtaaaatgactagaatacaatcaagtttaggatcaattccattcacttatgcctcttgcagtctttgttctatgggaattatcacttattctgctttagccattagacattttaaactgtataaattcgaatcttcatgtactgtttgaaacaaatgacttaactcatatggacttaatccagttgtatatctcagccagttaataactaccaattatttttgaaaatcaaaagtttgcaattgt

SEQ ID NO: 1809 - DNA, 1200 bp, mus musculus
atggtggctcacaaccatctgtaacaagatctgactccctcttctggagtgtctgaagacagctacagtgtacttacatataataaataaataaatctttaaaaaaaaatatttaagtctggtctttgctgctggggcagacccctagttgctctgcttccgtgaagactccatatcccaacccatcctagaggaaccactgcactcaaagcagttggtaagaaggccccaaccccaacaccagagtccctaagctgcagctgagagcctggtggactcatgaaccatcacctaacaaagcacccaccctcccaaacagcaatccccttctgtcccttccactcattccacccaatactttctgctggggcagactcctagttggtgtgctcctatgtaaactccataacccaatacatactagaagacccgctgcactcagaggggttgagaacccgctgcaatcggagcagttagacaacagattgactgctccactgaagacccaacagtctgaaggcttcccaagagatctactgcagtcagggcaacatatcagcagcttctttgcccctgtgaagattcaccagttggaactaccaacatgcggtctgatacagccagggacacaggcctaccaggagatctgaagcaacccaaggacaaaagaggcagattccaaaaagttaccaagaccaacaaacaccaggaatatccagatggcaaaaggtaagcccaagaccataagcaacagaagccaaaatacgtggacatcatcagaacccagctctcccaatacagtaagtcctgaatacaccaacacacctgaaaatcaggaatctgtcctaaaaaatctgtcttcacagttaaacaggtgaagaaattgaataaagcaatccaataaagcaaaaattgataacctaggaaagaagtcagatattacagatgtaagtattccaacagaataaaagagatagaagtgataatctcaggtgtagaagatactgtagtagagattgacacaatggtcaaagtcaatacaaaacattaaaaactcctaacccagagcatccaggaaattcaggatgcagtgaaaagaccaaatctaagaataaacagaatagaggagaatggagattcccaactcaaaggacctaaaaatgtcttcaataaaatcatagaagaaaacttccccaacct

SEQ ID NO: 1810 - DNA, 1000 bp, mus musculus
ttgctgctggggcagacccctagttgctctgcttccgtgaagactccatatcccaacccatcctagaggaaccactgcactcaaagcagttggtaagaaggccccaaccccaacaccagagtccctaagctgcagctgagagcctggtggactcatgaaccatcacctaacaaagcacccaccctcccaaacagcaatccccttctgtcccttccactcattccacccaatactttctgctggggcagactcctagttggtgtgctcctatgtaaactccataacccaatacatattagaagacccgctgcactcagaggggttgagaacccactgcaatcggagcagttagacaacagattgactgctccactgaagacccaacagtctgaaggcttcccaagagatctactgcagtcagggcaacatatcagcagcttctttgcccctgtgaagattcaccagttggaactaccaacatgcggtctgatacagccagggacacaggcctaccaggagatctgaagcaacccaaggacaaaagaggcagattccaaaaagttaccaagaccaacaaacaccaggaatatccagatggcaaaaggtaagcccaagaccataagcaacagaagccaaaatacgtggacatcatcagaacccagctctcccaatacagtaagtcctgaatacaccaacacacctgaaaatcaggaatctgtcctaaaaaatctgtcttcacagttaaacaggtgaagaaattgaataaagcaatccaataaagcaaaaattgataacctaggaaagaagtcagatattacagatgtaagtattccaacagaataaaagagatagaagtgataatctcaggtgtagaagatactgtagtagagattgacacaatggtcaaagtcaatacaaaacattaaaaactcctaacccagagcatccaggaaattcaggatgcagtgaaaagaccaaatctaagaataaacagaataga

SEQ ID NO: 1811 - DNA, 1000 bp, mus musculus
gatactcataagtggacattagctataaaatgcagggtaatcatgctacaattcacagacccaaagagactgggtaataaggagggcccaagggacaatgtgtgagtcttactcagaaggggaagcaaaatagtcatcagaggtggatggagagagggagctagatgggaaaaagggtgaagaggggaatggggatggggaccaggtatggggagggggttcaggagaggactgggagtgagaatggaaatcggtgagagggctatctctgggactagctggagacctgggattggagaggacttgggagagtctatggaagtgaccctagctgactgagattcctaccagcaggggatatggaaactgaagtggccacctcctgtagccaagtgggacttctagtgggagtgggggacatcaactcatccataaaacctgccaaccaatgactgccttaagacccatctggtgatagagccagtccctgacactgttaatgatgctctgctctgcttgcagaccggagcccagcatgactgtctcccgaaaggcctcatccttcagtagataaaaagagatgcagagacccacagccaaatatcaggcagagctcggagagtcttgtggaagaatggaggatagaattgatcaagctggatgggtcaaggacatcacaggaagacctgcagagactcaaccaccaaccggaaagcatgcacaggctggttctaggccctctgcaggatgtaaagcttggtcttcaggtggatcccctaacaattggagcaggggccatctctgactcctgcctgcctttggatcccttcccctaatcagactggtctcagtaggagaggatgtgtttagtccttctgcaactagatatcccagggcagggtggtacccaagaggggcttccccttctctgagaaagggaggagctactggagagaatgatttgtaagggtgggactgggaggagagggctttgtttagg

SEQ ID NO: 1812 - DNA, 1000 bp, mus musculus
aaggtgctgggactacgcacatgtaccaccatgcccagctcagaataatgtttctcaaacacagatctgacatcacacttttgtgtcaactgattctcaaccttgttaaaatataatccaatctttttgcaaagacacataaactgaaaaatcctccttcccagctagcaccttggctctccactgaccatggaatccgagatatgacgaggtatgattacttactctctgtgccagacacttttgtgcatgccaaactatacactggcacctccatgactgcctgcctggcatgcctattaccgacccacctccttctcttctaccactcaggactcttcccagatgctcccacgaggaggcgactctgcattctcttatcacagcacttaacacactctgactaccttcttaaacaattaccctccccatttagccagggagctcctagaataatcatattccttatcaccacagctctaaaactcagcaagaaaaggaaagtgtaggatgacccagtactagggagacagagacaggcagagtttgagtttgaggccagcctggtccacacagtgagctccagaacagtcagggttccagagtgagtccttgtctcaaacacaaaaggatgaacaaatggatgtgctatggtgctgcataagaccccgagacttcactcgtagcagtcagaactggactctgagagatgagagtgagccaacagttccctgagcatccagtggggaacatgccacaggtggggaacacagcacaggtggcagctgctcaccaacaacacgctcttgccccagttctcccacaagcaataccaccatctgccaaaggaaacagtttgtcttcactcagctgcaatctctttggtttctctgcacaggacccactgatcagagaagaatgaagagcctaatccactatccatggaccagtcccttcagctctatcaggattcgctgcaaagtggaaatgaatgtgttcg

SEQ ID NO: 1813 - DNA, 1000 bp, mus musculus
atttctgaagatgtactcctgttgttaatagttgttttttaaagtttctatgtgtgtgtgtgtgtgtgtgtgtgtgtgtgtgtgtgtatgtgtgtgtgtgtgtatacatatatatgtgtttatatacacacataaatatgtatatatgtgtgtgtatgtatgtttacttattcatttatgtattatgtatgtatttgtgtctttgtgtttatgtttatatttatgtatgtgtatgatgtttgcactgtgtgtctgtgtattctttatggtgccaggccttctgaacacagaagagttcattgaaccttcagaagttgatgatttgttcttatagaaaatgtggtgtgtgtgtccgtttgtctgcctgtccaaaacgttccacttcttctaagttatcaagatggttagtgtttagttttcataataatttcagtgatgccagaaagggcctatcatgaccgccctccgaaagacccaagaagcagctgaaagtgtcagaggcagatatacacccaaccaatggacacaagctgctaacccctgtggttgaattagaaaaagctggaagaaactgagaagtatgaaactttaggaggatgagaagtctcaattaacctggtccctgagatctctcagacacaggaccaccaaccaggcagcatacaccagctgatatgacactgccaacacatatacagctgaggactgccatggttagactcaatcagagaggatgtacctaaccctcaagatactagaagccccagagagttcagaagtctagtggggtagggtgtgtgtggagtggggacatcctagtggagatggggggggggtatggaacagtcagagggtggaccaggagggggataaaatgtggactgtaaaaaaaaagattaaataaaaaatgaacaaagagaaaaaaaagaaaagtataatttcagcgatgcaattgtggtaccaactgtaacatctttgtattttagttttgaattttatt

SEQ ID NO: 1814 - DNA, 1200 bp, mus musculus
aatggtatctactcaagctagacctccaaaatacagccattgaccttgaccaatttatctggtgtgctaatgaggatattagtataaaaatgttgattttcaagacaggattccatgattaaggaagcaggtataaggcatagaaggtcatagacataggttttcatatacttgacattaaagatagaatagagggacactgaatatctaaaatcttattcattctctagatgaagttgactttcaaagtggcataatagaaggaacattccacaaaacaacaacaacaacaacaacaacaaaatctgtgttgtccttctagaaaaaggtaacagaaaattctacttatttggaacgatttgtcaatggtatattattttagaattcctggatacccaaataatgcagggagggatggagcctcccaggggtgcagacagcctgtgagtgcaggtaagaccaccactgctgctcaaatgagctcatccagaaccctcaggacacaggaacctaggggctacctgggacaggagtcttccagtttccatctgtgcccagagctgaccctgtgccacagagctacacacacaaatacccccaggagagagctggcttgcaggagtgcctacacactttcaagcacaggtaagaccaacacttctcttcaaattcctggaccacgagggaccctcacagagccatcaggacacaggaaccaaggatcagctgggtacaggatccttctgatctctgtctccaccccagagctgaccctgtaacacacctctccatacccatgttcctccctgagagaactattcacccagggggtactgacacacaccacaggcttacaggagggacaaaccaaagtcagagacagaaagaccagctaacaccagagataaccagatggtgaaaggcaagtgcaaaaacataagcaacagaaacctagattacttgccataatcaaaacccagttcttccaccacagcgaaccctggttaccctaacacactggaaaaacaagactgacttagaatctcatgatgatgatagaggaattcaagaaggaaataaattattcccttaaagaaataccagataacacgggaaaacaggtagaagacttaaagaggaaacacaaaaatcccttaaagaattacaggaaaacacaaccaaacaggtgaaagaactgat

SEQ ID NO: 1815 - DNA, 1000 bp, mus musculus
acaggaatggtatatttagagaatttaatgaatgcatgtgagaatgaaaagatcattcttttttattattatgtatttttttcatttatatttcaaatgctatcccaaaagtcccccatacactccccctgcccactctcctacccaccaactcccacttcttggccctggcgttcccctatcctgaggcatataaagtttgcaaaaccaagggacctctcttcccaatgatggccaactaggccatcttctgatacatatgcagctagagacacgagctcccagggtactggttagttcatattgttattctacctatagggttgtagacccctttagctccttgggtactttctctagctccttcactgggggtcctgtgttccatccaatagctgactgtgagcatccacttctgtgtttgctaggcaccggcatagcctcacaagagacagctataacagggtccattcagcaaaatcttgctggcatatgcaatggtatctgttttggaggctgattatgggatggatccccaggtgtggcagtctctagatggtccatccttttgtctcagctccaaaatttgtctctgtagaaacaataaagaaaacccaaagtgagacaacgctggagataaaaaccctaggaaagaaatctggaaccatggatgtgagtatcagcaacagaatataagagatggaagagagaatctcaagtgcagaagataaaagataattcttgtgggaggtaactttaaattttaatttaggcattcctatttgcatagaagcattataggggtaggcaggatggatggaaagtagcttttttgattattttctcttgggattggtttggtttggtatggtttttggtaggttggttgtattttgtggggacaccatctgtctctgtagcggcagctggcctagaatttgttgtgcctacaaggctgccctctatctcaaggaatcctccccctcctcctcccaaatgc

SEQ ID NO: 1816 - DNA, 1000 bp, mus musculus
taagaatctgttttagttaccttctattgttttaataaagcatcaagagcaatacagaatttggaagaaaatatttatttggagcttacagttccagtgacaggagtccttcaccatcatggctagaagcatgggagtaggcaggcctggtactcaacctgcagttgagagcttacatcctgacccacaaacaacaagcaaagaaagcctactggaaatggccaggaagcgttaaaaccagaagcttgaccccagtgactcaccttctccaatgagtctacacctccatcctgaaacaaccacttgatggtattcaaatggaggatactcatgaagatcattctcattcagactagaacaggatcattcaattgtctttttcctgcaataaggagatttcaagtttcctcagcaaaagatgcatagttctgcgtaggaaaagtaggaaatgtagtaagtagtagggtgtcatcagattattgtttttagaaaaaatgtacatactatttatgttttgtgtccttttttgttgttacaaacccatgtatctatttaccaacctacttatatacatataaatgtataaatacaacctgttgggtccacttagtggttgcttccatcttgatattggataaatacttaggtgacacttccatggagaaaaaatgactctctctgtgtctccatctctgtctctctatctctgtctctctctgcctctctctctctctctctctctctctctctctctctctctctctcctcggcagtcatcaattatctctctgtctctctgtctctgtctctctctgtctctttttctctgtctctctctgtctctctgcctctgtctctgtctctctgtctctgtctttgtctctctctctctgcctctctctctctctctctctctctctctctctctctctctctctctctctctctctctcctcggcagtcatcaattatctgtagcttttcttctaggatggggcct

SEQ ID NO: 1817 - DNA, 1000 bp, mus musculus
ccaacccactcttctaaactctcttttatatgcatggcaatatacatgaggcaaaaatcacagatgaaggctggggctcaactcataaagtgtgtgctgcacaagcaccaggaacaatatttggatcatcagaaccaagaacaatctaggcatgtgccagttcctgccagtaatttcagtgtcttgggttcagaggcaggaagggtagagacaggtagaaccccatggttaaattgccagcatgtctctccccaaatccaggagtgctacatttaatgggaggctttgtttcaaaacatgaagatacagaacacctgatgagctacacatgtcttttacctcagtcatctacatgaaaacacatttacagacaccatacacatgcaccacacatttactctgcactcccccatacaaaattaaaaatacgagtagggttgaacataatacatgaagaaagaaaaacaaaacatgtttaagtgactagaattttaaaatgctatcatcccaggatttcctaagtaatcaatcaactaatttctttagtattttattttatttaattttttttgcattaagaattttaaaaatttattcattttaggtaccagtgtcagtctctccttgtttccaagtaccccttatatagatagtcccctcatttttcctttactttttctctgagaagggggaatccccctctggatatctgctcccctacttactacacttcaagcatcaagtctctgcaggactgagcacctcctcttcaactgaggccagacagtgtccagccaggggaacgggatccataggcaagcaacagattcagaggcagccttcactccagttgctggggcccctgcatgaagaccaagctacatagagcaaataattttatatacagaattataattaagaaaatagttagttcatattgccagaggggtggacaatatcctgaagaaaatgtttaactctgggttgcagaggttgtata

SEQ ID NO: 1818 - DNA, 1400 bp, mus musculus
acccactttctctagtgtttagacaaatcaaatgaaactcaaattgctaaaattagccagacagaatcaatgactcctaaagaagctgtgggcagtgataagttaatcaaaagatatgtctccaatagtgaatgtttggtctccagagcatgtgtttaaagtataacaaattttgactgaaaataccttaatatgtgagatgtttctaacactaaagtgcttgtggtttcaggtccagaatggaaacaatgctccttcagtattgtattatgcttaccaaaagaaataaggtttttttttgttttgtttttttgttttttgtttttttgtttattttaataaatggacctctctgggcatcagaaaatgctacctggctgacagaacaattgattttctctcctgcccattgtgtagataacaatattgatgaaatacagaaaagacaaaaagaaggcatcaaatgatccttcatatttctggaaagggatgagagctttagatgagagtggtgtttattctgagcttctgggctaatatccacttctcagtgactgtatactaattcacagaccaaatgaagctcaagaagaagaccaaagtatggatacttcagtccttcttagaagggggaacaaaacacccataggaggagatacagacacaaagtatgaagcagagactgaaggaaagaccatccagagccggccccacctggggatccagcccatattcagtcatcaaacccgaataccagtgtggatgccaacaattgcttgctgacaggtgcctgatatagctgtctcctgagagcctctgccaatgcctgacaaatacagaggtggatgccctcagtcaaccattggactgagtgagcacaaagtccccaatggaggagctagagaaaggacagaaggagctgaaggagcttgcagccccataggagaaacagcaatatgaacaaatgagtacctccagagctcccagggactaaaccatcaaccaaagagtacacatggagggatccttgttccctctgcatatatcacagaggatggccttgttggacatcaatgggaagagaggcacttggtactgagaaggttcgatgtcctggagtaggggaataccaggacaagaagcaggagtaggtgggttggtgatcagggggaggggacatgggatagggtttttttccaaggggaaaccagaaaaagggaaaacatttgaaatgtaagtaaagaaagtatctaattaaaaaaataaataaaagtaagtgccatttatgtgcttgactgtcgcagcattcccatagagatactttcatcaatatgttgataaacaccaaaaactcaaaatcaaatctttagctataacagaggttgattggtagatattgc

SEQ ID NO: 1819 - DNA, 1600 bp, mus musculus
tgccatcataattttctagttagtgatgtgacagattacttataagtatgttaggttttttttgtcacaatcatattatcatttgttcttaaacaaaaacccttgtattattcaatttatcaattaattacccatcactattgtactctataatctctatctttatacctgtattttattgctaatagaagtcaagacattatgataacttttcaaaacctagattaatgaataaattctaagtaatgcatataagtaaggaatgacacttaagtatctaagtatgcacaaaagtggccatagactaatacataaaatataaaaaaaaacactttaaaaaagatttatgtattttatgtatatgatgatactatagctatcttcagacacacaagaagagggaactagataccattacagatggttgtaatccaccatgtgtttactgggatttgaattcaggaactctagaagagcagtaagtgctccttttgtattgattattttacttatttacatttcaaatgttgtcccccttccaggtttcccctaagcaaatcccccctatcacatcaaccctccacctccacctcactgccctagaatcccccctactctggagcattgagccttcacaggaccatggcccttccctcccattggtgccagataagaccattctctgatacatatacagctggacccatggatccctccatgtgtattttttggttggtggttttgtccctgggagctctggaaggtcctgttagttgatattcttgttcttcctatggggttgcaaatcccttcagctccttaggtcctccccctaactcttccattggggtccctgtgctcagactgatggttggttgcgaacctccacatctgtattggtcaggttctggcagagcctctcaggggatagctataacaggcaatggatagacaaggctccaggctgagggatggggccacctatccatctcataatttttaacccagaatggttccattcttaaggaaatgcagggataaagagtggagcagagacagaagtaaaggtcatccaatgatcaccccacctaggaatccattccatctgcagacacaaaaccagacactatttctgataccaagaagtggttgctgactgtaattgctcttaattaactactgagccatctcttcagccccataataaaggtttgttaaaaagaaattttgatctgacagaattcttgactgccaattttcctttttttcaaatgaaattcctaagtgttatgagtctatatcaaaatttgagagttgcaaggccactgattctatgatggagatatatcaaacatttttaatagggtttgcaggatttatcaaaagtaatgaggcctttaaggtgggatagtgggtgagagagatgtaagtgggagaaattaagagagctagtttcaaacatcccagggctcttccccacagtgagtcagatttggaaaatcaaaatgagtctcttaatatgtctaagagtttagtactaaagaacacttaattatgaatacttcaacaggtatatcatgtttaataaggaatgcatttt

SEQ ID NO: 1820 - DNA, 1400 bp, mus musculus
gttccctagaacgaacttcattccttccatgtacccttcttattagagatattcctttggagttatggcttcataatccaaatacataatgaagattatgatatttaaggaactgtggtcgcaagattttattcaggtagactttaatgaaattgttatgataaactttcttgggtgatgacatgtccctacaggacacagattacgagttataaaaacaattgaaagatggtttttgccaaattgatcctcatgtcaagtgatttaccaacaaaaaaaaaaaaaaaaaaaaacaaggcagacaagtagaatgatgaagtacaacataataaaaatattaatggcccgcaagttggctagggtggaaagggggctatatttcgaattcaggacctaagtttgatccacagaatcacaagcttggaaaagctaagaacattatgtaaaattgtcctctgacctccatttattggcagtgaaatttgtacctgttgtggatgggcctggtgctatttgtacgttgtgcttattctgctctcctgggaggggttgaagacaaggagtgagtcatactcaggtgactttttgtgagccaatcccctaaagaataaagcagccaatcactggggaagtaggcgggacttcagggttggagaggagaagaaaagaatcaggacagagttattggtccttttggagagagagagcttgaggacaagatgtaaccactagtgtctactggcttaaggtgaatcctggcagatttgccacctgagaaatcagatttagtaaggcttacaagactggaatttagttgttgcatgcagcagttgagatcaccagctcgtctgctctgatactgagattatgagatgctcacaaaaagggcctatcatgacttccctccaaaagacccaaccagcagctgaaagagttaggtccattatatttacatccaaccaatggacagaagttgatgaccactgtggttgaattagggaaaagctagaagaagctgaggaggaggtcaaccctgtagggggaccagcagtatcaactctcctggatctcaggttgctttcttataaagcctaagactaccaggccagtgatgacacacccacaataggccaagcccttcctccttgatcactaattgagaaaacaccttatagctggatctcatggaagcatttcttcaagggaggctcctttctctgtgataactctagctgtgtcaagttgacacacaaaaccagtcagtacatggtccaagacctaatagtggaagtagaaacaataaagaaaacacaattggaggcaacccttagaatggaaaacttgggagagcctcaggaattacagatgtaagcaacaccaacagaatacaaagagaagtg

SEQ ID NO: 1821 - DNA, 1000 bp, mus musculus
atctaaattgtacagtctatgggatatttggaattctgattcttttttattattattattattattattattgggtatttattccatttacatttccaatgctatcccaaaagtcccccacacgctcccccacccacacacttccacctcttggccctggtgttcccctgtactgaggcatataaagtctgcatgaccaatgggaatactgattcttcatattataaaaatatattggttttactacttttttttgcaaatctgtttgtttgtttgcatgcataaagatacatgttgtccattcatacaaagaggttaacaaaaattgccaagtgttccattttattattctctgtattattcacataaaataggatttctgactgactcagtagctaggcagtagtggcaaaccagaaagccccataaccctccaggctctacttgctcccaatgaagctggggttagacgtaaacataattacatgcagatttctaggtgagtgcttgagatttgaacataagtactcagagtatttcatgaatccctgttatacatggagccagctgcctacccatgcacaagaattttattcttaaaatctttaaataatacttagaaaatccgagctgtaaaataatttatatcagtttttatagaataaagaatatgctattatttctacatacatatgtacgatatgtatatatcatataagtaatatatatatactattttcttttcactattcttttcactatttttgtacttgaaccctgaacttttcactggtttagaaagttggcacacatttcatgatctatatatttaacacattatgttttgccttttcctttatactagatcattttcacacacttagaattttctccataatatatcagtctttggtgtggcacaccgtctttttacatcactttgattttggaaggtgcttctgctggttacagtgaactccactgacagtcattgttctat

SEQ ID NO: 1822 - DNA, 1600 bp, mus musculus
aagagttcttgtttatagtgcaccatctaggttcagtgagaccttgtctcaaacagtacagtgaagaaccatagaagatagtggatattgacctctgacccctaaatgcagagatatgtgaatacaggtatgcacatacattcatgaaaattatgcatacacttatgttcaaaaaacactccaaataaacaattattatagataaaaataatttaagattataataatctattttcagactttattgttctaataaaaatgcagagtataaagcttactgccttaatcctttaaaagtgtatcgctcagcaaggtttcaggaatcatgcagttggcctggacttgataccttacggggcacatgtcatatgtttttctggttataatctatggctcctccagttcctaaaaacaccaatgcattcccttaggcagtgaatcttcaggctgcttcgtgtttctctttgtgttttcttagtagtcacagaatgcactagctcagaaacattatgctcattaaacaatatttctatttttcttctccctctgaaactttaagaaataattttctttgttaattaaaaaaataaacttaaagtataacaaataaacgtcatctcttctctcattagtttcttttttaaaattttagtagatattttctttatttacatttcaaattttatcccctttcctcatctctcctccgaaaacccccctatcccacccctcctccctgcttactcacccattcactcctgcttccctatcctggcattccactacactggggcatcgagccttcacaaaaccaaggaactctcctctcattgatgtcctacaaggccatcctctgctacatatgtggctggagccatgggtccctccatgtgtactctttgtttagtggtttaacccttggagatctgggggtactggttagttcatattgttgttcccctgatggggctgcagaaggggtttcttcagctccttgtttttatttttctctagctcctccattggcaaccctgtgctcagtccaatggatggctgtgagcatcgacttgtgtaattgtcaggccctggcagagcccctaggagacagctaacaggctcctgtcagcaaggtcttgttggcatccacaacagtgtcattactttcctccagacaaccttcccatgtgtcactgtccctcaaatctatgccaaattgatgggctaatttgttatcattgttgttatctatatttatagcaaaagtatatgaatattagcagatcactccatttcaaatagcttagctatagttgatttcacgactaactactttacaatgcataatcaattaggggttcatcttcccactttgcaatgaataatcaattagggggctcatcttcaggagaagctagttccccttctttcagtagtcagttgcttcttatagttctcagcctaggattaggacccactgagattccccatatcatgttagtatgcttattgatattgtaattgttttggtcttgtgaagaggagcaatatcactgaggtattatgcttgaatcgttcatactagttcaaatatatatattct

SEQ ID NO: 1823 - DNA, 1000 bp, mus musculus
agattttgtctggcttgagctttccctggcagtatgcatgatgtttcaaacacagtgagttgatttctgcagcatccctgttgtttccagaaacagtttccttccattgatcctctcccactgacccttactcttcccaatccctctcccatgctgatccttgaactgtggaaggaagtggtatagtataggtatatagatttaagtatgacatcatttctcattctctccacctcgatgggtctccgagttaatagccatctacttcaaaggaagcttcttctgataataggcgtgactttaaaaacatgaaaagattgtaccacaaaaaaaaaaaaaaagaaagtcaagcagatgatagattcacgaagagccctgaaccgaaatgatccttagtttcatttatccaaagtgattccggtaggattgccagactgtaacaggtggctacttttaagtacagatgctaaatgtcatacctgcagatggttcatcagtagaacatgtaaaaaacatcttaattatatattatgaagccttttcataaaaaattaaaagatagcattcattatgcttgttggagctagattgccgagtgcagatgctcgtgtcagttagctggtgcttaaatcaaaacaagtatcagtggatccatttaatgataagagaagttctggctgcaggttggaaagtttcttgtgatgtaaatttcttgcactttcctgatttatgcatcaaaagcagtaggctctcctctgctagcctctcacaggtgcctgagtacagaaaaagactcagctggttatcctcagcagcatccctgtttgcagtgctcctgcagggagaccacaccatcacacctgaaaactaaagctggatgtttaattctacacatggactctagggtcattcagccctacatgaaagagcagagttgattcatgcgtacatccatattatactcaaatttcattttgttttagcatgattggcctgtttc

SEQ ID NO: 1824 - DNA, 1000 bp, mus musculus
tgccatatccgacactcttaaatagatttttcttgcctacagaataaagtctatccctgcagcactgagcaaggaataaatgatgtctcacatgcttaactcttaaagctgccttttctgatagaacttgagtggtgatgtactaagtttctagatacttaaactgaccatttttctttggcatgctatcactgttgcattttctggttcatctgccctccaatcatgacctacctggagaccgacatcatgaccgatgctgtattctgagcatcccttgccaggtcagtactctgttccctccctcctaccatgttttcaaagctgcttcaccaatgatctgttggcttttcagtagtctccacttgctgcaaattttcttgaacaatctttgggccccctatatttcttgcctaattcctacttacttttctagacttcttttgtaggaaatgcttactgcccttttgtgttcctttcctcctgccttgcttagaacaactacgctttagctgcttatctccttgcccaacataggctacacctcctgctttccctgtaagtattgtcttcgggatgaaccgatacctcgtgcacacctttttttgaaaccataagttgatagataagtgaaagagtgaagcaacctaaatcacggactcacaatttccaatagaatatcaacatttccaaggaaatgtgtctttaaatagtaagttaatgtaaataattatatttaattgcatcctatcacatgtaatatcaaagttcctgtttgtatgcattccgttggtcacagcctaagaaacaaaccactgtcaggctgaaagcttggaagaaacaggggaaagcaatgtgctttggaggagtcacgcacattctcctgtcagcattaatttcgtcccctggctctggagaaattgagtgctgaaaggttaagtaaaagatcagctcagatgggagaatgggagcagagcatttggagctatctgcaacaaac

SEQ ID NO: 1825 - DNA, 1600 bp, mus musculus
agtaaatagagctttaagcatttgtacaaatattccatttccataatgaatgaaacactgaacactctgtaaattaaacattagagcttatagaatattttaatgagcatgaaaaatattgtcaacatataaattccaattaaacacatattttagcaacagagttagaaaaggtattgttagaaaagacactgctcttttcctttttattcaacttagattcttttctcatacaatataatcttaatacagcttcctctccctctattcctcccagttcttccatatcttctctcctccagatctactcactttttatctctcattagaaatcatcaggcttctaggagataataacaaacaacaaaataaaatgtaataagataaaacaaaagccatcatatcataatttggataagacaagtcaagagaaaaataaaatagctccaagagaaggcagaaaaatcagagattgacttgttcacagactaagaggtccaataaaagtccaaaagttaaaagctatattatacatttgggagaactgttgcagactcatgtaaacccgggggttactgattcagtttctgagtccctgtgaggtcttttagagatagttgatcttctggtggggcccctccccactatcgaccaccccctccagtccttctgcctcctctgttatggggttggttccctgaactctggctcagaatttcatatcaaattccagagtgattgttatagagaatctagtttagatctgtgtgttcgaaaggatcccccctctctctccctacctcctattcttcccaatcaaccccctttttgtttgcctcttctccatggagacttcttaaccaatgaccagtgttgaaatccaatacttcaaaagtcacaggtcagatgccatgtgttctatagtgcttgttgctctttatgcttcccaccctgtaaacttttgtgaacctatgaaataccacttggatgcagaagggagaactacacttaattctattcagcagtcttcaaaactacaaaatctgaatgtaaggtgaaaacagaaaatggtgtatgtatcttttgctctctgatctcaacactatgtattcaagtcagtaataaatgtgaatatgccatcaacttcctcttgaatctctctgtgtaatcttacccttttgtgtttctctgatgagagattactgcacgatgaactttccccaatgttagtgatttgaaacaataagttattattctttctcatggacctgcaaggtgactgtgtttaactttgtagtcttgtcttagtcagggtttctattcctgcacaaacatcatgaccaagaagcacgttggggaggaaagggtttattcagcttacacttccatactgctgttcatcaccaaggaagtcaggactggaactcaagcaggtcagaaagcaggagctgatgcagaggccatggagggatgttctgtactggctttcctcccctggcttgctcagcctgctttcttatagaaccaagactaccagccctgagatggtcccacccacaagggcctttcccccttgatcactaattgagaaaatgcctta

SEQ ID NO: 1826 - DNA, 1200 bp, mus musculus
aggcttgaatttcacttagaaggcggaataaagtagtcatagttggcagagggaggaagaaaattgggtggaagagtgggtggggagtagaaaggaggttgatcaggagcagaaaggggtttggtcagtatcaggtgtgaagagagacaaaagagaggactagagggccagagggccaggagaatgaatggaaatcttcagctccctcaggtatggccagtgagggaatgtttataaagtcccagagatctgagatgggagaggctgccaggagtcaatgcaggtgatcttagccgagatgcctagtagtagggttagggaacctgaagaagccatgtcctgtagccaggcaggaccctcgatagaagcaaaaggataccaaaccacccacaaaactttgagcccaaaatttatcctatcaaaaaaaaaaaaaaaaaaaaaaagtgcaggaacaaagttgggacagaaaccaaaggaatgtctaaccaataaccatgtcgattgagacccattctatgggcaagcaccagtctctggcactgttaatgatactctgatatgtttgcagacaggagcctagcataacggtcctctgagaggcactacctggcagcttcatgaaacagatacagagactcacagccaaacattgaatggaattctgcggaatagttaggggaaggattaaaggccctaaagaggataggaactccacaggaagacgaacggagccaaccaatccttgggagctctcagagactgagctactaaccaaatagcatacacaggctggacctatgcccctatacattgtgaatgtctccatgtggggcccccaacaactggagcagcggttgaccctaaagctgttgcctctctgttgaatcagttttccaacagggctgccttgtcctgcaccagtggaagaggatgggcctaaccctacagagacttaatgttctaggttgaggggatactggtgggcaggcactctgtcaaaggagaaggggtgggggtaggggaaagaactctggcatgggggggggtaccaagaagggactgctgtgattgggatgtaaataaataaataaatagaataaacaaaacccaaaaacaaacagaaacctaaactcaataactgcagaaatgactcttgctcttttctggtaaggttagaagcaggttacaaatctatattag

SEQ ID NO: 1827 - DNA, 1000 bp, mus musculus
agagcttgtgagggaggttgattgaatctttctcagaagagggaaaaaaaaaaaacagaaatcagaagtcaatggaagaagggacctgggtggaagaggggatgggaagtggaacagggtggagggtatggtatgtagggagagcatgagagatagaagggagatgggtttggggcaggggcaatgtcgagcataaataagaaacctgggatggggagaggctattctaactgaggttcctagcattgagatatggatcctgaagtggctgcttcccgtagccagataggactcccagtggaaggataaggacaacaatccactcacaaagctttcaacccaaaatgtgtcctgcttacaagatgcacagggacaaaaatagagcagagtctgaaggaatagcctaccaatgtctgccccacgtgagacccaacctatggctaagaaccagtctccaaacactattaatgctattgtgttatgtttacaaacagaaaactagcataactgttctctgagaggctccacccaaaagccaatggaaagagatgcagagactcacatccaaatagtagctagacctcagggagttttacaaaagagtttgaggaaagactgaggaacttgaagacgacagaaacaccacagaaagaccaacaaagccaacaaacctggaacctcaggtgctcccagagactaaatcaccagtcaaaaagtgaagccaggctgcacctaggccccccggccatatgcagcagatgagcatcttagtcttcgtgtgggtcccccaaataaatggagcaggggccatagctaatcctgttgcctatctgcctgcctgtggatctggcacctctaaatggacagcattttctggcctcagtgagagagtatgtgcttagtccagcagaaacttgatgtgtggcgtagagggtagagggatggggaggggggttaatgagggcggggaggtaaggatgtgggggtaggggaggaatgg

SEQ ID NO: 1828 - DNA, 1000 bp, mus musculus
ttttgttttgttttgttttgttttgttttgttttgttttgctttgctttgctttgctttgtttttttcaagacagggtttctctgtgtagccctggctgtcctggaactcactctgtagaccaggctggcctcgaactcagaaatccgtctgcctctgcctccgaagtgctgagattaaaggagtgcaccaccatgcccagcgagaactgtgccattttttggttgggtgtgtgtatgtgtgtgtgcatagtggttgtatttttctcttttcatgatatctcattttgatacaaaaccacatatgacattgatatatgaactaaaactttctcttctttccaattttttttacatgaggcaagtgcatagctcaggggaatggtgattataggcttctatgtttgaagccagaacactttaggagcatccttcgaggaaacagttaaacttgatttcttttctgaacgattgtaattaacaacttctggtcttgcagctttaatatattttcctaaatgttttcctttatgtattatataattatctagctccatgaaaatcagttaatgtataatttttattctgatcttagatttgtgaggctgatgataacatcctttccttcattttcgttttgcgtgatttcagaattgtatcttttatcctggtcatgctaagctcaacgtgtctacattcctactgttctccaagcattcccctctgttgtttttatcgtatttgtgtaaggatgagatgacgacctgtctttctggagctcttcttctttcactgcatggatcatagcagtggcactcagctttttagactgcatgtgtgagcactgactcactgagtcactgctcctgctgtcacacctgaattttcttggtcaatttttattttctgttcgcagtgcttattctgctgtactccttattagctcatttctttgccctacctcttcttaaagcatttaattactctgtgtagtaatgtagg

SEQ ID NO: 1829 - DNA, 1000 bp, mus musculus
gttaaacatgcacggtaacaaatttgaagtagggcatttgctgtcatgagttcttaccattagtactttacctttgcactcactgggggagtttccccttacatcagctacttttccaatcagtcatcattagatatagaatgtgtagcaagaacggtggctccacctctgaataaacaccggagcgggagggggaggggcatgcatccacaaaagcatctcctattggaggacctaactgaggactgactgagagaacaaggattgctgaggcagacaaggccagccaatctggaactgctgttaagaagggatgttttctcagtaccaatggctcataggtggaaggtattaaaggagcctgatatagctggctcctgggaggctctgccagtgtctgaaaaatacagaagtggatgctcacagccatccattggactgagcacagggtccacaatgaaggagctagagaaagtacccaagggactgaagtggtttgcagccccatatgaggaacaacaatatgaactaatcagtacccccagagctcccagagactaaaccaccaaccaaagaatacacatggtgggactcatgactccatctgcatatgcagcaaagaatgacctagtcggtcatcaatgggaggagaggccttggtcatatgaaggctctatgccccagtataggagaatgccagggccaggaaatgggattgggtgggttggtgagcaagggtaaaggggaggagagagggggttttcggagggtaaaccaggaaaggagatatcatttgaaaatatctgttttgctttgttttttgtttttcaggacagggtttctctgtatagccctagttcttggaactcactctgtagaccaggctggcctcaaactcagaaatctgcctgcccagaaaatttctaataaaatataaaaatagagcttgcagcattgttcagatgagcttgtgcagtgtttctcacctgcttccggagtc

SEQ ID NO: 1830 - DNA, 1200 bp, mus musculus
gacttcattctctaaaatacttacaatagcaaacccaattcaaattctgtataaacagcagccatactaaaaattcaatagtacactagcaggaaagaaaactatgttgcataaaatacaagtgcaatttaattctatactatttttgaggatcagtttattgaagataaggatagagaaggctgatttcactgcatgtcttcatttgttatgtttgcacaaattattaatttggattgcattttcattggagatatgagcctgacctcaccttttgtgacatggctttctaagcatacagggccatatacacagaaggtcaacaagcttctgagtggtttcaaattcattatcatatgatacgtttccatttctatgtcttctttttcatatatatatatatgtgtgtgtgtgtgtgtgtgtgtgtgtgtgaatattttctttatttacatttcaaatgttatcccctttcccagttttcacccccctcccagaaacttgctattccattcccactcctcttgcttctatgagggtgtttctccacccacccacccatccacccattcctgtcttcctaccctcgattcctctacactgggcatctatctagtcttcctgggaccaaggacctcttctctcattgatgcctgacaagaccatcctctgctacatatgcagctggagccatgtgtactccttgggtggtagcttagtccctgggagctctaggaggtctggtgggttgatattgttgttcttcctatagggttgcaaaccccttgagctccttcagtcctttctctaactcttcaattgagtaccccacactcagctgaatggttggctgttagcctctgcatttgtaaggctttggcagggcctctcaggagacagctgtatcaggctcattttaacaagcatttcatggcatccacaatagagttggtttgctaactctgtatgggatgaatcctccggtggtacaatctctggatggcctttccttcagtctctgctctacactttgttttcatatttgtcccatgtgtattttgttccccttctaagaaggaccgaagcacccacacttcgatcttccttcttcttgagtttcatgtggtctatatcttgggaattccaagcttttgagctaatatccacttagcagtgagtgcatactatgtgtgttatttttgt

SEQ ID NO: 1831 - DNA, 1000 bp, mus musculus
aaagcgatgctacctctagtttagcaatttatctcaggcactttctcttctcatttaatcaaaaggaatataatgcaaatcagtaggcaatgataatggtgatattcagtaccagaggttcacaggcctgtgcacatgtgatcagtaacataatgacagagctttcaggatttgggccccagcttacaaacacagaaagaactgaggtccagagatgtgcagtaaataccatgtgtccagtcagtcctggcaggggtgggtctgaagcctccagaggtatctccaaaatgtgtctcactggccatactcttcatctgactcctctctgtataggccacccaccttacaaataccagtgacggcagctaggtgacatcccagctagcagatcttagaatggaggatgagagcatgtatagggggaactttcatcctaacagccattcatcttgtcagtttaccaagcctttctgctttctatcagtaaaggcctctgaggaatgggtggtggaacgactttcctccctgagcccaggcaatatagcaaatgcgtgaatctcactgttacccatgaggacacatatcagagtctgggatggatgacataaccatcagacctgggccaccagagctgatacctgctgtcatttgggcagaatgggcaagacctgcctggaggccacctgccaggcgctgcctgctattgattatctccatcgtgatctcccctgctggggggaggagcaaggaaggctgcagggaagccaggaaggatggcagaaccccctcctactcacagcaggcacgcagtccctgccaaccagaaatgccaatgctctcagcatccacggttgcaattcttttgttgctggtttcttttctggcactcccttcactctgttcctgatcaaggcagttttgggaggcgatgcctttaagtatttacctcttgttacaggcataggctggacacctggggtcaccacacagcaagggctcc

SEQ ID NO: 1832 - DNA, 1200 bp, mus musculus
tttttttttttttttttggttgttgttgttgttgttttttcgagtcagggtttctctgtatagccctggctgtcctggaactcactttgtagaccagactggcctcaaactcagaaatcctcctgcctctgcctcccgagtgctgggattaaaggcgtgctccaccatggctaaccctgaacttttaaaatttgttgtcaagcactgggggttgaatgcagcactttatctgaagccccatgactgctcctccatgacttagggtactttaaccaagcccaggtcccaaccagagcctcagtgtccttagctatcatgatgccatgattctcctgtggctgtagcaggtaacgtgtgacattaacgtgggttgaggggccttgggaggcttcccagagatcagagggaggtgctggcaggagggaatgtgcacagtggactgcagagcccccaagtatcctccctgcggcccatattagcacagatgcaaagacaaaactagccactagggggcagcgtgggcctgcagcaagccgaggaaaggcgcccagttgtgtgataggcttttccaggctttttcttatctgcagagttgaggcttccctgtgagtacagagcatggctcatgggctcccagcacaacagcagggtcagataggaacaactgacacctgctgtggccaggaccacagaacatctgggtctataccctgacctatttactcacttgctgactttggaccaggggtactcagtgttgtcttatccctacagcccagatgttgtgtgtgtgtgtgcacacatgtgttcgctgtggccagaggtcacaagcagaggtcagctacataggcaggaggtcagcatcaggtggccttcccattcatttctctacgtttgaggattcattcttagtttatgtggatgagtgttttgcctgcatgtatgtttgtgtgcgtggtgtactcaggggcaagaagacggagtcagagtccccccaggaatagagttacagaacccaactagtcagtttactccagttttgcagcaccaagtgctgttaactgctgaaccagccttggcctcaattttgattaagtcttggtttggggtcttcctttattgctggactggactcctgagctcaagctgccacctggcctcaccctggcagctgggctgaggtgtgctgcacaacaaact

SEQ ID NO: 1833 - DNA, 1000 bp, mus musculus
gccacctggataggccaacctagctctctcccttgggctctttgtctgggactatgggtcttgggagatggagttcaaggttaaaagccagctttccaggacatgctgatgctcagagcccttgagtacaggaggtggtggggattaaaagtctgggctgggagagcctgccctgtgttcctactgcatctcagtccccatgggcaaccttgcctctggccacaaggaggccgcttcaagattagccatcaggtggggttccaaggtcataccaggttttgagggctctgattccttcccctgggcacccattgataccaagtgcactcaggtggggttgtacagctgaggataaccaccatagacagtgtcaggtgctgtaagccctgcgtgcccagctgcgtggctgggctaagggaaagggccagaactggacctcaaatcgggtctgggaaaataggctcacactgaaggctgcgctcctgtcactccagctccagtttgcatcctttccctcccatccagctcctctcactcggtccctggtcattgccctgcctgccactctcctccttcaaaccagctggccgccacctcacttccactcacctctccctcggaaaggcccaccctgagaacagcagctgaggagcgagcggcacctgcctccagatctaccttttcacagtagagagtacacagtagatgcctaatcatttcccacctatccttctggaccttcagccccacaaggacggcttcatcctaggcttcctggtgtacacagcaggcacacacaggatgtgctaactggacacacaaaggcatggccaggccacagtcatgcaaaccttcagtgacaagcatgtgcacaaacacacatccagcatcatgctagcacatgcatttgtgagtggaggcatgcttgccccccacctccagtagagcccagtgggagtgttatcacccatggccctccatctaggcagctgggctccac

SEQ ID NO: 1834 - DNA, 1000 bp, mus musculus
acacatacacactcactcacacacacacacaaggccagcctggtctacataatgagttccaggagagtcaggagtctctacataataggaagaccttgtctcaaaacaaacaaacaaagtgtgggagcatgtgtcttactataatcatgatactacaggagggaagacagcagacaggaatgtctctggggagccaggccaaggcctgtgccatgcgggatttcaggatggtaccaccatccttttcactgcttctctgccctgccacccttggcccctctggacaggatggactgaacttacagacaatgcacacagacaatgcttagacaagtcatcagcttgtcccaggtgcccctggagctctagctacttactccataatcaggaccgcccagctccttgatgcggacctcccagtgtcctttctccctcagcagcttgttaatttcgtcattcaggtcccgaattcggaattcccctaagccagctagaaaacaaaaaatgttaatatcatttcttcaagatgccatgcccaataatgaatgtcagtacttccaatcatgtactcagtgttacagctttagaaagaaaggcttcaaccccaaaggtacactgcataaaactactcattgaagttcagaagaaaaggcctggtgtggtggtgcatgcctttaacaccagcacccaggaggcagaagcaggcaaacctcagtgagtgagtactagcctagccagggatacacagtgagactccatctcaaaagtaaataaataataaattgattaaggaaagtcactaacacccaaataaaggaagaccaagtactataaacaaagattcccaataatgtggggttaaaagtctttttaaaaacttcatcctcagccgggcatggtggcgcacgcctttaatcccagcactcgggaggcagaggtaggtgggtttctgagtttgaggccagcctggtctacaaagtgagttccaggacagccaggg

SEQ ID NO: 1835 - DNA, 1000 bp, mus musculus
agcctggggacctgcaagttgtcctctgccctccacatataccaccttttcttgcttattcgttgaagaagaatctccctaaaccttgggctagcattttcttggccaggctggaaagcaggaagccccagtgtttctctcccttctgcctcctttggagctgggatcgcctacctgacctagatgtctggcttgacatgtgggtattgggagttaaacccacatcctgtgaaagagcagccagtgctcttaactctctattcagcctctattgtgtgcaattttatatagctaagtgcagggtaatttttacttaatatgtcatgaataatatctaacttcatttggtatgttccaaggacagagcagttgttgatttcaaatgctgctgaaaggtagagcaagagaagggacacgatacaaaaaccttacaggattcaaaacaggatccaaaaaaaaaaaaaaaaaaaacccaggatccagctgtttcgatattagtctttactcttttaagaagtagggctcaccgtgtggacccccaaagttgggagtctgtagacatcaggttgcttgtgatagtaaaagcagcagatgaggtagggatcagcttccccactataagcagcgggtctcagctgaggtaggggtaacttgctctgtcttggaatctggaaactgaccactctgaccagggagaggccgcacaccaggtttatacagactttcataggtgagccctgattggctgtctgcagttaagtaaagatgtgaagaataaagaccaatcaataaagagcctggcaaaactagggtggtggggagagagggtccccctgtatgaatgagcaaagccatgtcaaggacactagtgcctcagcctcagggggatggcaagggacgttgatgaatggctggcttttcatgaaaaccggtatgtgcaggaagtaccatctcagcatcctcatcccatgcctgcagcttggggatgctccctacagag

SEQ ID NO: 1836 - DNA, 1000 bp, mus musculus
agacctctcctctcaggagctatagctagggcgcgcctttcactggttgctgtatgccctgtaaacatctgcaagaacaggtttctgtgaagatctgttggaagaatgaacaaaggagtccttgcatggacgctgctagtgcaggctggctgaatgggagtgttatgtcacattcacagctgagatgacaatagggttccgcctattttgggcctggaggacacagttgaagtacagaatctgctggagaaatgacttgtcggttgaagcagtgccacttacattgtgtacctcgggcttgctctgtgtcctgaagcccaccatgtccccacagtggcaggtatctgctgagtgagctgcaggaaggaagggggaaggagaggagttgagagcagaggtctagaaatgtggaacaggaagtctctcccaaagtctaactgtgtctccgcttctctagctggaggatctggaagttactgtggctgatcacatccaaaaagtcatgaaagtgaactttgaggcagcctgggatgaggttggggatgaatttgagaaggaggaaacgttcaccctgtctactatcaagacactcgaaggtaaagtgctgctgacgtcatctctgacgatactgtggctggccagtgtgccttcccgcttcccaccaagaatccagagccttaagggatacctagcttgggactgactggggggaggtgggtgggggtgggaagtgcatacttaatgtgttaggcccaggatttcactagcacccaacaaaagcacacaaatactcatatgcctgtggcttaatgttgctgggattttccctacagaggctgtgggcaatattgtgaagttcctgggaatgcatccttgtgagaggtcagacaaagtgccagaaaacaagaacacccacacgctgctgctagctggtaagaaacgtctgtggcctgagtagcttcacggtgggagtgccactgggttttgtctgccgccatcc

SEQ ID NO: 1837 - DNA, 1600 bp, mus musculus
cggttctgtagctgtggtggaagtgtgcctggcggccccagccctgcccacgcgcctttaccgcactaccccctgtgcccaccaccggagcgccagatgcatggagggaggggggaattcgagagtggtcgagccatgggagtgtcggcccgcccacgcatgcggtacgggggggggggggggcgcggcgggagagcgcggtgacctgggccctggtatttggtgagggaacactaggagtgggatgggttggcgcgcatgccgagatgcgccgccccgcccccccctctccgagccaccattcccacagggccttcccagcagtcccggagccagtcatggagcaccgccatggtggaagtgcgcttggcgcaccataccgccccctgagccctctgccagaaggagggaaggagggggaatgatgcgcgggtggaggagttttcgctgcgggcaccttttttatttactttcctggtgctccttacctttggacagaagccttaaatgaatggatgcttagcatctcagggtggggccttctgaaaaaagaaaactcttaaaatgaaagcagttagtaacagactggatgcaagggaagtgcaggcaagcatctgtgcgcctcagaggccgcctgcacttgccaccccgcactcgccataagcataataaaggatgtttgaagctttcactgctctctctccccacattacagctatttcttcttttgtccccaccacccttggcacttctcccccacatccgcagaagcggcgccgctactcttgtctctttctccttgttctattcctctcccaggggcatctctgtcccctatctaagtgctcccttttttgagctccttaccccactctgtttctggcatgtgttgtacatgtgtctcagagttttctttccgccatggttctggatcatctccgctggagcagagggccttctctttggcgctagccgatggtgaggcagtgccgggattcagcgccatttgtcctgagcttttgtccttgcccgcaggaacgcacacaggacacaagatccttccatagctactttattacatcttgacgagaaaaggcaaaaaggctcagaaacgtgttgcttaaataccctctggtatgtcgtgtctatatacgactggctgctttactcacaatctcatagctccggggatgggccagtgactttggcgggcttttgctcttagtacatgtgcacatagcttgctctttgtttaggtggcataaggcactgcggagccagcgccatcttatgatggtaaatgttattgcggctctccacaaggggattatttgattttctggagtccaccctcttgagttctttatatatattggatattagtcccctatctgatttaaaataggtaaagatcctttcccaatctgttggtggcctttttgtcttattgacggtgtcttttgccttgcagaagctttgcagtttcatgaggtcccatttgtcaatccttgatcttacagcacaagccattgctgttctattcaggaatatttcccctgtgcccatatcttcgaggcttttccccactttctcctctata

SEQ ID NO: 1838 - DNA, 1200 bp, mus musculus
gaggtgttttatatgcagttcaaactccaagtgaaaattaagaaaaaaatagaatattacctagcatgaaagcaactaatcttaaacaaagtgtgggctattcttttgtattgtaaaacaatcaatccaatataaacatacccagtgttgtatttttccatcaatacttagtatcatatgcacttaatatgtcagaagaacaactttgtgaaatgttatgaactaataccacctacatcctatcacctagtgtagcctcccccagccttgagcagtctggctcacagctgttctgccactgtcagctagcccacctagggtggagttttcagacctagataggtctattgttctgccacttctgcagttttctccaagatgctgctacccactctgagtctgaacctgtcttcctgaggcaatcctgaataagcaagagcctggcaatgagggcctggcatggtgagggatgagcctacccttttataggctcagactcttaagtaaacttaggaccttgatcagcatctttgtcttggtctcaatatttctcttgccatctcttttcatacgtccccagcttccctttcaggaacaagctacaacctagaaatgtttttattaggtcaatatggtcatttaacttgtacagttgtcatttcttactcatttttaaaattgttattgatgctttgtgaatttctcaccatgttcccttgtatatttcctttatccttgcaacctcccccaccccaaaaaataaataagaaaaatagagttggatgatcacagcctaccatcagactgagtgcagggtccccaatgtaggaactagagaaaggtcccaaggagctgaaggggtttgcagcctcattaggggagcaacaatatgaactaaccagtacccgcagagctcccaaggactaaaccaccaaccaaagagcacacatggtaaaactcatggctccagcttcatatgcagcagaatatggcctagggagtcatcaatgggaggagagtcccttgatcttttgaaggctctatgccccagtgtaggtgaaagcctgagcaaggaagcaggattgggttgattggtaagcagggggagagggggagggatagaggggttggggggggaaccaggaaagaggataacatttgaaatgtaaataaaatatgtaataaaaaataaataaatag

SEQ ID NO: 1839 - DNA, 1000 bp, mus musculus
tcccccaagagccatcctccaagcaatacgcagccttaccggagacttcttgatgtccgaaacagcgtaattcccttgtgacgtccatctggcagactccgttaaagacagcccagtcccataaaggttgatgctaaagcgcccctggaacacaaagccaacacaaaagactttcagcccatgtgacataccaaccaaggcagagctgacacacattcaaaggcactttggtaagcagaaaggtgttaattaattttgatggccgctaatcgttgaaggtattttgttgttccgttgtcagagctaggcgccttacattcatgatttctaggtagggattttgtttacaggcggtgaaacccaggatcacagccgatcgactccctcctgaacacagaaagccctcaggtcatctttactgacttctaaatcctctctcagagcttcctccagccggcctccgtagcacggtaaccctgattgttgctcacaattatcagattccttcaggaccaaaatgccgcagtgtaatttttctaacaagatctagctgccaaagttcccccctcccccccccccccccccccgcttccagttccctggggcgaagagcaagcacactttgtaccaagcaccgctgggtgtgagttcaaagcagaggcgcgtttccaaaagcagccagaagagggcgcgcatcgcctgctgaagatagagcccactcccagcacatctaaggctgttccccgcccccctccgccccgccagtcttagttcaggaacagaattcccaaaggccacaagggtgtgtggtctgggcctttgataatgatatttatctctaaggagtccctgcagtagagacatcctgaaacggtctctcctctctttcaaaaccagatccaacactggcgggttctgagctgagaacgttctgtgaccctgaacatgcgtgctctcaggattactttctccagaactgagaacccacaactttgacaaa

SEQ ID NO: 1840 - DNA, 1000 bp, mus musculus
tctttctaagccctagctacttcacagagcacagtttcttcaagctttgcccatgttacagcagagattaaggctgaataacatcttatggtatgtgtaaatatgcacaaacctttgggttttagggaaggagtctctgaaatgtggatcagtgttcttgtttgcttcccgctgcagtgacaagaacactggtcaaaaccaatctggaggaggaagtggtttattccatctgacagggaacaaacagtccaccataaagacaagcaagggcaagaactcaaggaggtgcagaggtcaaaccacaaaggagtgctgcagttgtgtcaggaaacatttgtgattcccaaaaagaccaccaaggagccgaatccaatgcaatcacattaggatctctttattcaagttcaagcttggaccatctctgatgcaggagaacgggagggggcatcctgagctcagtgttaggcaagcatttatagaggcaacaagggttatctagcctggtacatatctgatttggggaccattacagcttttaacataattggctggtgctaagagtcaaaccacaaacttaacttctgccttttacatgattgggggttgttaggaggtgaaatgccagggcaggcttgttacctggaggtgcagatttgttggggaataacctggaaactggtgctagacacaggtcttatggggtaggggtagcctggaaactggcgctaggtacctgcctgttagtttacttgagttcaaccttaggtcaggctttctaagatggagtttgaaccccaaagatttgatctctaactgcttactggcttgctcaccttgcttttgtatataacccagggctaccacccgcagtgggctggaccctcccacatcaatcaccactctagaaaaggtcccatagactcacctccaggccaatcaaggaggcatcttctcagcagaggtttcctctttccaaatgaccctgccttgtgccaaggtg

SEQ ID NO: 1841 - DNA, 1400 bp, mus musculus
atattcatgaggaaaactggtctgcaattccttttttggctgaatttttgtgtggtttgagtatcagtctgatgtggcctcataaaatgaatctggcaatgctccctccatttctatttggtggaataatttgagaagcattgatattaactctttttttgaaagcctggtataattctgcactaaaactctctggccctgggcctctttggttgggagaattttagtgactacttctatttctttatgtgttataggtctgtttatccaaacttgatttaatttgataggtaggtggtacctattgagaaaattatccatttcttttagattttccagtttgggaaagtacagatttccaaagtatgcctaatgattctctgggtttccttggtgtctgttgttatgttccccctttcctttctgattttaataacttggatattttctatcttttagttaatttggatagggtttgtccatcttgttttttctcaaagaaccatctctttgtgaaagacctccgtggggatacccccacccgagtcacaagatagcacgcacccaaagaatcacaagggaccatcttgatgcaaacacacgaggtagtttaatgacagaagtccgggcctacatgtatctcacgcaggagacagaggtatcgaccccaaggctcaaaagttaggggcttatataggaaaagagtggggataggggaagaattggcacggcttcacacaattggatagtttaaacatcagcaaactgtatgtgcagagtgaagtaacagcaattctgaggggcaggggcttatgactcagctgagatagtccagacatccctgctgagatagtccgaatgtctttgcaggtcttctcctatctttatggctagccagttcctggaatggcttaacagcaacagcctttgttctttgcccttggcccaaaacgccctcctaagtagcaagccacatgagtcatggaccttgaatttaattttctttcatttgtttcatctattctgtgtattgttctttgtttctcttttattgatttcagctctcagtttgattatttcctgccatctacttcccttgggtatgcttgcttctttttgttctagtgcttatggatgtgctgttaagttggcagtatgagatctttccagttttttatgtaggcatttagtgctatgaacatgtttcttatgaaccgtgttcctatgtatttgggcagattgggtattcattttcattgaattatggaaagtctaattctttcttcatttctgtcttgactcatttttcatttagtagtgagttgttcagtttccatgagtttgtaagctttatgttgtttctattattattggtatccagctttattctgtggtagtct

SEQ ID NO: 1842 - DNA, 1000 bp, mus musculus
cacaatcatgttcctttgttcaaacataaagatccctagaataggccatgtatcaggccacaaaacaagcctcagtaagtggtaaatactctagagcataccacgtatcttctaaaaacactacagaataaaagtagagattaataatcaaggatggggagtggatgaagtacttggtgtacaaatgagaagactttgagttcagattccagagctcatataaaaccaggcacagcatcacacctctgtgatgccaactcctactgcaaggtgggagatggagctgagaaaatcccagaaactctcaggtcatatacagcatgaacacaaaagactctctaccttaagtaaggtggcattgagaaccaacaaccaatgttgtccatatacatgttgtaacaaaagagtgcccacactcacacatacatacaccacacatacacaagagatttttataggccaggatgacatctagcttgctctataactgaagataccatttaaaaggtacttcagacattataaaatacataaagagctaacatgctatagaatgaatagtagatcactgaagaaatgaaaagggatatttaacaatttaatgagaaaatagaaatgcagcataccaaaactatgagatatgacactgttgcagtctaaataacaaatgtctcccagtggtctccggctggtggtgctgtttggaaaggctgtgaaagctttcagatatggagcccaaatagaagtgggtcattgtggatgagtcttgaggctttgatttcatttcattttttaatagacagagtcttatatagtgcatgttgacatctaacttgctctataactgaggatgaccttgaatttttgacactcttacctctacctcctaaatgctagtatgcgccattgttctgcattttataaggccctaaacccagggcttcttgcatgcagtaccaactgagctacactctatgttcaattaattacaaataaaaaa

SEQ ID NO: 1843 - DNA, 1000 bp, mus musculus
tttctgggaaccaatctctaggtttctgaaagaactgtatatgctcttaaccatttgtcgagaccccatattaatctatatattttatttttttcacgattataacaaaattagatgtgggttaacttcataaagataagagatctatttatttcatagttttgaaagtaaggttgaagagtcacatctatttttgcagagcccgaaatgcagtataggaacaaagaacaacaaattctatctgtgggcatgtctgtcttcttttgttcctaaggctaccacaattcaatagtgaaggctgcaccctgataatcttatgtaagcttattgacatctctacacaggacaggcagatgaagcttcaccatcccagtagcattaacctgtaattcttgaaatcctgcatatgctttcaggaaaaaaacaacacttaactgtagcaagagcctcattttaatcactttgtagcaggacattttaagtcaatcaacaccaggacgtaaaccctaagagaaaatagatatatgacctcaccattcacagggagtttggacattgttactagcattttgtaaaatccctttattgttcttgagccctgctaactaaggttgaagttagcaaatccctgagcttgctgcacaagtgattccctttcagcagggtttctccttcttaaaccttgtctgagggatccaaaaccaccataccctctacctgtggaatgtcatgaagcctaggtaagattataggttcagctttctttcatctataagaaagcaagcacctgagattcctggaatgcctccctttgctaatgctactgtggcttcttagtaccttagccttcagtcaatgacctttgcccaccctggatatttatgtggcctttcctgaaactgtataacccttgactcactccaaattaagttgatctgtgtccctgaagctgatcctggaatgttgtccttttcatttatactcatgggtaatcctaaac

SEQ ID NO: 1844 - DNA, 1000 bp, mus musculus
atggatggaactagaaaatatcatcctgaggtaactgggacccaaaagtgtgcactcactaataagctgatattagccaaaaactacagaatacctaggatacaacccaaaaaaactcaaaaaggttaacaagcagaaggagtaaggatgctttaatcccacttgggagggagaagaaaacaatcttgggagagagggacctgagtgggagaggggatggggagaggaagaagggaaaatgattgggggcagagacaggagagaagccctgagggacagcagaatgaatggaaatatgcaacctcagagagtgggagtaggggaaccctctagaaagtatcaaagacctgggaggttaaatccagtgacctgcctaacttggaatccatctcaagggaaggctccaagacctgacactattactgatgctatggtgtacttacagacaggaacctaccatgactgtcttctaagaagcccaagaagcagctgactcagacagaagcagaaatacccgaccactggaccactggactgaagtcaggaacccctgcagttgaattagggaaagctagaagaagcagaggaggaaggcaaccccatagaaagaccaggagtctcaactattctggacccttgagatctctcagacactgagacaccaatcaagcagtatacagagctggtcttaagcccctgacacatatatagcagaaaactacctggtctggcctcagtgggagaagacaaccctaaccctcctcaagagacttgaggccccagggagtggggaggtctgtcagggggggagggccatactcttagagacaggggaagggagagatgggtcaaggaactgtaagagggcagacctagaggggaccaacaactggattgcaaaaaaaagtaaacaaacaagtaacacaacactttgccattgttatcagaccatacaaatgtcaaactcagatggaaatcgaaacacagtatagaagccacc

SEQ ID NO: 1845 - DNA, 1000 bp, mus musculus
tccatgtttaaaaagaaatcggtttataattattttttcattgaggtttttgactaatttattcactttctatcccaatagtagcttcccctccctccagtactcacagtcctttcctctgatctccccttcccctttcttcctagaaatggggaggcctcccatgtacatcaatcagctccagcatatcaagtgacagcaataccaggcatattctcttccactgatgctagaaaattcagcccagttaaggaaagtaaactaaaggcagacaacgtagttagagacaatcccatttcccactttaggaaccccatatgaagacacaggtcaactactgctacatatatataaagggcctagtttcatcttattcatgctccgtggttggaaatgcgtgagaccaaatgggcccacgttagtagactgtaggttttcatatgatgtccttgaaccatatggttccctcaatcctccctctccctcttccccgggattctccaagctccacttattgttttgctgtgcatctctgtatcagttaacatcagttgctaggtgaagcctctctggtaactgttatgctaagctcctgtttgcaagtacaacagaatatcagctatagtgtagtgtcaagggtgggttccctctcatggcatgggtctcatggcatgagtctcaaatgatttgcccttccctcaaattctggtccctctcctaatcctgtactcttataggcagaacaaattgtgggtctaagagtttgtgatgggatttatgttcaaatcttttcattaggaaatcttgactggttacaggacatagcatgttgaaactatatcgctcattgctagaactctcaactaggctcattcttacagctcctggaagtttccattattctagagatggaccaaccccaatctagttgtctctcccagtattctctccctccatactttgttgagtttttatgtgtttttttttttttttaacatgg

SEQ ID NO: 1846 - DNA, 1200 bp, mus musculus
tgggattcagttattcgtgggtgcgagggggaccgcaaacctggaaggagatgggaggaagaaaaagaagagtaggagaccaggaaggatacctatcgaggtctcgtttattatgttgaggtgccttctttttaaagcatacatcttggggaatatgggaggggtcgagggagaattatacaaagaacaaagacatgggcaactgctgacatgggggccgaagtcaggcgccaggcagcgggcactctgcatcttatctctggaacatcgatcctccttgacagccttggggttcaggctgggctcaggcgtaactcatgtccttggatggcatgggaactcaggaagagatagggaagaggggactataattcagcttttacagcctcagttgccaagaaaggaatagggaggaaggggggtgataaccagctcttagtacaaggacatttggcctgttagggagattgtgaagggctcactttctcacgggatggtctctgacagttacagacccctttagctccttgggtactttctctagctcctccattgggggccctgtgatacatccaatagctgactgtgagcatccacttctgtgtttgctaggccccggcatagtctcacaagagacagctatatcagggtcctttcagcaaaatcttgctagtgtatgcaatggtgtcagtgtttggaggctgattatgggatagatccctggatatggcagtcctataggtggaacaacaatataaactaaccagtaccccggagctcttgtctctagctgcatatgtatcaaaagatggcctagtaggccatcactggaaagagaggcccattggtcatgcaaactttatatgccccagtacaggggaacaccagggccaaaaagtgggagtgggtgggtaggggagtggggggagggtttgggggacttttgggataccattggaaatgtaaatgaggaaaatacctaataaaaatatttaaaaagaaaagaaaaaaataccttgtggaaaaaaaacttagagaaacaaaaattacattaacagaagtagagttaatatatttgtatggaagcacaaaagtctccagatagtcaaagctaaacataacagaaaagaaaatttgaagatatcataatgttatcttaaatcatattacatagctacagtaacaaaaataccatggctc

SEQ ID NO: 1847 - DNA, 1800 bp, mus musculus
gagctcttgccctcgctcttgctctcttgcgctctggctcctaaagatgtaagcaatagagctcttgctctcttgcgctctggctcctaaagatgtaagcaataaagcttttgccgcataagattccggtttgttgcgttcttcctggctggtcgcgagaacgcgtgtaagatgtgtgtatgtgtgttgtgtttgatgtgtttgtgtgttttctacacacagacattcacaaagagtagcactttctatatttatctttacttcatgtgctaaagtatagtaatgatcagcctctaaatgctgacaccattgcatacactagcaagtttttgctgaaaggacccagatatagctgtctcttgtgaggctatgctggggcctagcaaacacataagtagatgctcacagtcagctattggatggatcacagggccaccaatggaggagctagagaaagtagccaaggagctaaatggatgtgcaacgctataggtggaacaacattatgaactaaccagtaccccggagctcttgactctatctgcatatgtatcagaagatggcctagtcagccatcattggaaagagaggcccattggacttgcaaactttatatgccccagtacaggggaacgccagggccaagaagtgggagtgggtgggtaggggatttgggggaagggtatgggggacttttgggatagcattggaaatgtaaatgaagaaaatacctaattaaaaaatgaaattaaaaaaaggtatagtaatgatccagaattgtatctctaatcagaaacattttcaagataatgtcaattaaaaaaaaaccaacggatgtgtttttccaacggatgtgtttttcagtgtaactcactcatctaatatgttctacagtgtggttttttatcattttccatgttcctcattgtaactcattgatatacactgttctacaattcccgtttccaacgaatgtgtttttcagtgtaactcactcatctaatatgttctacagtgtggtttttatcattttccatgtttctcattgtaactcattgatatacactgttctacaaatcccgtttctatactttctcttgtttttcatgtatttaccttgcttgaaagattgcttgatatatttcatacactgttaagatcttttgtgtatatttaaaactcatacattttcttggttttatcatttgggcatttggttattaaactttttaaaaataacaaatgtcactaatacttggggtggattttactttatcatctagattttcatggactaaggacgataagccttttgatctttctgatcctcggataattgcggctaacaattcaggcacattcaagatcccaaatgagggccacatctctcactttcaaggaaaataccgctgtttcgcatccaatagactaggaactgcagtatcagaagaaatagagttcatagtaccaggtaagtgtccaggcacagattgaatcgacagttgctctagtgaagtgttaaatggacataatagcaactaaagaaagatattagtatgaatttaattagtgtgtatttaattattagaaaaattttcatcagagtcttgatatttacagtttagattttaggagaaagtagcataaccactctgtcagcttcactaaccatctatgtaacctggggaaagtaattagttttcatatatgatgatggttaaatctatgattagtgaaacctagctcagtttcagtagcacatgatctcaaagcctctacatcaacacaaagacactcttt

SEQ ID NO: 1848 - DNA, 1200 bp, mus musculus
caatgatattgctgatatgttgatttagaattgtgtatcatgttgctttatgtcatttcttgcttgctttgctctacaaaagcgtttcaatttatataatcccatatgtacaaattgttgttcatatttctgtactagaatagtctaacaaagtccatatatatgtgtatatattgattgtattgctttcgctaagtttttatctaatagtttcagagttgcgattttcccttttctacattatttatttacatttcaattgtttcttcccccatcctcctccctgagttctttactccttatccactttgcctcttagaaggtgaaccccacacaactacccacttctctcacccactcaccccccacttcacctcccgaggtgcccctgcatccctccttccttggagcatcaagtctctacagtattaggttcactctcccactgagatcagacaaggcagttggaaactggttggaggtttagtctctgggaactctgaggagtccatgatagttgaaactgttgttcttcccatggggttggcaaccccttcagtgtcttcaatccttcccatctctcgtccataggggtctgtgacctcagtccaatgtttggctgtgagtatttgcatctgtctctgtcagctactgttagagcctcttaggggacagccatgctaggttcctgtctgcaagcacagcatggcataagtaataatgtcagggatttgtgcctgcatatgggatggatcccaagttgggctggtcactggatgggcctttccttcagtctttgctccatttttgttcctgtatttcctttagacatgaaaaattctaaatcaaaaattttgaaggtgggtcagtggccccatccctgcactggaggctctttctgtctactggaggtggtctcttcagctccccactgagcatttcagctaagctcatacccactgagtatgaaagtctcttacttccaggtctctgtgacttactagaggttctctgtgccccttcacccctacagctgcatattctattcattctcctgaacctctgggcttctctcctgactccccctatacccaatcctgctcttacatggaaagttttttgtttgtttctttgtttgtttttgttttttatacagttccaagtatgttctctacaggcttttatatatggatcatgtgg

SEQ ID NO: 1849 - DNA, 1000 bp, mus musculus
ggaacagtctgcggtccctcggggaactgccagagtctggctcagattatctagcaccgcagactccgctgggtgctgtggaagagtcagtgctggggtccctgaaccacacatagaccagggatgtcaggtcctcagttttcgacatctcagacacctctggatgttgcagaagagctgagaacagagtggggcctgggcttactctggcctggggccaaggggaaaatggtaggaggagagagctcttgtaggttattgcagggaatccttgtgttgcctggcaggcggcttgggttggtggaattcatggctgaagcacctggaggtttcctggcaggaggttagacaggcatgacttgttagaggaagacctgatccattgctcaagcatggcagatcccaatgagaagaagcagtccgtggttttaaagcattttttgtagaagggcagagagggagagagtagggaagtagaggtcggccatggctacatggggtgtggggaaggagtaagagcaggagggcaagaagtgagagtaaaagcaagagggtaatagagtaagcaagagagagaggagggttcaatagccccttgtataggggactgggtctacctggctgttgccaggtaattgtgggggtagagtccagacagaataccaggagcttggggctttgcctacatgactgatggccacataccttaggtgtgaggggtggggggaggctgtgggaggctatagctccaacaggagctaggggcccaggaggcatggcagaacacttgctgacctttagtgtcaccagggttcaaggcctgtgcttaaccagcgaccaggctgtctgtgcacagctcatagcctcacaaaagagtgtcagatcccctgaagctctaggtatagaaagttgtgaggcttctaggtgggatgatgagagtcaatctcaggtcctctacaagaacagcccaggcacactctccaaccgtcagcagtgtctg

SEQ ID NO: 1850 - DNA, 1000 bp, mus musculus
tggaccttaaaaacacacttagaagactcattatctgcaggtaaccaaggtctcctaaggcttcacaaaggccatatgttcttgggttatttgaacgtcagcacctccagaacttagagtctatgggcatctcaagtctggagatgctgaagggaagccttcagtggaaaggctttcctgaagaatactaggcacttcccttcacttgttcatacttgcctgctgactatgcctactatgtttccttctagaaagcctttaaacttcataggtttcttgtattaaaaattttaatgtcaattcaatggccttctgtatttcttgtggtgagttttatatttgcttggtgaaatgttgaagaggacgaccaagtgtgtttatgtcaacaatttgaatcatttgatcatacagaaaatgtgaggattcccccctccccagaattaaaagtgattttctgtcctgtgtgtgtgtgtgtgtgtgtgtgtgtgtgtgtgtgtgtgtaagtgtgtttcatgcatatgtgtttacatgtgagtccatgcagatggtcttacatttatatgtagaggccactagtcagcatggagtgatttctaccatcgtcagcctagtatttgagacagggtctctttgtgaacctgagctcttcagttcagctaggttgaacagcctcctgtgtctatgttctttcatcaccatgtttaaaaagagacatgacaacacttggctttttagtgtgtgcggggggggggagggggtccaacctcaggtgctcatcctcaccaggcaggacattaactggatgagccattttggcaggattcaattatttttttcaatattttttacactttgctatgattatgttccctgatctgtttggaaacaatgccaagccttttgaaaacagtctaataaaaaaatgcacaaagatactgtataccatacactctattcccactagttgtacaaataccataaattattagaatttaatatt

SEQ ID NO: 1851 - DNA, 1200 bp, mus musculus
tgtccttggtgcagtttcatcatgaaagaacagattggatctctttctttttaaaccatggccatttaaataggataatctcagctaagcaattgccccagaggtaaagaagatgatactgttttacataagaaagcattgatttaaatctgtttgttttgtttgcgatttcatggtgttcactacaagtgggaactacttttgattacagaactagctgataatggagttctgtatctttgtatgggctctcttccattcttccttcatttttcttcattttaaaagtctgtcaagtctttcacaactgactctgcttcatttcctacttttactgttgtaatcaactaaaatatatgtatgttaattcccttatatgcaaatttaaaacaaattttttttgtggttgttcactttagtgttttcagttgtttaacaaacttcacaatatttctgacaccttgaccacaaatactggaacctttgtctttgcaatcacttcttgtactatgcttagccaaacaccacaagggtttcacaggcatgctgcaattcttagtaaacagcaccccctctctctgtggggcctctacatcaacttctgcctgcagatttcggccctgtttgagttcctattttgatgaactgtgatatggaagaataagaaaagaaaagcatttccccatcaaattgcttttggccatggtgttttatcatagcaatagtaactctatgatgaccttaagtatttctgctcaaagttttagtatttcaacttgaatattttaacaaaattatgttgtttcaatgtacccttttaaaatccccttggcttataatcaagaattgttcatttgttcgccatttttatttgtttgttttgctctgtgttgagtgattttatgtaaaccctgtaggcacatagtgaggactagtgagatccgtcgttcagtaaagctgtttttcttgaaagtgtgaagatgtacattggatttcctgaatccatttttaaaatgctgttaggatgccagtgcagaaaaagtagagagccatatctcccttgaagaagttgttcacagcctcaagaaagacacatgagtttgaattatatatttcatgcaggtgcacattcatatttctctctcatacacttctctctcctcttctctctctctctctctctctctctctctctctctc

SEQ ID NO: 1852 - DNA, 1200 bp, mus musculus
gttctcttttcatcttcagagacttttactatttatcattgcagaatttgtttcttaactatctgcaaatctcaaaatccaaaattttcatataactcagtgatacctttggggacgttattttgtgagtgtacttcatcaatgtgttttttccttccacttttaaatattttaatgtacgactctttgtcagccattatatttacttttcttatcttacttaaaatcttagacaaatggatggatctggaggatatcatcacaagtgaggtaatccaattacaaaagaacacacatgatacaactcactgataagtggatattaccccagaagctcagaatacctaagatataatttgcaaaatacatagaactcaagaaggaaggtctttggaagaccaaagtgtagatatttcaatacttcttaggaggggggacaaaatacccatagaaggagctacagagacaaagtgtggggcagagactgaaggaatgaccatccagagactgccccacatagggattcattccataaagaaccaccaaaaccagacactatgtggatgtcaacaagagcttgctgacaggagactgatatagctgtctcctgagaggctctgctagtgcctgacaaatatagaagtggactgagcacagggtccccaatgaaggagctagagaatgtacccaaggagttgaaagggtttgcagctccatagaaggaacaacaatatgaatgaaccagtaccctcagagctccctgggacaaaagtaccagtcaaagaaaacacatggtgggactcatggttttagctgcatatgtagcagaggatggcctggttgctcattaatgggaggagaggtccttggtcctgtgaagcttatatgcctcaatatagaagaatgccatggccaggaaacaggaatgtgtaggttggtgaccagggggatggagaggggattaggatttccagaggagaaactaggaaaggggataacatttaaaatgtaaataaaggaaatatgtaataaaaaaagaaaagaaaagtaaggaagtgttcaaaagttaataacaaataaataaatattgcatagatagatatatagttatgagctacttctcttcggataatgaatacctcaaactagtgatgactttatttagactctgtgctcatggtagcaatgtaatacatattt

SEQ ID NO: 1853 - DNA, 1200 bp, mus musculus
atgcttatattacgcttatatatttcactttattttcatggagtatttttccccataggtagctccattttacagatgaggaaactgtctcatagattgaacaatgatgtgcttgaaatctcacagatattatgtgcctatgcctagatttcaacctaagcagcgtggctgcagtgtttagtgggcaagaatcttaaccagtgtgttcctttcctttcttttttgcaatttttaaattctctactaccttttcccccaatattttagtttatattcactttacatctccttcttccaagagaaggggagccccccttgggtactcccctaccctgaacatctagttccagcaggcctaggcatatcctctctactgaggcccacccaggcagtctgggtagggggaaggagacccaatggcatggaccagaaactgagatagctccttctccacatgttagagatcccacatgaagactgtgctggatatgtgcaacaaatgtgtaagatctcctgaatgttcccatgtttgtggcctaggtttggtgagccaccatggtcccaggatagttgactttgtgggtatggttgtggtgtccttgacccctttgacttactcacttttattcctactccattcttccataacactcccagagctccatcctatgttttgctgtggatcttggcagctgcctccgtccactgctggatgaagcctctcaggaggcagttatgctaggtttctgtctacaagcatagcagactatcattaataatgtcaggggttccctctctcacatgggatgagtctcaagtcggggcagtgattggttggttgtttcttcagtctctgctccatgtttattcctgtatgtattataggcttgaaggttttgtgggtggatatattgatgttcccctccttccttgggaagacctgacaagaggtagctacttcagtttctatattattctagtaggaatctcagctagagtatagaatctattcctatagattccctgtaaccccccctgtcacaggctgcgagccagccaccacagattccttttgccaatttccattctcactcacagccctcccactcccccacctcatccccatctttccacccctgatagcaatccctattttcctctttacccctcccttcccagttccctctctccacccacctc

SEQ ID NO: 1854 - DNA, 1000 bp, mus musculus
tgttaattaatgttatgcattgacatatagatgttaggtggtaattcctccatattctaaaatgcttacattgcctttaattctagagaattaaacttctactctgtaaatttagttgcaggtactgtattatttacccctaagtttgtaacattatctattcctctaatggtctgtagcttaaaaatgtgcattatgaatgaagaaaaaaataaaaaatatctaaatcataaaaaacgtgcattatatcaatgtcattagctatcctctgtgagactgtatgtatgtgtacattcatgcatgcgtatgtgtatgtgtgtagttgtgtgtgtgtgaaatatgcatgactgtaaatgtatgtgcaagtgcatgtggggtgtgtgtgtgtgtgtgtgtgtgtgtgtgtgtgtgtgcctgcataaatgttgtgtttcaggcagaataggatgtacattgtccttcatttacatgccagtttactcttttgagtatgagctcacattgaacttagatgtcaccattttcatctggcttgtagccagcaagtcccagcccatgttgtctctctatccctgatgctgggattacccacattcccaggtacactggactttcaaaatgcataacggccatgggaatatgaattaggtcatcacattaggtctgcatgtttgccctgcacgcatttgctatctgagccatctcaacagcctagtaattatttttttgactaccacatactaaaaggattatagtgttgggtagtatgtgttcatgtatacagaacttaccatgtaagcatgcgtttaggtaatcatagttactgatactgataaatttcaaaatgttagaaaaattagggaacagctgagattaattatgcaatgttcatttaatgaatacagcttattgatgacaaatcacctctaagacaaatggaagtattttctatcaacaacttttaattcttcagctgcatcttcatgcacattttagtgga

SEQ ID NO: 1855 - DNA, 1000 bp, mus musculus
aaagttcacctagaagaaatagtttgcttcctactgatgctgggaaagaaatgaagggaatgtttgttgtgttttataaaaatagagaaggaatatgttttggtggatgtgtagtcaggtatggggaaagggtgtgcctctgtgggcccatgctgaggcatcccttcaccctgagggaccagccacatggtatagtatagaatagagtttattcagcgcatggggaggggagttgagagggtagtagagacagaaaggaagagagagagagagcagaggagtagaggccggtcatgagcacctggagggggcagaatagggagagaggaggaagggacaggatgagagaacagagtgagagcaagaaggcaagagagagcagaggggcaagcagcccctttaatagtgagtcatttaatagtgccaggtaactgtgggaggagctaacaatgttactctcgttaacaatgtatacataaagacttagtcatagtcacatttgaacattctaccccctcctcactttctcatagacaagtgatacactatgtaaaattaatagatgataactaggtataggtaggccaatgaatagcatagaagagagtctcaaaatatagcctaaatatcagaggtctggttctggacagcagcatacatgctctgcttataactacccaattccattcccagtcaatgataaagcattcctcgggcatttgctatgtgctaaacctactgcttggcactgagaatagaagggaaagatagataaagccagtcctcaagatgctcgtagtccacgaccagggtccacgagcaagatcgcatgatttttttcagtaactctgaggactaggttataaagttgatatattaagtgtttaaaagaaacactgaaaaatgaaaggcggcaatagattgtagagatttcaagtttatgtctgaggaacttagactcggacctgaacaccctcaatggaattgaaggattttaatg

SEQ ID NO: 1856 - DNA, 1000 bp, mus musculus; identical to SEQ ID NO: 1855

SEQ ID NO: 1857 - DNA, 1000 bp, mus musculus; identical to SEQ ID NO: 1855

SEQ ID NO: 1858 - DNA, 1600 bp, mus musculus
agtatctgacaaaatagacttcaaaccaaaactaatcagaatagatagggaaggacacagtatcctctcaaaattctaccaagagcacattgcaattcttaacatctatgtacaaatacaagggcaccaaagttcatgaaacaaacaccactacagcttaaatcacatattgacacccacacactggtagtgggatctctcttatcaatagagaggtcatacacacgaaaactaaacagagatgctggagttaacagacattttaaaccaagtggacttaacaggtaattatggtacatttcacccaagtacttagaaactcatataatttttctctaaaaatgaccacttacttagacacaaagcaggtctcaaaagatctggtcaccatgtattaaagctcgatatcagcaataacagaaacaaacaaaaaaacttcaaacccgcaaaaattgaatatctcactaattaatgaaatatgtgccaagatgacaattaagtaaaaaaaattaaagattttctaaaattgaatgaaaataaatacaaaccatacccaggcttataggatataataaaggttgttctaaaaggcaagttcttggcactaagcacctacataaaaatttgagagatcccatttgtgaaggttaaataggtttggccctcatagactcatgtacttgaatgctttgctcacaacaaatggcactattaggaggtgtggccttgtttgagtaggtgtggccttgttgaaggaagtgtatcactgtgggggtgggctttgaggtctcctatgcctaagctccacccaatgtggaatccgagcctcctccttgctgcctttagaccaagatgcagaactctcagcttctcctccagcaccatgtctgcctgcacactgccatgcttcctgacatgatgataatcgactgaacctcttaaactgtaagccagtctcaattaaatgtttcctttataagagttgccttgggctggagagatggctcagtggttaagaatatgtactgttcttgcaaagcaccttagttcaactcctggcatgcacatcaggcaacttacaactgcttgtaactccagcatccaaagtatgaccctaacttcaggcatatgcacatatacagaaatacacatatgcatatgtaaataaatatggtcataaatattgttttggtcatagtgtctcttcacaatgagaaaacccaagtaagacaccattctagtaacttaacagcacacctgaaagtttagggaaaattgaagagaagaaatcacacctcaaaggaatagacggcaagaaatagtcaaacttgggcctaaaatcatcaaatacaaacaaacaagcaagatacaaagaattaataaaaacaaacagttcattctttgagaaaatgtataagattaacaaacgctatccaaattaagatgcaaattcacaaaagaagaaacgataaggggtgatataataacagccactaaagaaatccagagaataataagggtacactttaaaaacctgaactttaccaagttggaaatccaaaaggaatggataatttctcgatatacactacttcccaaa

SEQ ID NO: 1859 - DNA, 1000 bp, mus musculus
aaggcacccagttaggctgagccagcatctttccagagatgctacccaggcagttaaacacagacatgcactgtcctcaggccacagcctggagctaattaggcagtctagaagaaacagaatcttttttaaagggcccctcaaaaccagggcacagacatcatgcttcttcacagaaccatctccgttctcaccatcaagtatcactacacagacagacagacaggcaggcaggcaagcaggcaggcaggcagacagacagacagacagacagacaggagtgagcatgacaaaagtgtcatgaccaatgtaatctttccatgattctgagtaccaaggcatgggggcaaaaaaagacccacctttcatttcctgtaggtgtcgcttgtaagcatctaccttggctgtcctttcattaccttgaaagtgtttttcttaggaaggaaatggcccagttgaagctttccatcaagtttgattaactgggtgataaaacgtacacttttacaaagtaaatcctcagaaagtgaactcattataaatgctgagatatgtcaaaggacaagagcccagactcctctggactataaaagcaatgtttaactacctaatatcacacatcattacagtaacaatttctagcaactctgaccccaactctcatctgttaatagatcagacacaagtatgaccaatgcatctgacatgagcaagaaaggaggagtacaagagtgttttgttgctgtataattcttgtctttatgaaatacaaatgctgtgtgtgtgtgtgtgtgtgtgtgtgtgtgtgtgtgtgtgtgtgtgtgtgtgtgtgcaggttaacctgtatgtgcaaacatccctagtggaatacatgaatgtttgtggagatctaaggtcaacctccttggttgtcattgcttgggtaccgttcacctgagacagtgtctcctactagcctggcacttggaacccagacttagaaggatctgcttctcaactg

SEQ ID NO: 1860 - DNA, 1000 bp, mus musculus
atgagggaggctcccagtagtgtatggggtaactttagctcagaatcctagcaatgtgaatatggaacctcaagtggccatttcctatagccaggcaggacccgcagtggaggggtaaggacaccaggccacccacaaaactttcaattagtaataatcgtgcctcggataaacctcattggctacgatcccacaaaactttcaatccaaaagttgtcctatttaccagagatgtagagacaaagatagagcagaggttgagggaatgaccaaccaataactgacacaacttgggacccatcctatggtcaagcaccaatcccagacacaattaatgatactctgttatacttgtagacagaagtctggcataactatcctctgagaggctccacccagcagccaatggagacagatgctcagagccacagccaaacattggaagaagctcgaaagctttatggaagagttgggaaaagcattgaagaacaagtctgggcttggaactccacaggaagaccaatagagtcaactaacctggattcttggggcttttagtgactggaccatcaaccaaagaacatacacaggctgaacctagacccctgcacatatgttgaagatatgcagctcagtctttatgcgggttccccaagaacaaaaggagggtctgtctgttgtctgttgcctgcctgtacatcctgttctcctaacagagctgctttgatttgcatcagtgggagatgatactcctagccctggcaagatttgataggtcaaggtagtggaattcccaaggggtcttcaccccagaggagaagggaagtggggatgggaggaagcaactgtgtgagaggggaaaagggacgaggtaacaatcaggatgtacagtgaatgaatgaatgaataaacgaatgaatgaatgaattaataaaaagaattgaagttttctagttcctgaaattaaataattgccaaattatttatccaaaacctagtc

SEQ ID NO: 1861 - DNA, 1000 bp, mus musculus
ctttaagctgactctctctgtgacagcaggagagagggggaggcagggagacagagagaaccactttgtgtgcagcagctcataagtgcatacctgagatgcagcagagagtgtcttcccaaccagagtcattagaaggaggcagcacaatgccctttccaaattaagaacatagaggacaaaactggcccgtaagaagatccagctttggtttgaattggaagataccacccatactatcagaacagcctgtgtaatatatttttttctttttccaattagtgtggtgtaacttgtattcattttgtgaaattagagaataaagatgctaattaacagtgtaccataaaaagcattggtgactattgggatacctttatttctggagaattcactaatgtgagatgctacctttcaggacagtagtcaagggattaaagaagaaagcactgtggaaattaccaagctttattagactggcatctgttttatctcatgtttataaatatcactaaaatagtctttgaactgaagtctacagttgctttactgtagctctagtgacaggtattctgagcaatcatcccctgctacttatatacattgcgcttgcatcagaggtagctctgggattcatgctttcttgaatcctgcggtctctattatcctttctagcatttcctcattccttagttggagtgcaactctcatgttgagtttggccttttgattttctagtgacaggagatgcagaaacgatgtgcatagtgtcttttactgtgactctttctaggaatgcattctttattctctctctacttctgcattttccaaagaaggagcagaggatagaaaaccagtaaatagccacatgacctgccatacccagcactaacattttatagtatcaaatagatgaaccctataagtgtatgaggaatcaatgaatgttattttatgattctgagatgtggaagagtttgcaatgtagcacttttat

SEQ ID NO: 1862 - DNA, 1000 bp, mus musculus
ttttaatcttgtttttacaatccaaattgtatccccttctctgtccaccctctgactgttccacactccataccttccctgcccctgtctccacaagtatgtccccatccccccaccaccagttcccaccccaccagacctccggaagactgacagccctctgaaagacccaagaagaagctgtgcccactccttgtagcctctagtctcttaagggttcagaacatcttctctgactgagtccagacctggcagtcctctgctatatgtgttgggggcctcatatcagctggtgtatgctgctttgttggtggcccagtgtctgagagatctcaagagtccaggttagttgagactgctggttctcctctcctacagggttgcattcctcctcagcttcttccagcttttcactaattcaaccacaaggggcagcaggttctgtccattggttgggtgtaaatatctgcatctgactctttcacctgcttgttggttctttctgacggcagtaatgataagcccccttttgtgagcacaccatagccttagcaatagtgtcaggcctcagggcctatccttgagctagatcccaatttaggcctgttgctggccctccgtttcctcaggctcttctgcatttttgtccctgcagttctttcagacagaaacaattatgggtcagagtttttgactatggaatggcaatcgcatccctcacctgatgccctctctttctgatggaagtgggcgctacaaactccctctccctactgtaaggcatttcatctaaggttcctcactttgagccctgagacccacctcccaggttctggtatattctggaggatgcccccacctcttacctcctgagattgcctctttccattttttttttctgctggccctcagggcttcagtcctgttccccctacccaatacctgatcaagttcccctctttccctccctgttccctttcctacccaggtccctctctct

SEQ ID NO: 1863 - DNA, 1000 bp, mus musculus
gtaagccataggtctggggatggggaaggcgcagcctgaggtccccttggacctgctggagtcgaggtcagacttttgggcaccacagacaccactgggtcccttggaagaactggttctggggttcctgagcctcatggaggccaagaatgtcaggttctcagtctttgacatcccagatgccgttgtatgtcaaagaagagctgagaacagagtggggaccctctcacaaactctggcctcgggaccaaaaggaaaagggcaggggggagatctttatcgaagggacaaggagagtcttttggcaggcaagttgcttggattggttggcagccatggctggagcacaggaaggcctcctggtgggaggttagaccagcagctcattagctccttagaggaatacctgctccattgctccagctcgcatcccattgagaagaggtagtccgtggttttaaggtttattgcagaaaggtagagagagggaaagagtagggaagtagaagctggccatggccatgtggggggagggggagggtaagggggatgaagagaagggagtaaaagggcaagagagaagcaagagagtaagagagcaagagagcaaggagggggcaagcatctcctttcacagtgggttgggtcattctggctgttgccaggtaactgtgggggtagagtccagacagaataccaggagcttggggcatagtctacataactgatggtcacacacctgtctgtgggaggtcgggggtgtgtgtgtgggaggggctgtgagaggatgaagctgtgacaggagccaggggcccaggaggcattgcctgtgctcaactggggacctggctgtctgtgcatagctccctgccctacaaaagatgacttgtgtgaaccatgaaatgcaaaatcaaagccatgaaacagggaacttgaaactacattattacattcaatcaaacctctgtatcaccagggggttctactcccttggtttctt

SEQ ID NO: 1864 - DNA, 1000 bp, mus musculus
agaggactggagcacaacagtgtcttctaaacataaaaaataactatactagcccggcgtggtggtgcacgcctttaattccagcacttaggaggcagaggcagacagatttctgagttcgaggccagtctggtctacagagtgagttccaggacatccagggctacagagagaaaccctgtctgaaaaaaaacaaaaacaaaaacaaaaacatacccaacaacctatacttacacaatcacatggctgcataagatcagtccttgccaggcactcaggaggcagaggctactagatctctgagtttgagaccatcctgctctacagagtgagttccaggacatccagggctacacagagaaaccctgtctgaaaaaaaacaaaaacaaaaacaaaaacaaaaacaaaaacaaaaacatacccaacaacctatacttacacaatcacatggctgcataagatcagtccttgccaggcactcaggaggcagaggctactagatctctgagtttgagaccatcctgctctacagagtgagttccaggacagtcagagcaacacaaagaaactttaaatcccgctaacatgcctcatcagcctctaccccttgataaaaatctattgacagttggtggttcctgtacaatggagaatcagcacatggcccttggtagattcactatgcaccagtggttgtccccatactcatgaatatatgggaagcacaaattaggctgaataggttataaacttttaaaagagaacattgagttggaagcagagtatgggtggctctttgaggaattaaagataggaggtaagaaggagtacaatcaaatacatcacatgtacatataaaattttgaagtatttttctcaatagccaggcgttgtggaacatgtttagaatccaagcgctggggaaaaagagacaggcagacccctggggcctactaattgataagctttaggccaatacaagaccctttctcaaaacaag

SEQ ID NO: 1865 - DNA, 1000 bp, mus musculus
gacctcaggtcctagatacagccaaatgtcccctgatgcttctagatgacagttaccatttagatacacagctaatgcctcattactacactgccacaaggaacttggcatggtcttgggagcagggctgcccaggaatgaatgacccaagcctccaagacagacagggcaggtggcagtgtccctgctgtcaaaatagagcatatagaggtgactcagtggtcaggtcctaagatatagaggggttctgagtttgagttctgggaagattctgagactactccagaatatgttgattgtatgaaaggtacaaagaaaattagcatcagggagggaatggatgcaggaaaaggacattgccaaccatgggttatcctgtcattggttgctgaagtctagagtgtaatgctaatggagacgtcaaggtgacagcattaagcaccacatacttaggaggcaaaggtatttacacaccaattccaatcagccagtggttacatggggcaatgtctccccaaagcaggctccagggataagagaattccttcagcatgagatgagagagccagcttcaggcagtcagtcatctatgccccttggcatgccagggcactgcagtatctgatactgtcaaatgtgtcaggtcaccgggcctgatgggttcactattgtcttagttaggattttactgctgtgaacagataccatgaccaaggcaagtcttataaaaaacaacatttaatgggggctggcttacaggttcagaggttcagtccattatcatcaaggtgggcgcatggcactatccaggcaggcatggtgcaggaggaactgagagttctacatcttcatccaaaggctgctagtggaagactgacttccaggcacccaggatgaggatcttatgttcacacccacagtgacacacctactccaaccaggtcacacctattccaacaaggccacccctccaaatggtggcactccctggtgcaagaat

SEQ ID NO: 1866 - DNA, 1000 bp, mus musculus
cagtcccaccccagtgaccattgcacattatgtgaggcagagagtattggcagctgggcactaatctgagacatgctagctagaagattcaaactccgctgatttggggtgtgagacgtaccctaggcctcttctgcagccacccatgaaggcccaggatgccttataggcatcagaacagcttccactgtggacttactggccccagggctgaagccatgtatgcagtgggcacacctgccagtgtacacctgtgtgcatcggacacagctgttgaatcatttgagcctcacagtggtcatgtcacttatgtgacttatgacactcattacttcccctctccaattttcagggcagaaagcagaggcacagagacctgaaagaagtgtcgtaagtggctcaagggtatcagcacgggaggtggcctggccctctgcccattcacatacgttagcagccttctggagggctagctgtgggaagtcaggaactgtcccctggctcccttcttaccatccactgaacttacacatccctccagcttccctttggtccaaggcgccaacttctaggttgtctcccctaatgctggtcatttccacctggcctactgccttcccagagaccaaggctccctggcacactggcagtcccataaacccagcctctcatacctgatgcagagatgatggggattcctgcttggggtatcttctgagttccaggccccccaacacaaactcccactctggcttcttggtgtcagtgccggcaatccagtcgtctgtagcccttggctatacccgctgaggaagcccctccctggcaggtgaagcaggcagtgcccctggtccctagctgcttctctttctggtctagggactggcaagaggggaagccaggctggcaaggggcggggagcatggctgggcaccagagattgaggactggcttcttccattccctgacaaaacacaggactctgccaaaagcagtgtgg

SEQ ID NO: 1867 - DNA, 1800 bp, mus musculus
ccctgatcccaactctctccatccctcaaatcgttgcattgcattagcacatatgttttctctacagagcaggccacatgctcccacttctggccgggaggtaggggcgaggacactacttcaatatgattagaatgtgtgtgtagggctatggtgaatgctgagctctaggtagctcacggggctctcctggcctcgcatgtcagacatcagccctgactggatggatggcgaatgaactgagatatgccacaactgttatgttatatgagatatgccacaactgttagcctttgcccatctgccccaccttccctagctggtttgttttaactgaggtagggactaagcagggacaaccctcctcaccgctggcacctgacaggagccaaggcccaggagaaagtgggcctctttgtgtctgaccagagccggtgagtggcagccctcagaccccaaatacccttttgaaatccgagcccatcacgagacatttttttttcagataaggaacacaattgattctagctttactgcttcagaggagggtgaaaggacatgcaggggtgctggaggccagcccagcctaggcctggggcttctgcttttttcagacttttgttatcagaggaggaagggtctgcatgggtcactgggcagtagcagggctgagcaagacatcactctctgtttagagttagccataccatgaggcattcagaaggccaaatctggggacctgatactctcatgagctttggggattagggttgttatggccagggtcaaggtctttgggagaaagggctacacctgacaccctcaaggcttgggttccgctttctgtattggttttcctcagagttcagggcctgatgcacaccgaccaggtagagttaccgaatccattccacgtcccgacctcaggttcctggaggtctcagtggggccagctcaagggtatccacaggggtctaaagacatggttagggtggtgctaagggctccccctaggagtggcccatgtcacccagggacctctagtggtgacccatctccactagatgacaggtggttcatggcaggaatgtaaaagagaacgtgttagctcagtgggcagtgcacttgccagctccttggagagacttctgaagtagggagtatggcctaaccatacaggactcactgtccacccagaatttaagccttcttcaatcatttgtttttcagtcagggcctctaacccacttgtagcagagtaatctttaactcttgatctttctgcccctacctcccaaactgggattagaggcccagcttcaaatttcttaattgctgttttctatttatgattgctgctctgtccatttatggaagcaatttcattaaaataaaattgttttggtaatagtgatgatgatgacgacaacaatgagataagctcatccaggcaggagtttcagtgctggcactctgaatggcagctagagagggagggatgtaaagactgggctccaggagtctgccacagcttacactggtacactaaatgcccatgctggcgtcaggacccttgacagacacagcagcagtgttcacagtaagagctgggacaaagccctcaggggtggtgattgcacccttctttgtgaggccaagagcagagccctctgtcactgcaacccctcagaacagaggaaatgaaggcttctggccctgtgccaccgggtcctgcacgctccaaggaaatgagcctgctcatctcccaggaagccattcacagagtcagcactcggtgac

SEQ ID NO: 1868 - DNA, 1000 bp, mus musculus
gttagccaggtgggcgcaaggtcaaggtattaagggaggcgctgggcgcacaaggtcaagtcactggacttgcagcgcccctaccatcccgggattcaagcgggcaggaggtggcctgggcatcgtgtccccgtcccgtgcggtccgacccgggcggctccctcggctccacccccggctcccccgcccgccgctcgagcctctcaaaagcccgggcgcccggggcggcggcgcagagccggggccggcgcacgaggcggcagggcggccatgactgcggagcaagcgctgcccctgggcaacgggaaagcggccgaggaggcgcgggggtccgagacgctgggcggcggcggcgggggcgcggcggggacgcgcgaggcgcgcgacaaggctgtccacgagcgcggccactggaacaacaaggtggagttcgtgttgagcgtagctggagagatcatcggactgggcaacgtgtggcgctttccctacctgtgctacaaaaacggcggaggtgagcgcggcggggatggcggggacgcggggcgacacctggggtggggtgacacctctcgtgcatggccccgatcccccctcccagtccccaggagctgtgggactgcacggggcccacctgtttctctgcgcctgcgtgcacagagcccgcttcgcacctgagcgcaccaccatctgccacctgccaccgggcccagagcagcgtctgtcacctgcgtgagggacagacctggcccaggagctctgctttcaggccactctcactggtattttaggcagaaacctgttatttagcctcggatgttccctgtcctcacaggaagagactgatctgagcaatcttttagagaggtcgccgaagtgccaggaataggggcccagcgttagccatgtcttgtaaatttttaaatcgtctcacagtcagtcaccttggaagggaatgctgttatggatctcaacgacgatggtactaagcatctaagaaact

SEQ ID NO: 1869 - DNA, 1000 bp, mus musculus
gtgaccagaatgcctagatttgtaccatggcctgtgcaggcccctttggttatgacattgtgtggacccaaaagagattttgggatagtccataccaattccactcaggtggaggtatccgtggctgaaggattgcaaattggattgccaccactatgtcacacctaaaggaatgggccagtattggtggattggcactgtgctgtgtgctcatcactgtcctggccttttggtgcatctgccacatgcaatatcaccaccacagggctcaagcttttttgatacaagcctttgcagctgtggagatgggacaatctcctcaagtgtggcttggcatgctagggaagtagtcagtgatgggtaaggctccctggacatgttaccaacctaagacagggatcagaccactactgtctgtatctgatgacggggaaggagcattgttgcagagggcaacctaagacaagcattctctctgccaatttaaagattaagggggagatgtgaggagcgggtgtggccgcggccccaagatggcgcccgggactgctgccaagtctttttttttcatgttttttttattgggtgtttatatcatttacatttccaatgctatcccaaaagtccccaacacgctctcccacccacccactcccacttcttggccctggcattcccctgtactgaggcatataaactttgcacgaccaatgggcctctctttccattgatgaccgactaggccattttctgattcatatgcagctagagacacaagctccaggggggtactggttagttcatattgttgttccacctataggattgcagatccctttagctccttggatactttctctagctccaccattgggggctctgtgatccatctaatagccgactgtgagcatccacttctgtgtttgctaggccccggcatagtctcacaagagacagctatatctgggtcctttcagcaaaattttgctagtgtatgcaa

SEQ ID NO: 1870 - DNA, 1200 bp, mus musculus
taaaggaaatgagggcagctagactcagagtttcagcgcactgtcatgaaactcctgaagtctccatgctagggaggagcggtatctaagtgctctactgtaaagcatccactcttcggagcggctttctcctctacctttcacttcttctttttaaaaaggccggaagtggctccctttacctggcggatcccagccaccgccttcctccctttgccccttttccaggacaccgggtgagttttcaccctggcatttttgcccctcttatgtggcttcttttctttgtgcaccttcatgtgctgcctcagatgggagctctggctgaagcacttgtcacactcctcacactggtagggcttctctccggtgtgggttctctggtgctgaatgaggtgggaactctggctaaagcaccggccacactcatcacagcagtagggcttctcgccggtgtggatcctctggtgctggatgagattggagctctgcttgaatctctctccacactcgtcacacttatagggcttttcccccgtgtggatccgccggtgctggatgaggttagaactctgaaagaaacttttcccacaatcggcacatttatgggatttcttcccagtatggatcttcttgtgctgaaagagcgtggagctctgactgaaactcttggagcatttagcacacttgtaaggcttctcgtccacgttccttctccgtcgactcaagcccgagtcgaagcgaatggccaccccccatttctgtcgctggcgggctgtcttgcgcttgctctcataggcttttccttggctggcgcttcgagaaataccccctttgggctttcctaacctcatggtgagtaggcaaatgtgtcggcaagagatcctactgtcttctgaacttctgaactaaggtctcatatcctagagtgacgcaactcggaattcccttctgtagaagaaaaagaaaaatacagatatttattagttcagcactagcacctcttcaatctatcaaaactgcatccatgtgtagccaaagcacacctagtacaagtgcaatgacgcacttttaagagacaggtgctcgttaggtgattctaatgccagaggttaagcttaatcagcatcatcatcattttgcaacgtttctgattttggacaggcaaaagagaagacgaagaaaaacataaacctgtta

SEQ ID NO: 1871 - DNA, 1200 bp, mus musculus
tgattgagacatttttcaactgaagtttcctcttcctagatgaccctggcttttgtcgtttcgacaaacaagcaaacaaacaacagcaaaacaaccagaataccactaaaccatcttcctggtcctccatagttcattatgggcttgtttatagaggaaaggcatcattccaaattcataagaaaccggcttctgtgagtgtctctacatttctttctctgctttaaaaaatgaaaggtctcaggatggatggattgtgttaaataaggcacaggggctcctgtgtcagggccagtgagcaatgcagcagcagggcatacactgtgaacttgccccctcagcaatatgttcaggttaaactgaacttccctcagctaataacacaccatgaggcagcaataagcacagtaaacatgtcacattctcagctgtctgtagcattctattttttttcttctagatttaaaaaaaaaaattattagatattttcttcatctacatttcaaatgctatcccaaaagtcccctataccccccccccctgccctgctcccctacccacccactcccacttcttggccctggcattcccctgtattggggcatataaagtttgcaagaccaagggacctctcttttcaatgatggccgactgggccatcttttgctacatatgcagctagagacatgagctcttgcagtactgattagttcatattgttgttccacctatggggttgcagaacccttcagctccttgggtaatttctctagctcctccattgggggccctgtgttccatccaatagctgactgtgagcctccacttctgtatttgccaggcactggcatagcctcacaagaaacatctatatcagggttttttcagccaaatcttgctggcatatgtaatagtgtctgagtttggtggctgattatgggatggatccccaggtgaggtagtctctggatggtccatcctttcatcttagctccaaactttgtctctgtaactccttccatggatattcttatcttgagctggtggcagccagtgagtgcttagggaagtgtctgatggatcagggacttggcaggggaagacacctgcaggacatgtgactaactagctttgtttggcccaacacaatggacagaaaattaaaataagatattataatatatgtaaaatacatattag

SEQ ID NO: 1872 - DNA, 1200 bp, mus musculus
agaaaacaccaatgtctcagactaaggtgtatgacagaagtaattccctctgttgtctttcagcctaaggcttcgagtgtttagttgaggcccaagtgcatcagggaaagcagtctgttctgctcacccagagacattctcacagacccacccatgctaacattcggccaaagactcagacactgtgtgaaccagtcaaactgacacatgaatttaactatctcagtagctcagggtaccctgagcagccctggctgagcagataggacagcagcctggatgggtccctgggcatgtgcttcatcctttgtaagtacacgttttaacagttgcccgtgtcccatgcgcccatgactggcaccagcaaatggaagcaccacagaggccctgttcaggtagcttccatcagtaagctatggccagatgaggactctgtgcccgggagggatccgacaactgttcaaggtcccacagccattcagagatgacttggatctgggagactttctcaccctcatatcacctgtcccccttccccacaatgtacccacatggcttcatctactctagctagccatggcggtttctgaagccctggggatgtctggtcagccttaagctttctggaaaaaaagctgcgggaagggtgaacaccctttgcttactcagggaagactgcatttcttacacagtcttaccaggtgctggtttgtggggcccagaaaggacagtcagagggtggctgggtaaacttgaaggatgaatgtgtttcatcctctcatgaagtgatcttggtcatgactctggactcagcacaagaactcagatagaatggtcttcagacagcctaaaaatggctccttccaagatcaatactggctctgaaatacgaaaatagttttaatacatgttgagattcaagggactgagttcaacattctgatgtgtggggaggggtgggagtgggagggtgcacggtcagggagggagggatcaaggagcatccctggcagggaacgccttgtgcactaagttgtgttgaagatctctgtccacatacagttcatgagccctggcttcaaggaccagcaagctcacatctttcctagtttaggcctccggggtcccacagaaagagacagggttctactggcccaggacactggtcactgcgtctccctgaccccaatgggcagcccc

SEQ ID NO: 1873 - DNA, 1000 bp, mus musculus
tacgcagaagaggtttcactgtccatcgtttctggacgaggtctaattctagcagtaaaggagccagccgccttatgagcatagataggtcccgaagcatctcttccttggtttggagaacgcccatctggtgtatgcccaccctaccctaatgcccactcaacatctaatctgatcttggaggctaacagggtcaggcctggctaataattagatgagaaagaaagcccctctgctttccatcccaaagaaaggccacctgctcttgtgcttctgggagtctaactgcctgagggtaccaaggagtctggctctgtcattctgggaccctgctccacctttcccatgtaaggacacatattgctctcatttgtttccttcccctcgggcagttcctctgccacaacggagaggtattccacatctaaataaattgtgcaataaatctgcaaacttgcatggaaggtattaaagccatcctttgatgtctggtattgagtttcctggggtagagaggtaagtttcattgaattccaggccctaaaaaggcaggtattattgcccctgcttccagatgaggaaacaaaagtagcaagtcactgagagaatcctgctgagagctgtctcactctgtctagcgaagcctcagccctttttctcagcttgatgacaatggcaagggacagacaactgtccatcacctcctcccactttgctgggaaactgaagcacaaacctaatccagtagggtagggtgacgggtcttgtgacaaggacaatgtgctcaggaagagaggaaaggagtcccactcttggcagaagatgcctagcatgttatgttcattccacaggcctgcttgccaacggtgtgctgtgcatctcagagatcatacacagggtggcgaaaggttctggcttatctgagccaatgggtctattcctgttagtcctacgttgttattaatactatctcaaaagaaaaagatgatgcattgaagga

SEQ ID NO: 1874 - DNA, 1000 bp, mus musculus; identical to SEQ ID NO: 1873

SEQ ID NO: 1875 - DNA, 1000 bp, mus musculus
tgcaatggcatctcaagacccacacaagccagcccccaagacggtgttctgtatcctgcagattcctgttagagtggagtgcctggggatcttggcaggacaaagggtcagagggtaagtgcgaggaggcagctgtgggcagcactttggtaagctccttggaaggcttttgtctggggtcagtgacagcagggtgggtgtcgaaatgttcatgttcataatctcatctcattcatctcctccccctcactccgggctcccttacctctgtgtgtgacgtcacatcacctctgaacaccttcgctccgtgtgacatcatcactgcttcatgacatcatcaccgccctatgacatcattgccaccctatgacatcatcttgccctcatgtggtcctgtgcctttcctgtgccatgtccaaccctgtggtgggctcatgccctgagcagccaaatctgtcttccatcactgtaagtaattctgactgaaagatcctaccgtatccgggtataccagggagccacacaggctcgcctttaagcctgaacccagggagtgagcacagacaagctgagttctttatctggtcctttatcctaggacactccttgattgggagggtccccaaacccttaatccactttaaagccctttcctttctgggaagaaaggaaagacagagttccagccgtctaagtacagccctgccttaggaaacagccatctcctctcaagaggctccagttatgtagcggagatgctactaggtcaccccagagacaaaagcattgtcacctgtgcccaggtatctgccagcctcgacaaggctcaacacttgaacgaaagaaattgtgcctaaggccaaagcacctcaaagacaatgacaggctgaggtggccttaacacaaagcaaagggaaactttgtcccagctgctgttgatgcttgctgtcagcctgggaaaggacatctgttctttacaaaccaagagacacacatggca

SEQ ID NO: 1876 - DNA, 1200 bp, mus musculus
tatgacctcctttcagcagcgtcaggtctcaatggcaagcaggcaagtctcttaaaggacttgtctccttcacccaaccaggcagaacatttggggacgttgatcaactctttaggccactggagaaatgctaaatgtagggtgccaggcagctcctggtcaggagccacggggctctcgtgcctggcactgaggaatcgtttagaacaccaccagagcagctgaagagaaggcatttcatgatgctctgtccctaccatggacaccaggtatctcccaaggtgtgcctgcctctcaattctgagactagtgccgccaaaggacatgtaggaggatggccaagacatgacgtggcaagctaagccctcctcagtgagtgatcataactccaccaagacactggaagactgcagtctggattaggtgaaagatctggcaccttgactttagaggaatgaagttggcacccccgagattaaatgaatggaatgcagcattctggcatctttccttatctgtgttgccttcaaccacaagagctggagccctgtcagaagcaccaggaatgtgccgctgagcttatgtgctagagtagaaccacctcaaataaaaggcttcaacagcattttgtgatgctacgtcaagttttggttcaggggacatagtagtgaccacatcctagggtcagaaaagcaagcagagaggttgagaggggctcagatataaaagagcaagggctcggcagcttccgaaatactctttatggtgaaccatgcatcaggaaggctgtaaaaggtaacctgacaggtgagagcatatggaaccagggaaggtaatgagtcatatcctacggcaaacaacaggatgaagcagatgtgcacctgcctcgtaattctgagtctagtgtggccatagggcaggaggctgcagcctgtctccctcagtcgtttctgaggggcccagccatggagcacttagattgggtgtggggaagtatcagatggcttgtgcccagtaaggctgtccctgggctacagcagcaccaccctgagggtttcaagtggcttgcaaatggagcggacaaaatacaggggcccagtgcatgtggtcaggttccacacagccctgaggccttgatggtcactttaaccaggtatagagaaagctcaccttttttagacaaggtctgtgtaagcccag

SEQ ID NO: 1877 - DNA, 1000 bp, mus musculus
cgcaaactttatatgccccagtacaggggaacgccagggccaaaaagggggagtgggtgggtaggggattgggggtgggtggatatgggggacttttggtatagcattggaaatgtaaatgtaaatgaggtaaatacctaataaaaatggaaaaaaaaaaaagaaagttaaaaaaagaaaaaaaaaaaaaacaaaaaaagatttcctcaccattatctttaatcattgtgtaacggtggcaccttccacaagcttaaaagtgtcattggaagcactcaggctaatggatcaggccccatttttctttttttcttttttcccttttttctttttgtttttctttgttcattaaactaataaaatttatttaaaaaaaaaagtgaaaactatagcaatgaaagcatattattaccaagacacgatctcacaggtaagcatggagcactgactgctgaagtttgtattacactactgctcatcttgctaataactgttctttttagaagtggaggagggtaggtagagagagggactcattcagtcattcctacatgaaccaatttttgtgctaaaactgagagctgtttggagacagagctacagtaaacataccagagctatttacaggcttcttccagtgagagcctcacacaccaggtgctaaatgccaagataaacatctgtgtgcctacattaacacacacacacacacacacacacacacacacacaccccccttcctaagagctcaagctgacccttgccctaatggggtcctcacactactgggtagatctccctggagcacgtttgcaaattttacagggatatatattaacctcaaatttccggaaaccgccaatagagttaattctattcatttaattcatgcaaaacttttctaaaacagagtaattatgttaggtggagattcttatgttaagcacaaaatcactggtggccacaccccatgtgcaggtgttctaacacacaagagcag

SEQ ID NO: 1878 - DNA, 1000 bp, mus musculus
ttttatttttaaaaggggggggggaatgtgatgaatgctagcgaggtgccacttctctgcctcttccgggcttgctgtcccagctctgggcccccacatcggccggcttcccagagcatggttaacaggcacagtcttggttggatgacacagggcactcctgtttccttgagaggctaaagagggtctcctaaacccccaaattctaagccagccctgggaacacagtgagacacccactaaaagaaatgtttaaaagatgggatgcaagtctttagagagagcacagactgaataagacttggtgttggggatgttgagcggcaggctgacaagcattcgtcaagcgtgcctgaggccctaggtttaaacctcagtactacaaagtaattaacttgtttttaaaactcaggtaccaggccctcagcctctatgctcagaggctaggagcccacgaggctaaattctgagcctagccttccttccatagtccattcttcgggactcaggacagtgtactattctggtcatgacactttggggacatctcaagtctgatccctgtctacagataccctagaaagcaagagatgaaacaaagaggccttcctagtaggtcatgtgtgaatggaacaggggaatgactgaaaagagccaaaataaatagcccagaggaaggaaccagccctgagtcagacactcacagaagacttgtagatgatgtacaggacctgtgctgggccctcactaggccctcagcaaccctggcctcactcacacgtggccatgtgaccatgtctcttgatgtaccaaggaaatgtcagccttcctgtcctaaatccagtggcagtctctcagcagcagacagcatttccacagcagagggacagctatccaaacagtagaaagagggtgggttgggggccagccagagccggccatggctcagagatcatttcttttcacagtcattgaaattaggtagcaagaaacacagcga

SEQ ID NO: 1879 - DNA, 1000 bp, mus musculus
ggaagatcaatattggtaaagtgttattaagctaatgatctcatttaaattacactgatttttatgttgatgagcctttctagtccagattctacctacactccaattcaagatcccaggatgcacttagcgtttctctagtctcctgtatcctaaacttgcctatgtatcttttcttatcctctgtgatctgaacactatattaattactcatctaggcgctgcagcaaaatacaaaagcgacctgaggaaaggtttatttttgacccagtttgaggagacagcctgtcctgtgggaaggtcaaggcggtgggagcttgaggcagctgaccgcattgtatctgcgcctcagaagcagaggcaggtgcgtggaagcgcttggtctgtgttctcctttccctccgcccaggactcgagcttacaggtagggttggtcctcccaccccagtgatccagtgatctaagcagtttctcacagggatgtccataaagaacagttgtttgttgtacgtcctttgcttggggctgtgttctgttctctcaggatcaaataggatgattggcaagaggagcagtgtattgtgcctgcatgactgactcttcatacacacttcaggaagtgaatggtacccgtgtgttctatggctgcgtgcttcctggcctttctaccatgaagttaacatctttccctttgtagtgtataaatatctgtggggaagacacttagaaactatgaaaattctggtcttcctccaacttgtattcacagatctaactggtgttgtggttactaaagttgtctgtccaatggtgggttcctatttctgtctttccttctacatttgctaactggaattctgtcttagggaaaaggtgcatttttgtcccccattcagctgcttatttattatttatattaccacagacacgagtgaattttactctgtggtcacagtctaccgttgccagtatttcttttacttctcagattgtcaccatc

SEQ ID NO: 1880 - DNA, 1200 bp, mus musculus
gtctttagattattttgtttagatttatttacttattattaaccattccattcgtttacatctcaaatgatatccccctttttggttaccccataaatttcccatcccacatccacttgccccctcccttttgcctctgtgagggtgctctcccacccacccacccacccacccatccgaccccactgcttcagcatcctcctacactggagaatcaaacctccacaggaccaagggcctctcctcccattgatgtcaaacaaagccatcctctgctacatatgtatctggagccgtaggtcccgccttgtacactccttggttggtggtctagtccctggaagcactgggtggttcggccagccaacattgttcttcctatggggttgcaaccccctccactcctccagtccttccccagcttccacaccagggtcccagctcagtctcaaggttggctccaagcatccacatctgaattggccagttgctggcagaacctcccaaggaacagccacaccaggttcctgtcagcaagtgcctcttggcaacagcaacagtgttgtttgttgtctgtagacactgtggatccccaggtggagcagtccccagatggcccttccttcactctgctccatttttttttgtccctgttttccctttggacaggaacatttctggtttaaaaactttgagatgggtgggtggccccatcccttgactgggggccgttcctatctactagaggtggtctttgcaggttctatctcccctttgctgtgcattttggctaaagtcatccctgttgggtcctgggagcctcttgcatccctggtgtatgagatcctccagtggctatcctcagttcctcatcctccactgctacatatttttattccatttcctgaccccctgtatctctctcctgtccccctcccccagtacctgatatggcccttctttattccctcctcctcctctctccttcccaggtccccctctccctccacctcccacgatcatcctgttcccccctcaatgcaggacttaagcatccacaccctggtcttcctttcttctaagctccatatggtctgtggtttgtatcatgggcattatgagcttttgggctactatccatttatcagtgagttcataccacgtgtgttctcttgtgtctgggttacctcactcagaatg

SEQ ID NO: 1881 - DNA, 1200 bp, mus musculus
caattttgtaattaaaaatctttattggattatagtcacattaccctcccacccaaattaaggggaaaaaacaaagacaaacatgaaaataaagaaattccagtcagagccccttagagttcataaacaactatgcgctaaatgctagctgagagaaacagcagacatttcagattatttaaaacacttctgtattgtaaatggatgttttcctctttacaaatcttgaaactgaagtcatgctactaagtacttggatcaaaaccattctacataaaaacaaaagcaagagaccatggggagaaaaaaaaaaaaaaaaaacctttcacgttctcatggcctatgagcagggttttcatacgtaactgaaaaggttaccatgagagcctgccatttctctctgtgtcacctagtattcctctgtgaaatccataaatgaatcactaccaggggcctcatctattttcctttcttctaaccaatcttactgtatctgtaactcaaccttctgaacattctccatgaacagcattgcaagttggttaaagggaaggtgtggggtgcagggagacagttttacaagggttttgttgtttaactatttaccagtggagtcactccaccaggagtttgatttcattggctagcagctggttcatgttgaacagcccccctgggagcttggtgagcatctctcgctcggtggtgctttcagggtcgctatcaacagagctggaactcgcgctcatgttgtcgacagcagcgctggcagggggaccaagctccggctcactagtctcactggcagtggacaccacagagagcagggacatgcgccgggtgagccggccagcgggcagaagggaggcagcatagtctgctatgataccagctacatctagattacaagccttatcaaaggcgatgaaacctacatttgcattggcctcgcagacacagaaggagccgtcatctttcatcaacaggtcaatgccacacacatccgtccccaggatattagacacttggatagccagctgctttccttgttcactcagtgagcacatcatccccacgccgcctggaagggaagaggtggggagctttagaggggaagcaatacagttctaatgtacaaccggtttttgttttgtcctatcaagactagattaattattagactactaaagaacagagtct

SEQ ID NO: 1882 - DNA, 1000 bp, mus musculus
aactctgggtactgatgcaactgggaggatcttgtcccagctgaacccctgttcctgtgccctatgtgctcttggcttgtcctgctttggacagttattggagagaaagtggcaatctcacctcttagcccaggagtgagagccctcttgggagaccagctctctcttggcatgatctgtctacagaagcctgtggaacagccttatctctctggtgcagatggtgactggaaggatcctgtcccactatttctatgtttttttttttttttgtggttgtttttttctctcctctgtctttcactcttgccatgtgtgattatttccttttattaagtaatttgtgtatgacttaatttttagtatttgtcattgtcaattaggaattcttgtgtacctatcactttgatgatttatcatccctattagtgttttggtagatgctttagagcttatgtgtaaagttacattacatacagctaaatatattttgatttcctttcacacacacacacacacacacacacacattctttcattgttgcgggccgaccagcagctcacgaggaacggtacaactgagatggcagctcgggctgaaagagaggaactaaacagaaagaagaaagaatggagccaagtcaaaatggactctgatcaaagctcaattttactgtccaacacgcagttttgaaggaggggaagggaggccgattccagccaaatagtcctggagtccagtagcagggtgaccacgtgtatggctccgaacagcaaagtggcaggttccagcagtgggcgtggcagaacgattgagcagcaagctccatccaggtgtaaacagtggaaccattaaggctgggggaggggaggctacatttcattattactctagataagacttcaagtactatattgaataggagtggagagagtaaactttcttacattgcttctgatctcagtagcaatgattcatctccagggtgttggctatggg

SEQ ID NO: 1883 - DNA, 1000 bp, mus musculus
ataataaaaaaactagtaggaagcattgctgctgtgctctggggaggctttgcaattggaaacattttcaggaagaagtgacagctggacaaccagaggacagtacacagagcatacctgaacatcaatcatagccctgcatattgcgcacagacccaaacatcactcaaagccctgtatatcactgcacatcactcacagaactgcacatcactctcagccctgcaaaccactcatcctttgcaatctctcagtgtgtgattgtacagtggcctcatgctagtgtacagtaccaggaatacataaggaatactcccacaagaatcatattacaaagaaaagaattaaatcatatgcaaatacttacttagtcataaacacatatttatggtgtttctactattcaacataggaaattatcccagggtcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctaagaagtgcttcatctgccatcaatcacactgatacaatgattttagcaattcctcatatttgaaaatccctctatattttatctcagctatctctaggttttatgatcatcacaatttacatagtttctctgaaatttaatttccttgtgaataaaatgttgattattagtagtattcattgcaagtatgaaataaggtcatgctttataatccatctcatagtttagggtatacagggagcactaactgtctacagtatacagagagtgctaactttactcatttatactgctaaagctgcaaagtaccattag

SEQ ID NO: 1884 - DNA, 1200 bp, mus musculus
cttttatctttctttccgtttattggttgtctctaacttcagaggtatgaatgacttcatgattggttaagtaactgagggattctggagacttttgctaatatggcttaagctaggtggtgggggagcttcctcatggctgcccatgaagttaattttcttatcctggaattgacttgttttggatggttgcagttttgggaaacagaaacttgggcgtagtcttcaaaactgtcagtctgttaggaagtcagcctggctctgactgtgtccgctcattccaacctctgatttgtaattgaattgaatcattgatctgtcaaaaaattttccccaaagtcttagtcattacctaaggggtcaattgaaacttaaaaatcatgaattaatgtcagaaatacaggcccttttttacttagcacctcagcctgtgaggtgacataatggatgccatttttttaataattgattttttttctattattaggacattcattgtttccttgggggctcaggaaggctgaaatgctattcaaagattgggcaataggtcatggataagaagcatctggtgatgtgacccagctgaaaggcaagggtccatcatgtggattgggctaatgattaacatcaagttttaatagtcagcattcagcagtttgcagtccccaagtgacccctgaatgtcagtgtaacagtttggggttggacagccattggcaaggtaaattacaaagtgtcccatcaataatatggggatagagataacaagtttttgtcacatggttatcttgtcagcatccttgaccagcaggggagtggcagctatgatccaaaggcactttcgccaatttcaggtcaccaggacctatttcttggataaataagtctctttcatggtaccaacttttaggtaagttcttttcttttttttttttttttcagcctgtaatttcttcctcttttattttttttccactttttattaggtatttaggtcatttacatttccaatgctgtaccaaaattccccatacctacccacccgcactcccctacccacccactccccctttttggccctggcgttcccctgtactggggcatataaactttgcgtgtccaatgggcctctctttccagtgatggccgactaggccatcttttgatacatatgcagctaaagtcaagagctccggg

SEQ ID NO: 1885 - DNA, 1200 bp, mus musculus
ttcttcaatttttatctatttaagtcagtttattacttttctaaaataaaacatagataaataaaatataaataaataaaataaaaataataaagaagctgtattgaatttgatactacagagcaagaactgcacttagaagagttgcaggggtgcctgctgtgtcacatgtacaccagtaggtggaagagaggagagaggttatgtccacccactgtgttctcacctaggaaaatttgaatgattaacagcctaacactccccggaaaaggaaagctcgagattaccactattccagtgctgcataaaccccaatgactcccagaatgaggaatagcccagagactagaagtctttctaggcctgaaggccagaggctagagtataatcacaatactctatacagacaatcctcagaaggggccattcagaccaaaactatgattctaatgtaattccttcaccagctgcagtacacaggagaatgaaccctgcacatcccatggtcagcacaattgagctgacccgggtagttggggacacaaacaaaccaggcccaactgcatatgcatgacagagctgatgagccacttgactgcatgcagtgacatgggtgagggagagatgacctcttcattgcctcttgttatctacaactggcaggaaggttggtcccaaggtcatcagagcaggagagctgtccatacctcttatattcttcagcaatcagaaggccaaatcctgaaccttgcctggtcagcacagtagagctagggatggggattgcacgtgagccagcatgaagaacatgagtaatgggagatacagagcttcctcttatctgctggctggtggtgctaaccaaggagagattctctcttaccctcccttgttccttgccatctatgacaggcagaagagctggccctgggattatgagaatgggaaaagtggccatgtccctcactagttgcactacttgggagaacagtccctgaacttcacctgggtagcagggaatagctggccctgtatatggggttgtttgtgaactgaatctaaaagcataaaggaaggaaggtctttatgatctaggcctttgaattggtccactcgaacatctacggcactatgaactcctggggtgaaaaaggggccactccaaaatatctaaaacttcagaatctccacaacacagga

SEQ ID NO: 1886 - DNA, 1000 bp, mus musculus
gcaattggaaacattttcaggaagaagtgacagctggacaaccagaggacagtacacagagcatacctgaacatcaatcatagccctgcatattgcgcacagacccaaacatcactcaaagccctgtatatcactgcacatcactcacagaactgcacatcactctcagccctgcaaaccactcatcctttgcaatctctcagtgtgtgattgtacagtggcctcatgctagtgtacagtaccaggaatacataaggaatactcccacaagaatcatattacaaagaaaagaattaaatcatatgcaaatacttacttagtcataaacacatatttatggtgtttctactattcaacataggaaattatcccagggtcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctcccaggctaagaagtgcttcatctgccatcaatcacactgatacaatgattttagcaattcctcatatttgaaaatccctctatattttatctcagctatctctaggttttatgatcatcacaatttacatagtttctctgaaatttaatttccttgtgaataaaatgttgattattagtagtattcattgcaagtatgaaataaggtcatgctttataatccatctcatagtttagggtatacagggagcactaactgtctacagtatacagagagtgctaactttactcatttatactgctaaagctgcaaagtaccattagtgaaaagcatgggtataaagaaaagaaaataaactcagtgcagacttgcag

SEQ ID NO: 1887 - DNA, 1400 bp, mus musculus
tccctttgggtagaagtgtctggcttttatctttctttccgtttattggttgtctctaacttcagaggtatgaatgacttcatgattggttaagtaactgagggattctggagacttttgctaatatggcttaagctaggtggtgggggagcttcctcatggctgcccatgaagttaattttcttatcctggaattgacttgttttggatggttgcagttttgggaaacagaaacttgggcgtagtcttcaaaactgtcagtctgttaggaagtcagcctggctctgactgtgtccgctcattccaacctctgatttgtaattgaattgaatcattgatctgtcaaaaaattttccccaaagtcttagtcattacctaaggggtcaattgaaacttaaaaatcatgaattaatgtcagaaatacaggcccttttttacttagcacctcagcctgtgaggtgacataatggatgccatttttttaataattgattttttttctattattaggacattcattgtttccttgggggctcaggaaggctgaaatgctattcaaagattgggcaataggtcatggataagaagcatctggtgatgtgacccagctgaaaggcaagggtccatcatgtggattgggctaatgattaacatcaagttttaatagtcagcattcagcagtttgcagtccccaagtgacccctgaatgtcagtgtaacagtttggggttggacagccattggcaaggtaaattacaaagtgtcccatcaataatatggggatagagataacaagtttttgtcacatggttatcttgtcagcatccttgaccagcaggggagtggcagctatgatccaaaggcactttcgccaatttcaggtcaccaggacctatttcttggataaataagtctctttcatggtaccaacttttaggtaagttcttttcttttttttttttttttcagcctgtaatttcttcctcttttattttttttccactttttattaggtatttaggtcatttacatttccaatgctgtaccaaaattccccatacctacccacccgcactcccctacccacccactccccctttttggccctggcgttcccctgtactggggcatataaactttgcgtgtccaatgggcctctctttccagtgatggccgactaggccatcttttgatacatatgcagctaaagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagagacacctacatct

SEQ ID NO: 1888 - DNA, 1200 bp, mus musculus
gaatattagtgtggatatattttcttcaatttttatctatttaagtcagtttattacttttctaaaataaaacatagataaataaaatataaataaataaaataaaaataataaagaagctgtattgaatttgatactacagagcaagaactgcacttagaagagttgcaggggtgcctgctgtgtcacatgtacaccagtaggtggaagagaggagagaggttatgtccacccactgtgttctcacctaggaaaatttgaatgattaacagcctaacactccccggaaaaggaaagctcgagattaccactattccagtgctgcataaaccccaatgactcccagaatgaggaatagcccagagactagaagtctttctaggcctgaaggccagaggctagagtataatcacaatactctatacagacaatcctcagaaggggccattcagaccaaaactatgattctaatgtaattccttcaccagctgcagtacacaggagaatgaaccctgcacatcccatggtcagcacaattgagctgacccgggtagttggggacacaaacaaaccaggcccaactgcatatgcatgacagagctgatgagccacttgactgcatgcagtgacatgggtgagggagagatgacctcttcattgcctcttgttatctacaactggcaggaaggttggtcccaaggtcatcagagcaggagagctgtccatacctcttatattcttcagcaatcagaaggccagatcctgaaccttgcctggtcagcacagtagagctagggatggggattgcacgtgagccagcatgaagaacatgagtaatgggagatacagagcttcctcttatctgctggctggtggtgctaaccaaggagagattctctcttaccctcccttgttccttgccatctatgacaggcagaagagctggccctgggattatgagaatgggaaaagtggccatgtccctcactagttgcactacttgggagaacagtccctgaacttcacctgggtagcagggaatagctggccctgtatatggggttgtttgtgaactgaatctaaaagcataaaggaaggaaggtctttatgatctaggcctttgaattggtccactcgaacatctacggcactatgaactcctggggtgaaaaaggggccactccaaaatatctaaaactt

SEQ ID NO: 1889 - DNA, 1000 bp, mus musculus
gaaccaggttcctaaagggaaggctggagctgtatgggaagaaatggcggatgaaataacaagaccaagacaagatactgatcaaggccccagagtttactaagagtctgagcttataaagggggaaggcccatccctcaccatgccaggctcttgatgctttgtcaccaggctgtcagcacttggtcaccacgctgttgccattcaggaatgtctcaggaagacaggttcagcctctcagcaggtagtggtgtcttggagaaaagtgcagagttggcagaacaatagacctatctaggtcagaagagtctaccctaggtggtcttgttcacagtgacagaacaggtctgagccaccctgctcaaggctgagggaggctacaattcctccctaaatacataataaaaattagctgggctggggcataaaatttacttatactgcatggtcctgcctgaaaattatggtggctggcagccgtgcctgtcttgggactttggtcttctatgaacttattcttatctgtcctggagaacatgtacagcttgcttgtgtttatttgaacaaacatggctatatggtgttatgaaaaaaccacggcctcttggcacatccctctgccttagattgaataattcagagacccagtggccagtctttggctgccagccctcatagcacacccttttcccaatcagaccaaagccacaatatgtactcaattcatgtcttcaaattgatgaatttctgccacctgcacttgctgaaggcaagtctgcatgcttgctgaagaccagcctgcagggaggtaactgacctccttgaaatacaaaggctagagttgaaaagcaacagaattaaggctgtctgtggtgaagtccaagtactctattcagttgcaaattagcaacaaacaagcccaagctctgtcctccaggtgtgggggaggtggctttggtaatcagcagaaaagctgttacttatcacataaataggctat

SEQ ID NO: 1890 - DNA, 1200 bp, mus musculus
ttaaagtaacacattattcagcctttgaacatgacctgaagggactaccaggtgctaagtaggtagttttgcttccagtggacaaaggttcctctgtataggacaatgctgctaacttctatgtctttagaaagccctattgagggagagaacaaagagaaaatggaagagggagaggacacagacgaggagaaagaaggagaaaagcggagcagaagcacaaggcctggagaaaccgcaagttctaaggggtctcatagatgtgatctaggcgcacagcatgtaatcatatgaactgtgttgtgttttcattgccagggcatatttgggaggagatttaccgcaacagttatgagtcacctaagaggaactgatcccaactgtcagtgagcagacatagcccaacagtgccacaaacaagactgcgctgctccagtcatagtgacaactgggctcctctggagtactaacacactccctcagcagtctgtcctggtgacagccaaattcagcagaaaagctgaaaaagattcagggtgttccaggcctcagggagtgacctgaagctacacagaaaggctcattaaatggcatcaaacggaggggcttctgacggtgtttgagccgttggttgatttaggccattctctcggcccaaagtcccctcaacaatggcgagagtcagttgcggggcatccagcagctactgcaggcagccaagaaggtgtccaaggcctgcaagtgaaagaaccggaggccgaagcaggccaaagaagccgccaggctgaaattgaacagtactgcagaggccaaggaagctgcagcactggggtctcatggcagctgcagcagtgaggtggaaaaggagacccaggggaagatgaacgtcctccagaaccacttcgagcagaacagggatggagtcctgaatgacctcttggcctctgtgtgtgacatccggccagaaatccatgaaaactaccgcataaacggataggaggtggaagcgcctgctctgtgggttggcatgagatctgcccccatagaataggaaacctccacagagctcgagttctgttctggaaggcattaaattatttctctatgccgttgtaggacccttcacgttttaagagtatcaaatctagctttttgtatggacttactatgtacctgaagttccatcttcttatcttgtgt

SEQ ID NO: 1891 - DNA, 1400 bp, mus musculus
aaaaatccaccaagttgaagtctcaattctgaacatctatgccccaaatgcagtggcactcacatttgtaaaaagaaaccttactaaaggtcaaatcacacattgtagctcacgcaatgatagtgggtgacttcaacacctcactctcatcaatggacagatcatggaaacaaactaaacagggatacagtgaagcttgtgggtcaaaaaatggggtccagtgtccagcccaggactcaggccactgggcaaggcagacaaagggagtttgcacacaccccatggcacccctgggcaggtgtcaggctgtgggaagcctcaggaccccactaagggggtgaaggaggcacagtctggggtccctatggacctgaacctctggcaccacagatgccactgggtattgcagaaatgcgggttctggggtcaacagggtctcactctgggacatcctagatgttgctgtatgtcttggaagagccaagaatagagcggggaccctcaggcagactctgacctggaggcagaaaggaaaagggcagagaggagagagctctggcagattaacaagaggatgagagtcctaggctggttcggcagctagattggtgagtaggttggcttggttggcagcccttggctgggaaatgcaaggaagctagatgagtgactcattagagggagagctgttttattgctccagcatggtgggtccgatgagaagaggcagtccgtggttttaaggcatttattgtagaaaggcagagagatggagagagtgggaatgtagaggccagccatggccatgtggagaacggaagggaaggtggagagatgggaagcaagggagcaagtgtaagagcaagagagtaagagataagagagtgaggagggggcaagcagctccttttatagtgggctgggctatcctggctgttcccaagtaactggtggggtggagtccagacagaataccagaagcttggggcattgcctatgtgactgatggccacacacctctctgtgggggaagggaactgtgggaagctatagctgcgacaggagccaggggtctaggaggtgtggctgaacaactgccatcccttagggtcaccggggttccaggcctgtgtttgactggggaccaggctgtttgtgcacagctcactgccccacagaaactaatagaagttatgaatcaaatggatttaacagatatcaacataacatttcaccctaaaccaaaagactatacaattttcttagcacctcatggtatcttcttcaaaactgaccatataatcgggcacaaaacaagcctcaacagatacgaggggatcaaattaattacatgtattctatcagatcaccatggactaaggctggtcttcaataacatc

SEQ ID NO: 1892 - DNA, 1000 bp, mus musculus
caatgcaaatggtcttcgaaagaaccttttttgttgttgttttgttttgttttcgagacagggtttctctgtgtagccctggctgtcctggaactcactctgtagaccaggctggcctcgaagtcagaaatctgcctgcctctgcctcccgagtgctgggattaaaggcctgagccaccatgcctgtttttttgtttttgttttaagtgatggagctgatgggaaaattcctctctgggcaacaatgttgcagaagggatgtaaggccctgggagctgaggacatgctgcagaaatcggttcaggcactggttaatttctgctaccataacaaagcagaacagagcaggcggctcatacacccaagtcgcctgttggtcactgctctggagcctgaggctctgtgtcaggacgctgggcttccttctgccgaggcagagtgctgaaagctcaaactacagagagaagacaggggaactctctgcgtgccaccttgtaagtctcctcggtgaagctgtccctgtgatggagtcacattggtctacagtgtgactataactacaactccaaaggacgaatagagaagtggaggccagaagactgaagagccggtggcaggcagctttctgaaatggggggaggcaggaatctagggctgaggaaaggacaaagtacacgaggtgggagaaattaaaaagggaaatccctgggctggcgatcctcagcagttaggagcacaggctgctggctcagagcagctgcctttccctgccccggctccctcttctggcctcctgggacatcgcatgtagtggtgcacaaacaacatgcaggcaaaaagcttacacctgtaaataacaggtaaatcttacagacatcccttgtgggtacacggaggcaaaatgaagacccccagaaccaatgagaagattcaaacagtgctacagagacagcttgcccagcatgagacgggacaagctggccactcgtctcactgctga

SEQ ID NO: 1893 - DNA, 1200 bp, mus musculus
cttgggctctgttcagattagcttggtccggagtggagtttcactgtagctggtcatatctgtcccaaggatgacgatgatagcacactcctcatgttaatgtcgcccagctacccatgtactgcaattgctctgcatcgatttgaaagccgacttagcacaatagcagcttctaatttgtaagcaaaaccttcagtgacataaatcaaactgttagcagcaacgccactgccgcatgttaatggagagttaatagacacgggaggacatccggggcatcgggccctgcagcttgtaacctgcccacattccacccctctgtctgggcaccatggacatctacatggccagagccgtgactgagaccctgagcatccctgaagcataaatcctgcattgaggcagtgaagagagatcagctagtccagtgtccttgcaccaggtaagatttaaggagaaagccaaatcatgggagaaacaaggacttggggaggccagatctgctgaacctcagcttcagccccagactctggctcatgcttactaaggacccactggagatgggccttgcctcaggcatgctcatgggaagagccaggacccagcaggaggtgcccactgccttcccatcacagtcccatcagcacctcgcagtagccacaagccccagagaggctatcagtttaggaacagactggggttaagggccaggatccctgtgcactcatctagaagcattttcccaaagccaggatggtcaactggcctgacactgggaaggtccagggcctgagtctgtattggtaaatgccctggaagtacccacagtcctctgctactgtcaggatccagcctgacaacctgcccgtggctgctcccaactctggacacccaggacctgtgcccatccaccctggatgctgcaggacccaccaggccttaccaagttgggacagagccctgtgcataggaggtagagatcaccactcatacacctctcccaggctgctgagctatgtgcctccctgctgtgtcctggcaaggctaagctcagcactgcccctgaacacattcaaagtccaacagatgtttatttggggaaattttcagaaaaagacatcatagaactctgcctggctcaggagcaatgtgtccatagcagagcaccccaggcagccatcaccaccttcccaatgtgtt

SEQ ID NO: 1894 - DNA, 1400 bp, mus musculus
ctcaacaacgtgtttctgcgccatgaacggtttgaacgcttccgaacaggccagactgctaaggcctccagtgaagctgagctagctactgacctgattgacatgggtcctgaccccgcagccacaaacaacctctcatctcaactggcaggaatgaaccttggctccagaagtgtgagagctggcctgcagtctctggagacctcaggtcacctggaagatgactttgacatgtttgctctgactcggggcagctcactggctgaccaacggaaaggggtcaaatatgaagctccccaaaccacagatggcctggctggggccctagatgcccggcagcagagcaccggagcgatcccagccactcaggcccgcatcatggaggacattgagcagtggctgtccacagatgtggggaacagtgctgaggagccctctggtgtcaccagtgaagaatttgacaaatttctggaagaacgagccaaagctgctgatcgacttcccaacctggccagcccttcagccgagggaccccccagaccatctcctggaacagcccctcggaggaagacccaggagaaggacgatgacatgctgtttgccttatgaatgcagggtctggcatcctgcagcccagggcctgacactctcatacccactggggcccctccctcccttggtattaaagctgcttgggggtgttttgttaccccgcttctcttctcccagagcctgggcagcaagggggtcaactgaaggaataagtcagccctccactggaatcctggctggtcctgccttcttcccatcctgctaacgactatgattttactgagacctggggccccagacaagctgacctgataggacctaattgacctggtgtaaggctgcttctgtgatattcccctggtcccttccccagagaatcccacgggagccctccagactctacactaacagtctaggcaatagaggagacattaccacagccttgcctatcccatccccctgcagagtggggcccgaaaaaagcttcagtggcttttgggatgggctatggtggcccctgctgagctgcccactgtcctggtacgaaactgcacccatcgaggaaacatctcactgcccaggtgtcaagatgagacctcgaggattctgggtacccagagctccccagttcctccactgcctttcccctatccttgctctgtacctccagcagggctccacccacctggggctcacctgttgattggtcctcaggtacagggagaggtgccttttgtatccccaaataaaagtagaaaaccaaaaaaaaaaaaaaaaaaaaaaacaaggactccacctaagattcacttaatcttagaagtcagggtcaagggcttcgtgcccttgcc

SEQ ID NO: 1895 - DNA, 1600 bp, mus musculus
attgaggaaaatacataattaaaaaaaaagaaaaccttcactttaccaattattaactgtgcaacctttgaccatttacttttcaaaacctttttgctatacatgataataattactcaataaattgttatcaaatgacctaaaaaaatattttaaaaaaatggagtcaaccatgccaataggtgtgggcagatggggaacccagtggcttgcctgtcactacacaacatggcagggaagaggaagacaaccagaggtcagtctgtagccacactgcacaggaggctatatagacacacagaggctgccctgcagccatgccacactgcgtgggcagagggcacccaggagtcttcctgttgtcacgtcacacagagcaggcagaggaggtcacccagaggccctccagccttgtggtccacctgcagtgggaaccaatacactgtgcaagtatgtggcaggcagatgggagagaaggggaagccgatcagttgcaacattatgaagagagttggaattggagacatgaggatggagaggaatagcttgctgtgagtagcctgccccaccacctgaagccatggtgaagtcccagcctgtgctgtgattgagggccatgtctggatctttggccatgcaagcacagaggtctcaacgtttgtagctcatattaccactaaagaccatgtatacatccttggtctgggctgccactcaggaccacataaatgtccaagggctgtgcagagctggccctacctctcactggttgcagcacttttgagaatgggccctatatcttgcttgggcagcacagtagagctagacctaatggcaaaaccataggtgaaccagccctgagcatatgagagcaggagagctggcccagccccttgctggctgcagcactggggagactggacacccctacacctctactgagcaacatagtagagctggtgtgattgggtaagctggccctgagagcatgatagaggaaaagctgaccatggtccctgccagctatggcattgggtaagctagcctgggtagtactggagatctcaccctggtgttgtgtgtacagaagagctggtaggctgaccaactcagctaccacccagagccagatccagggctttgagttggcccactgcaacatctacctcaatctatatgctagagtgtgaaagggctggttctacagatccaaagctataggatatatacaacacagggcaaaaacaggggagtcccagctaagatccaatattgatgatgtagcagaatctagaggccttgaaccagaccaacaactcactgcaataaacatttgcaagtaaaggagtgtggacgaaagggtacacggtagggcacactctgatataatgtagcttccacaaaaaaaaaaaaaaaaaaattaacattgagccttgatcagagaactttgtcttggcctgttatttctctcacccacccatcttatttcatccccagctcttcttccaagtgtacccagttctccatggctgctggacagctacaatgacccatctgttatgttctaccctgtgcctacagagcccttactgagatgaaa

SEQ ID NO: 1896 - DNA, 1400 bp, mus musculus
cttaataaaggaagcaagacatgtttcctcctcctcctcttcctctgcttcctcctcctcttcttcttccttcacctgatttctttgtgtatacttggctgctctggaactcactttgtagactagactggccttgaactctcagagttcctcttgcatctaccttccaagtgctgggattaaagtcatgtgccaccaccactgccatcgccactaaccagttagacatatattgttaaatcagtctctgttagcctgaatagaccttaggtatagagggacattttataggctcttttaggtgctgggctcctctgagtttttctcagtatcatcaaggcttcctcaggatcccaggcaggtcagaaaaaggacttgtggctctggctgaactcctaattaaccagaaatagacaatgggtcatggcctgcctccttttgccttgaacagaggaatgcctggccttgggccttcaatgcccagctcagcatcctacagaaccaaaaggtgtttactgtttccttcttttatgatgtggcccttcactgaggaagtccagtgaactgaagatgtgtcttggggccttggtccaagatatgtaccccctaaagtgcagctaatcagctccagaggaggagaggtttgtgcctaactatctgtagagggaggggctcctgcaggagttgtggcctgatcaccaggcagctcaagatgctagtgacaaaatctccacttactcattcttctgtgaaatgtaagaatggttgattcttgcacttgctttgtgctacaggagatgcaaaccacactgtttctcagcccgggcattgtacctcatgcatataatcacttggtagggaggttgaggcaggaggagggcactgattcccccccagacccccaaagcagctgtaatacctttcatgtctactccactcagcatattgtattattgttatttaagaaaatatagttgcttttgactcaggtcttttgtcaagttcatatatagttttttcttatttcctgcatgataagactgatagaacattttcttactgttttatcttgtttctggttttggacatagaaacttctaaaatacttagacttgcctgagtgttgggagtgtgagggcaatctatagttgttcacatccagcccctttcaaccatatatacctgaggttttagtaataaggtaaattttggtgggctcctaatagcttcagggtaaaggctaccatgtgattagagcagtggccctttaaatcttacccttctcttccagggagggaagagggatggaaactgacttaactactgaaaaggatctagtcaactttgttcccacaagaattcttcataaactttctaaacaatgtggctcagggagcttc

SEQ ID NO: 1897 - DNA, 1000 bp, mus musculus
cagagctattttatgtctaagactcataaaaaacaaaccaaatcaaatcacatccaggcaacctaatgtgctaggaggaagacagagacctgcagactaccatgccacccacagaactgcactccagtgtacaagacaggtcggccatagactcctgcttacaggtataggaggatgtcacccaggggcccgacagccatgtgagacagcctgaagctggagctggagccaccacagattgttgagtgtatagtggtcatatgggaaagaaaacaaatgaagcatcttgagcatatgaagaaagatggaactgaagcctcatggctggagaagagtggactgttgagtagccagccctgccaccaggggaatcagtgagtttcccagcctgaactaccactcaaagtcatgtctgagactatggctatgcatggcacaggttgggttggttgttgatttctgtaattccggttaccactacacaacatggagatgttagggcagcaactgtcgattacctggatgctctaaggctttgagaactagccaaacacctcatggatggagtcctctgaagatctggccccatctctcatagcaggcaatacttgggagagcaggccctttgccttgcctaggcaggacagtaaaggtgtcactaatagcaggtgtgtgggtaagttgggcactggcatcaggagtgtaggagaggggacccagccaagagcctgcaatggggtcgcaagggctagggagagctatccttcactctcatcaactgtatcactttggagagtgggctctgaacctcgcctgaacagcaaagaagagctatgcctggtggtgggggcacaagtgaggcagcactgagggcatgagagcaggagagttaaagctgcaccctgctgatggcagtactgggtgtcatcaccagaacagtgctggagagctcaccctagtggtgcaggtaagagagagccattgggctgaccagctatgt

SEQ ID NO: 1898 - DNA, 1400 bp, mus musculus
cttctctttgtgagacttaaccgagaacaaagtctccgccgggcttttttgaaacttcctttgtcaattcaattaatataattaatccaagtctcctcaccttagcaccaggcagacttttcagacaagggtaaaaagtaatcatattcttcaccaaaatacccctaaaacagtctttatgctgaagagtggaaaatgctgactgccctgagaacatgggccctggccccctgccagatggcctaattacccggaacttttgagaaaaacaaccacagtttcaatgtcctaggtgccttgaagtaaatatctgcccctagacttcccctatttcctccccgatcctccccctggtttgtggtttttgcctttataagcctgctgaaaaatagggtcggagtcgaactcttctacccctgcatggtgtatgagtcttggccccggcatgctggtttgagctcttgtcttgtcttctcactgttaataaacttcctcatgtgattacagcaagttcggtctcagtgtctcgctaggtgcgcactattcctgagacttgacttgactcccttcaggggtctttcaggtgggggctcatccgggatctgcgtgaccacccaggggtcctagacccacttggaggtaaggttctctgttttgtctcggtcctgtgtctatattctgtctgaaaatctggtgtaatcgcagtttcggttttgtggacactctgtgagaccacactctgagagggagagcggggaggatagagatagacgtatctggtgtccaacatccgttcgccctaggagacattccaggaggacaggggtgcctcctggacccccgtgggaatagtcaggagataagtcttctccttgacgatctgtgtcagcgatctgcttccaggccagctgactcttttcggtgtttctggtcgactcggagtcggcggttcattttggctctttctgtgattgtctttgtgattgttttcattgtaagtgttatagaaatgggacagactgtgataacccctttgactttgactttaaattattggacggacgttaagagtagggctcgtagtttgtctgttgaagtaaaaaagggaccgtggcagactttttgttcatctgaatggccgacatttggcgtcagctggccgcaagacagatcctgtcatttacccattatctacgctgtaaagtgtcttgtttttcagacaccagggggctatccggaccaggtcccctacatccttgtttggcaggatctggtccagaaccctccaccctgggtgcatccctggatacccaggactccttcagtgaaggccgctgtttctatgtcaaaatcgaaaccaaatcagcagccgacccgtccctcagctcccccacagatct

SEQ ID NO: 1899 - DNA, 1000 bp, mus musculus
tctattggattaaatggtagactatacactgtgaaaagaaacacatgaacccaacatgtgtcaggtgactaatacccaaatatataaactcaagaaattagataacaagactcctggcagcagcaactctaggtcaccttgggtgcaaacttggcaaaaggtcccacagtccccagaagactgtcctcccgattttaggatcactagtgagtggaacacatcatctgttcgagaccaaatgtgataggcctgtgacatcaggagcaaagattgctgtctgccctgcctacccagctgattaggttccttctaattgctactagtacaccttgggttttgaacgcaccagacagacccactgtcctcagaggagacaccaattctaggcactgtaacaagcacagtttctttctttctttctttctttctttctttctttctttctttttctggttttttgagacagggtttctctgtgtagccctggctgtcctggaactcactctgtagaccaggctggccacaaactcagaaatctgcctggctcagcctcccgagtgctgggattaaaggcaccatgactggcacaagcacagtttcttaggattccaggatcccaggacaacagaagcttggttacactaggatctcagggtttcagtggaggctttactgccaaaaaccctgacacacacagaatctcactttcacaggagaccaaaatcactggatcacagagaaacctggactctgagtagtcctgaattaacctggaatataggaaagacaggatccaatcagatatattgagggcagcaagcacttgagataatcagatggaaggaggcaagcataagaacagaagcaacagaaaccaaggttacttggcataatcagtaacagattctcccacatagccagtcctggatacaccatcacaccataaaagcaagaaatggatctaaagtcacttctcatgatgatgatggaggactttaag

SEQ ID NO: 1900 - DNA, 1400 bp, mus musculus
ttattgaatgatatgccaccttcatttcatttgtaaagattctctccagtatggattctgtggtgagcttcatgatctgagtgttgtgtaaaggatttgccactttgattatatttataagttttttcccctgtacagattctttggtgaactttaagctctgagttctttgtaaaagatttgcatcaaccaaaaaataatttagggtttcactcttgtatggattcggtagtgaactttaaggtctgtgttccgtataaaagacttgccacattcattacatttgtaaggcttctgtcctgtatggattctgtagtgaacttgaagtttgtaggactgtgtaaaagatttctcacactcattacatttgtaaggtttctctcctgtatgaattcgttggtgaactttaaggtctgagttctggataaaagatttgccacactcagtacatttgtaaggtttctctcctgtatggattctgtagtgaactttaaggtctgtgttccgtataaaagacttgccacattcattacatttgtaaggcttctgtcctgtatggattctgtagtgaacttgaagtttgtaggactgtgtaaaagatttctcacacgcattacatttgtaaggtttctctcctgtatgagttatgtagtgaactttaagcactttcttccatgtaaaagatttgccacatttgttacatttgtaaggcttctctcctgtatggattctgtagtgaacttgaagttgtgagttctgtgtaaatgattttccacattcattacatttgtaaggtttctcacctgtgtggattctgtagtgaacttgaagctgtgagttttgtgtaaacgatttcccacattcagaacatttgtgaggtttctctcctgtatgaattctgtagtgaacttgaagctgtgcgttctgtgtgaacgatttcccacattcagaacatttgtgaggtttctctcctgtatgaattctgtagtgaactttaagcacattgttccgtgtaaaagatttgccacattcattacatttgtaaggcttctctcctgtatggattctgtagtgaactttaagctctgcgttctgtgtaaaagatttaccacattttttacatttgtaaggtttctctcctgtgtggattctgtagtgaacttgaagttttgaggactgtgaaaatgattttccagagttactatatttatgaattatttctcctgtacagttttcatggtaaactttaagacttgaggaacaggtaaataattttccacattcgttacatttgtaatgtgcctcttgggtagaagctctataataagcttgacgatttgaggattggataaatgatttctcatacttattacattcatttgctttatgtgttatcttta

SEQ ID NO: 1901 - DNA, 1000 bp, mus musculus
ttaaggtgtgagctgtccagaggttcaaatggatgggtacacctgagtggcaggctggcactgaaagagagggaaactaggcggacgagagagagatggaaccaagactgtattctgatcaaggctgaactgtttaatggcggacactctttataaaggaggggggaggcacatttcagccaactcattcttggagcccaggtgctggtgaccaggtgcaggatagggcgtaatctctggaatagacctggggcctctcagcaggtagcagtatattgaagaggaacagagacattggctgaacaatagagtgatctagggaggaaggctccaccctagataatctccttagtggcagcaaggtcaagttctggttcagcctgcttcaggcttgtgggaggctacattaaggtcctccatcttcatcatgagaagtgactttagatccatatcttgcttttctgatgtgatggtgtattcaggacttgctatggtgggagaggttggttctaatgacaccaagtaacattgatttttgttgtttctattcttatgcttgcctcctgccatctgattgtctccagtgcttgctgccctcaatatatctgattgaagcccatccttcttataatcccagttgattctggactcctcagagtccaactttctctgtgaacctgagattctggctatgtcagagttcttggcagttaagcttcctctgagaccctgagatcctgatgtgaccaagctcctgttatcctgggatcctgatatcctgggcatgttacagtgcctggaagtggtgtctcctctgtgggccgtggggctttctgatatgcttgaaaccaaagtataccagcacccatcagaaggaactcaagctgctggtcaggcagggctcccgtctccttgctcctgctgtcacaggcccatcaaaattgttttggaactgatgttgtgttctactcaacaaagatcctaagatcgtgtggagagt

SEQ ID NO: 1902 - DNA, 1000 bp, mus musculus
aggaaggaagaaagaaagaaagaaagaaagaaagaaagaaagaaagaaagaaagaaagaaagaaagaaagagggaaaaacaacaacaaaacaatatacagttaagaaatatttttgccgtttctttctctccctcctccttcctcctccactctctccaattttttaaaactccagtcattatctccctcccagtcctccttctgactgttcctcatcccatacctcctccactgtctccaagaggatatctccccctgactagacctcccaacttcctggggcctcaaatctttcaagggtttgatgctgctgcactcactgaggccagaccaggcagtcctctgctgtatatgtgtcaggggcttcatagcagctggtgtatgctgtctggttggtggctcactgtcttagagatctcggaggtccatattgattgagactgcaggttttcgtatgtagtcacccttttcagctttttccagcgtgtacctaattcaaccactgtggtccccagcttctgtccatttgttgagtataagtatttgcatctgactcagatgctttttgggcctctgggaggtagggtagggcagcaatgctaggttcctgtctgtaagcacaagataacattaattttgtcaggaattgaagcttccctttgagctggattccaatttgggcctgtcactggacttcctttcccacaggctcttctccatttttgtccctaaagttcttttagacaaaatatggttctgggtcagacttactaactgagagattgcaatccaatcactctacttgatgtcctgtatttctactggaggtcgactttacaagtgccctctccccactgtaggacatttgatttaaggtccctctctttgagtcctgagagtctctcacctcccaggtctcatacattctagagggtccccatacctcctaactcccaagtttggctgtttctactcttgctggccctcagagatttagtt

SEQ ID NO: 1903 - DNA, 1000 bp, mus musculus
aaagaccatcatatatgtgaatgcatacagactgatacagcatgcactgaacctggatagatttctaccagttaatgccctagtgctgaaaacagaagtgatgaaaaaattcccattcctaactcatatcttctactgggaactacttgcaaataaacatttggttctatccaagagaaccccacagagaaaatgaacgactgcatgcccaggagtatatgaaaaacattaaacattaaagaactcaacaataaatttggagctttcttgcctcataagataatatcatgtcttcccccaacccctgccaccaataatttcattttctactcaacgttgtgtcatgtgtaattcccagagcttccatatggataaatgccaagggactccggtggagccagcttgtgaggcagtaatgccaaaaagctgctcatgagaaatgaatttctaggactcttctcctggaagtctgacgaaagtcagctctccaggttgggtcagtttgacaggcgtaaagcctggaagctgttcttgaggatagaagttccatgaaaattcccctcccggaggtttggcgattactcctaacccataataatcaaatttccaccgccttagtctaatgtatagattcacgtacactctattaagcattaccttatagtaaatgccttttaagtttgtattctaacatagctaaagccttttcccagtgttcttagattccagatagcagcaaggggtttaacctattcattaactaatttagctctaccataaaacaattaagcactagccataaattcagttgtctacagaaagattctgaaattctcactgagataaaaaattattacagactacattccatgccaagagcaaattaatatactatactgaataatgggaattctccagacatagataagaattaacaaggcctaagaattccaaggttcatgacactactttattcctgaagccaggcaagagtttatac

SEQ ID NO: 1904 - DNA, 1000 bp, mus musculus
ctactggtcagaaaaattgaccatattaaatttggatagaaataattactgtcaatataaacaaatgtgtatgcacactagttttaccccaatgcacactgacacacaaaaattgtcagctaatgcaatgagatatttatatattgttagtcattaccttcaatatctgggttatatgattacataggagtttttttctagtagggacactagcagctagctcttccttacctcatcctgatgggcaaaagtcccagtgtcatataaaggatgaaaggtgacattcttctgctcctccttataaaggcagtgtcttacttcttccagcacagactcgggagaaactccagagcctcttccaagatgctggtggtcctgtttacagtggccctgctggccctgagctctgctcaggaaccccgtgaaggtatgagaatatgggggtgggtactatgactcttcttaaataacaggatacaacagtgtaggggaagagagaaatggaacaaaggactggagatgagatatgaatgaggccacatagtatttttagtttttaaaaatatagacttgaatttgaagacaatgtggtagataaaattaactatatatgacattagccttgctttactgttcaacaaaagaagacaagagaaaaaatataagagccatttggaggatagcaactgaagtaattaactgaaactattatgcagaaaaataataacagcttttaaatttcatttttctgcactcattcattattccaatatattatcagtgcccgtgtaatagtttacacacacacacacacacacacacacacacacacacactcacatatatatatatatatatatatatatatatatatatatatatatatatatatatatatatatcttctctttaagaagacagaaaggtagaagatttaaataaggaagagttcaatattttaaattacatagagatagaaaattgatggatgaaagataaa

SEQ ID NO: 1905 - DNA, 1400 bp, mus musculus
tggagattcctcagaaaattgaaaatagatctacctgaagacccagctattcccaaaagatgccccagcatgccacagggggacatgttccactatgttcatagtggccttatttgtgatagccagaagctggaaacaacccatatgtcccacgatagaagaatggatacagaaaatgtggttcatttacacaatggaatactacacagctattaagaatgagaacatcctgagtgttgcaggcaaatgacaaatcctgagtgaggtaactcagacccaaaaggaaatgcatggtatgtactcactaataagtggatattagccaaaacaaagaaaaaacaaaacaaaacaaaaaacaaacaaaaaacaaaaaggaaaaagaaaaattccattcagaatatacaagattcagtccacagaattcaaaaggctcaacaagctggagtgctaaaatgaacatgcctcagtcccacttgagagagagaagaaagcaatcacaagtggggaggtagggaagaagagagagagggacttgggagggaatgtgaacctagtgcagaggacagtggggagaagaggaaacctgatctggtattgggagagggaaaaggactgaagccctaaaggccagcagaaagaatgtaaacaggcaacctcagtaaataggaggttgggggaccccccagagtgcaccagagatctgagaagtgaaagactcccaggactcattgggaggaacctttgatgaaatgcctgacagtagggagagagaaatatggagcccacctccagcaggaagacaggacatcaagtgagggatggggttgcagtaccacagccacacctctgacccatgattatttctgtctgaaggaatttcagggatcgaggtggagaggagcctgaggaaaggaaggtccagcaacagtcccagggtgggatccagctcaaagggaagtcccagggcctgacattattactgaggctatggaatgttctcagaaagggatctgtcatgactgccctccgaaagactcaacaatcagctgaaagagtcagatgcagttgtttgcacccaaccaattgacaaataaaattaaacttaaaaaaagttagctcccagtaaacagaaacacattatacctgcaagacagattgctaaggagtaaggtccacaaaaaatctcatgccgaacaatagacagccaccacaatctctaaaaccagagaagaaacagaaaccatcaaacaaaatgcccattcaacaacaatgaaaacaatatacagcttctagaactaaaattttaacaatcccagatgtctagataccaacataaaacaagatcaataacagtcaagacaatatttctacactagagcccagctatcctacaatgaagg

SEQ ID NO: 1906 - DNA, 1400 bp, mus musculus
cagggttgttgtatttgtttctttctgttgtagtcatgtttctcaattctcattacttctgtggaatcttaaaattggaaaccacatggcacagtaatgacctctagaaaacacagtaccaaagtgtggatactttgttccttcttaaaatggggaacaaaatacccatcaaaggggttacagagataaagttcccagctgagaggaaaggaaggacggtccagagactctcccaccaggggattcatccaattaactaccacaaaacccagacactattgcatatgccagcaagattttgctgacaggatcctaatatctatctcttttgaggctatgccagagcctggcaaatacaaaagtggatgctcacaatcatcaatttgatggtacaaaggacccacaaagaaggagctagagaatgtacccaaagagctaaaggggtctgcaaccctataggaggaacaaaaatataaactaaccagtatccccacaaagcttgtgtctctagttgcatatgtagcagaagatggccaagtcagccatcaatgggaggagaggcccttggtcttgtgaagattatattccccagtgcaggggaatgacagggccaggaatcaggagtgggtgggttggagagcattgtggtgggagggtataggggacttttggagaggaaattaggaaaggggatagcatttgaaatgtaaatgaagaaaatatttaataaaagaaaaaagaaaagaaaagaaaagctccccagggagagtcttaagcagccatgaggggattccgtccttagcagaagtactttgaacagtaattttaaagggcctgtgaaataattgaggaggtgagaatctcagtctgaaatttgattctgagtagaaaaatggtaacacagttgaggcagtgctcacacaatatattgcaatatttcagcattacggattatttgtcatcatttcacaagttctaatatcctgctgtggcacagttaggagtcatcaaaacatgacttttcagccagctatgcaaatgaacagaagaaccagagtaatcagttactgggaacccttcccaaccttatcagaatggaagacaccccctctctctttcagttccttaatctctccctccttcccccttcttctctccttccctccctccccatctctatccatgcctcctgtcctgcatttgtatatttatgttagaaaagaagtctccttctaaacagaaacattctcagaaattaatggcttttaccccaaaatctgtgctgcagctagaaacacgttaaatatatattttctcgtccaagttcttattttgttaacttcacatttttgtatttgttagtgtactttcttttcactatgaagatttacatttttcta

SEQ ID NO: 1907 - DNA, 1000 bp, mus musculus
atagttttgcttacccactcttctgtaatctgatttctgtttccattgaaatcagaggtgatatttttctttcatgatacagcacactctgcactcagtgttgacactgaaggaagtcagggaatgcatctgagtggaatgacatttagcagaagctaccactgtgttggaggacaaggtcaagactggcttcctcctggacttcttcttccaggagtacacagtatgaaacatagagctttattctttgttatgctgtttctctctctgtttcccaatgaagccttcttaagacgacaaatgaaaaccactcaggacattctctttgccaatttagtatcaggagaaatcatacggtccacatgctttcgatagtaaaaacccccaggaccaagcactgtctctttctcccataaaccccttaagtgtagagagaagtattgacttagaactggagtagatttgccaacttctagaatcttcactttagaacacactcatgcgcatctggtcggcaccagcactgaagcaccttgggctcagagtctgcagacacccccaaggtctccacaggactctccacgggatctcaggacctctggtgagtggagcacaacttctgccaggaggcaggttcaaacaccagatatctgggtacctgccctacaagagaagagcttgcctgcatagagtactctgtccactgaaactcaggagagaactagtctccaaggtctgctgatagaggctaacaaaatcacctgaagaacaagctctaaccaaagacaactataacagctaactccagagattaccagatggtgaaaggcaaacgtaagaatcttactaacagaaatcaagacactcaccatcatcagaacgcagcactcccaccccatccattcctgggcaccccaacacacccgaaaagctaggcacatatttaaaagcgtattgcatgatgatggtagaggacatcaaaaggactttaataactcac

SEQ ID NO: 1908 - DNA, 1000 bp, mus musculus
tgtcattttaattggctgtatctaggttcagaggatctcacattgattgtaatatattctaagagacacaaagccattgtgcagtacagtctacgaacaatcatagactgccatatgggcctcatgcctgccaacaatcttaagcctcggagtcctgccatagttggttattgcccaatccaggaaagtcatgagccagtggcaagatggagttggagactttacattcctttgtaagcctcagactgaatctctgcagcccccatccttctctctcagcagagatactcagaacatttgtgatctggttgtctagtgggcatagccttatgccttagttgcagtgaactaaactgggttgttgggcccatggctggttagtgtgcactcctgctccctatgtgctgtagacaggcctcccttcttcctagcagtatctcttctgtaagcacagaccttctttttaaaggttttaaagcactacttgttttccagcctcttgtttttttaaagatattgaactcaaaaattattttgtcttgggggagtgtttgggctttctggtttgtacttgggacttttctcagatcagtttagatcctatgcctaaattgagtgacatttagatgttaagcctggttcttcctttcagacttgtactaccagaattaaaactcaggctccaaacacattcacaaataccttggtcataaatgtagctaggctattctctgactaaattataacttatataacacatttattctaatctacatcctgccatatggctggttaccagtctgcatttaccacccatctgtctcatcacaccttctcaggtgaatctcccagtgatttactctatctcagaattctatctgctttccagatgtcccacatcttattgtaccatttcatttagaccttaagggttttaattgaaagttgatttatccacaaaatgcacaagatattcccactataatgtgtaaatatgtgt

SEQ ID NO: 1909 - DNA, 1000 bp, mus musculus
ctcatcttaaaaattctgcttgatggatggaagaagagtcaggccagaaagggaaggctgaggtcaccagcagagtctgtactctgtaccggttgggccccttctctccactgtcagcctggccgggggtgaagctgctggcccagagatgaaagcggacatgtgccagtgaataagcaagtgtctgaggaatccaaggccaaaggaagcaaaatactccattgttccccgcatctcccccttggcgcctcccccatacccccctcctctgcccactctcctaggccagctcacaagtgtctgtgggggctggtggactccccatcatgggcttcctcccaggaaatttcctgtggtggaaactctggggaaacttcctgttgggtaggttcctgcctgcgactgataaggggaactgcttaaaacccccgccagccacagctgctgttaaagggtggcatggtctttctgtttcctcagtctgaaggaacaagaaagggcaagtaagcagaggcctctgaagtctcccctggctagaatattctggaagctgaaagttccacttggaatccgcaagttccttcagagagttggtgctcattgaaacatgcacttttgagtatggggctctacaaaccttctaaaaaaaaacccaggtctgagtgtttccatatcatttccaagccttcctcttagtcttcactgtcatgcatcttcgagtttcagtgatagtgtacagggaattttaattagtcctcgccaattacagatacagtcgatgatgtgaacaaagtggttcacatgataccaatgtgtgaatcgtctgaggtacgctctgtacgacagtctttagcctagcacagaattctcagtaggcttcatgattctgcgacctggcctggacttgtagttgcttattgtgttgtttgccagcccttaggcaaagataattatccctaaaccatcccatagggttaagctcagctctgaatatttcaat

SEQ ID NO: 1910 - DNA, 1000 bp, mus musculus
cctatttcccagacagctgtttgtacagctttggtacatagctgtcccattctgcctggtaacacgtgccggccaccggggctcccaggtgatacttcttgcggaaggctgcagttttgaacttcccacgatggtctccagaccggttggtgaggatgggttcgtcacatctcagtggcttgtcctgctggtacaccagccagacatagcgatggaggccagtgcccttgggaggtccggaacccacgtaatccgagaggacgttcccactgctgatgtcattgcctttcatgttgaccaccagaaaatggtgccattccctgtacacgggtttcttcctactgggagcatccgggtctgtgaggatcaaggtgtagagtttccctgtgtcaaggccatcccatgaaatgcttccgggtctgtgcttaacctgggtgggcgtcagcacttggcccagctcttccacctccgcctcggtgtaggtgacccgcagtaggtgctggggctgctcatccacttcgtggaggctcagcggcccggtccacatgctcatgtctgtaggcatggtgagaggctggagtggcggttgggtgctgctgaaggcgcgtgctgcgctgagaactggccgtgaccacacaagctctgcagccgcgggagcacacagttttgtatttttatatacctcaatgaatgactcccaaagttcaaatttttttttagtgctaaaattaaaatatcaagaacaaatttttacaaaaaattatgaaaaccatagtttgaaaagtacaagatattgttgaacaggatctaaataaataaagagaaatcactccatgtttgtgggtaagacttgggaattaacaagacattaatatcctctaactaagatagtgtgtagattcaatgaaagtcctgtccaaatcgcagcatctttgtagaaactgctgagtttagaatttgtaaagatggatttgcaaggagccagaatagtcaaagctat

SEQ ID NO: 1911 - DNA, 1400 bp, mus musculus
attactccagacttctaaccagagactatgaaagctagaagatcctgggcagatgttatacagacccaaagagatcacaaatgaaagaaatgaagaaagaaagagagagagagaaagagagagagagagagagagagagagagagagagagagagagagagagagagagagggagggagggagggagggagggagggagggagaggttgggatgagagggaaaggaaggaaaggggagaggaggagaggggaggggaggggagaggaggagaggggaggggaggggagaggaggggaggggaggggaaggctggaccaggtgtggtaggtatacagctttaatcccacatcaatcaccagtgaaaagagtgccccacaggctgcctggagaatagtctgatggggatattttctccattgaggctccctcatctcagatgactgtagtttttgccaagttgtcagaaatctaaccaggacagtggtacacatctgtaatctcagtgttcaggagagagaggcaggaggatcagttgagcagtaaatgtaaggccagtctcatgacaccgactcagaaaacaagaacaaataaacaacagcacaaccctttacaaccctcctgcctctgcctcagaagtgtggtctttgtcttaagagcaacaggaagaaagtccttgggatttaggaagataaatgagcaccgtggttcctgttctattcctaggaagagacaccatgaccaaggcagctcttgtaagaaaaaataataaaattaaaataaagcccttaattggggctgacttacagtttcagaggtcattacattatttcagcatggaagcaggtgaagagaggacgacgaggaagaggagaaggagaagaagggagagactggcctggtatgggcttttgaaaaatcaaaacctactgcaagtgacacaccacctccaacaaggtcacaccctctcagccacaaatcctaatctttctcaaatagtgccaggccctaatgacaaagcttcaagtatatgaatctgtggaagccattcttaatcaaaccaccacagtgactaatcagattttcattttaagagacaatttgagatggctcagcacttaagagcccttgctactcttcaagaggtccccggtccaaggccttgaacccacacagtcactcacagctgtcttaaactgcagttctggctgatccgacaccctcacacaaacatatgtgcaggaaaaacactaatgcatataaaattaaaaataaattatttttttaaaaagaatttgagccgggtgtggtgatgcacacctttaatcccagcacctggctgggagtccgaggccagcctggtctacaaagtgagtttcaggacagccagggctatacagag

SEQ ID NO: 1912 - DNA, 1000 bp, mus musculus
ctcttctttaaaggctggggagactccgcgaatgcgacggcagcgctcagcccctgacctcaaagagagtggggcagctgtgtgagtcccacatgatgggcagacagggcctagtggggcccttgttagatggaaggtgcccactgcttccccaagaagccctggggcagggaggccagaaagcagagagcaagagagagggaaggtccgagtaggtggtagaagatgccagagagtgtgctggaggctgagggaaggaagagggcgcggagttgccaggagcaaaccaaagtcaaagagggtccgtaggaagttgtcttggggctacccattgcaggggggaatcccacaaacgctgccatgggtgggtaggtgggctggggtctgcatagccagtgtttgactttctttttgagtgggtgcaacggggagagaaccgagagtgaggtgggttctcctccccagctcttgtctgtccgtctatccgtctgtctgtggtggatttctgtttccagggaggtgtggtgggatcctaagtcattcccttccccttccaggcctcctgctatatttaggggacctgtctggtttggctggggtcccacaaaaatgtggggcctcttaataaaggatagcaaacaaacaaacaaaaaggctggggagagttatcattagggacgtttgttcatgttctcagtattaattaaagtaatcactttcaggcccattaacatgatcatctggggatgaggagatggtattgtgagtaaaccttttccctgcaagtgttaggatgggagctcagattcctaacaccaacacaaatgtcaggcagccacagtgtagcctgctgtaatcccagcatggggaggcagagatagcctggagtaggtggccagctggcctattgagatctacagactctggtacagattctggtctctggtgagagaccctccctccatataataggtaggaaagtcaaggaagatacctgcca

SEQ ID NO: 1913 - DNA, 1400 bp, mus musculus
gtttaaaaattatagatgtaaaatcaagctaaatttaaaacgtctattatcattccatgcacatacaggtacacatatacatatgtatacaaaaagtctttctttggcacccaaaaatagacatctcaattttcatcaaaaggaaaaacaaatcagtggggatatgaaatatggcactcaatctaaacttccgggttagaatattttttcctgatgatatgtaaagttttctgcctacagcatgtttattttacaagctgtattctgaaatgtcaggaaaccagactctattagcatagctgctgttattttagagagacaattttagtgtatctcagatcagaaaaggcaccaggtgctggaaagcaggacattccgactcatcctaacctgccgtgaactcagctgggacgaacgcctggccttatcagagccacgcatctctttgctgtctatgcagtagaaggagggaccggcaagcaaacacttgatatttctgtagcatttcaaaaaggggaacgtgtgatgtgaattcacaaaaaaaccacccggttactcttgcaaccagcaacacgcacgtcaaattaggaggcaacagggagcacaattggagaaggggggggaagaagaatcccttcgtgtccttggatctgtttccttatcctcattgtctccaaagggatacaagaagaactgatcaaatttgtgtgcactgatttcaatactatctttttgaaatatccccatctatccatctatgcatctatccatcatctatctatctatctatctatctatctatctatctatctatctatctatctatctatctatctatctatctaactatctaactatctaactatctaactatctatctatctttttttgaggggtggaggttgaggcaggctgtcatgtgttccaaggtggtcttgagctctctatgtagctgaggatgaccttggccttctgattgatcctcttgcctgaacttcccctgtgctggggttatagattacacccaggtgcttggtctcatgctgtgctggggcttgaactcaaggcttcccccatgccaggcaagcactctgccaactcaaccacatctccagtccttcttatttttataacgggcacacaatgttagtacaggaaagacaggtggcaattctgagcgcacctagtgctgacaagaagggaagatgtttctttgcatgtaacactaatattgcgcgtggaagatggtcttgcttctgcagtagatgatgcttttctaacagggctgatttaagagaaaaagggaaattatatccaataaagaaacattaaggattatgcttcaaaccagaatatcagatttttttttaaccctgcggagcttcccagtgcatattatt

SEQ ID NO: 1914 - DNA, 1400 bp, mus musculus; identical to SEQ ID NO: 1913

SEQ ID NO: 1915 - DNA, 1800 bp, mus musculus
aaagatgcaaagttacaggtgaagtgacatctaaatactgcaccggcacagtttcagttagcaggtaaggttagcgggataaaatccacaagaaagccttttggaaatctggggcttgcagtatttatgtctcacttctaaggtggcccaaatataaggcaatcctgagtttcaagagtgtcccccaccccagattgccacagatactaaaaccatcaaaacacaccccacacatgatgttaaaactaaattgtcactcaaaacaacacaccaacgactgaccaaggtgccttcccaggaagacaacttaacacctgtggaagggacccttgggctttgtggctgttactcagggttatgactcatcccagcagatggtgtaaaggtggaagggggtgctgggaaggtgggagggggagggggactcaaagagagctagagagtgttgctagatacagaggggagggaagcatcagggagagcatgggggaagagatgggaggtggataagtgactgccacaaaggtaagcaggagaggaagtggtttctgatcctcccagcatctcctcggaaagcattggtgtgtcattacaaacccacaagatagttctcttatatttgggccaagagatatctaaagcaatccaaacatagcaaacatcaccaaaagttccacttagcacacaccaaagacacttaatatatatgttttgttccctagacaagcatgtcctttgcgcttcacttcgtgatggcttaatgaaatcgtgtcagtgttccaaaagcgccagaatttcaatgattgtttttttttccccaaaacctatgccaacggaaagtgctacaggctctgagtgccacaatgtgattcattctgcctgcttccataaaaacaagaacagctagtgtttttctctctgtggaataatacagtgagacgctcagaacatggtggcagtgtcacaggcaagcctggagccaggctcaccaagtattcgagtcccggttcatccaacccctgctgctgtagaaggcaacagtaccatcggacctcactcaacaacaggtcaaaagcgtagaccgaatggaagctttgaaagccatgtagagccattctcatggtctgtgccataaattatctttacttgcgtaccccctctcccctcagtcttctcagcctgcttcatgcctccaatctctgaccagagaagggagagagggccagatcctccaatcagtgtgactcattctgaaagtcactgagtcaggactgacccttgaccttatgctctaagtccctccccaacacctctgctcctctctgcctactgctaagcacctgctctctgctatcgcactcctgtgctggactcttcctgttggaggcacagaccaatgactcgcaacacacctcaagacctagaaggcttccttgaacacagttcacttggagccttttcttcacgccccaaggaggcccaggttccaatctgatgagaaatcttggcccagggctgttcccaggaatcaccactaaactccacagccctcccagtgttgctaggatagacccacgtttgtataatgctgtcacttcccgagtcccatcaccgtctctcacaaacgccaagctcctctgtacacaaagcatcctgtgtcgttctctgagaagactcagaatgtctctgcctcttaagaaatgcactttcctactaagtcagtcttctttaggagccaaaactgggtaaaacctctcgagcactgaagcgatggagactaacacacctgactgctgtgca

SEQ ID NO: 1916 - DNA, 1400 bp, mus musculus
agcccctgtgccaagcacttaaattgtgttattttacttaattcttaccaacttaaagaggccattaaaaccgcttattgccattctaatggttgtgggacttataaaagttatttataaaattttaaaatgacttggccatgatgccaatagttatcccataagagggctgccccaagttatgcttttaagtgctattaaatactagtattttgttttcactaatggccaatccagtactagggcttaagcaatgccaacagcaaaaagttaaagtcaaaatgaccttggtaaatcagtactcaatattcatccagcattgatcagcaccagccaacccaagccctaacccattcactcatcagatgtgcccgtctgagttctacagccgcctgaggttgttgctgggaactgaactcttgttctctgcaagagcaacaggtgctcttaacgccgagccttctcccagcctgtgttgttgtggggtggtggcagtggctgttttagaaggcagagcctcattctatagctcaggctatcctggaattcactaggttggtcttgaactctcaacgtgtctcctctcttagtctcctgagtgctgtgattacccggggtaaagtacaatgacgggctcagagttgaagaatccgttacatcagaaccactcagcacagagctgagcgctcacgatgtagaaagccaagattccccaggaactggccattatatttttattaaatcagcttaaatgtaaacataaattgctaatgtgattaatgcctcccatgaaggatagggcagttctatacatttattctataggagacaaaacagatatgattcctgctgtggtttaggtaagtgttccctaaagactgtgtgtatatacaccaccggcctttggtactattggcggggctttgaggtctcatatagatgctcaaatctggccagtgtgatccaaagcatcctcctggctgcctttggatcaaggtgtagaactcttggctcttccttccatgatgataatggactgaacctctgaaactgtaagccagctgccgttaaatgtttactttcataagagttactttggccatgctgtcccttcacagcaatgaaaccctaacaaaacacatggaaatagtcatttcctgccacaggtgtctgtggggaaactgatgggagactacatcaccttggtgggtgatcttgatttagaatcacctaggagacgtgcctctcgctgtatttgtgggggcatttctaaagaggcttacctaaggctgaatgacccatcctgaactcaggtggcaatattccatggactagggtccccaactaaacaaaaggaagagagtgtgctgagaaccagcatgtctcttgtctgcttccta

SEQ ID NO: 1917 - DNA, 1200 bp, mus musculus
ctgatgcaagccctgtggtatgggacaaaagcccaccttcccagtctgcacttggcgctgcccctgagaagctacagtttaatatttcatgactgagttcatcacagatttatgctttctatattctctcccttaaacaatattaacttctataagaacttctttctgaaaacataactgaacagggttgttgacactggaatatgtttatagaaaatctcttaggaggactgcccaacctgcagaaagtctcctctgtcgccacgtgtgctgctgtcggctcaaggcttcatgcgatttggttgtttgccattcctcaacaatggctacaagtgccctactgctgagctagctgtctgtgtgttactgaggcagggaaccacttcgctccattcgtgacactgctccgggacagtggtcagattcatagggaggcttctggttgctctgcggcagtggtcaagttcacagggaggctccctgttgcttccttggctcctttctccatgctattcgtggtgcctcctgcttgtgtgatctatctgaagaaagccccagtgtggcttggcagcttgtgggtatagatttgtccactcttttggatggttatactcctaggacaggcgaatccagggcatcatgagattactatacatgggacctgttcttttcttttgctttttcttggatattttctttacttacatttcaaatgttatcccccttcccagtcccaccccctgcccccagggaaaccccctatcccatcccccctccccctgcttctctgagggtgttcctccacccacccacccactcccacctccccgccctccattcctctacactgggacatctatccagccttcatatgaccaaggacctctcatcccattgatgtctgacaaggccatcctctgctacatatatgcagatagagccatgtgtactccttggttgatggcttagtccctgggggttctgcggggtctggttggttgatattgtggtacctcctatggggttgcaaaccccttcaactccttcagtcctttctctaactcctctattagggaccccatgctcagtccaatggttcgccgagagcacctgtctctgtatttgtaaggctcttgcagggcaattggatggaactagaaaataccatcccgagtgaaagaacaaaaagaacacacatgt

SEQ ID NO: 1918 - DNA, 1400 bp, mus musculus
ctccttgaatgcgttggcacaggagacaacgttctgaatgacatggataatgcagacatcaagatcaataattaacaaatgggtcaacataaaactgaaaagcttctgtaagacaaagccaccatcaattagacagtgtagcctcctgtaaaatgagaaaagttaaaaataagacaaaacaaaataaatcctctgatagaggagaaatatccaaaatatataaagaactcaattaactaaatatcaaacaacctaatttttaaaaataatcaagtacaaatctaaatagaattctcaaaagaggagactcaaatggctgagaaacactcccacccatctcaaaaaaatttaacccacaattgtctcagtctaaaggaaatgcaagaacaaagagagtggagcagacaccaaaggaacggccatccagagactggggattaattccatctgaagataccaaaccccaacaccatttattgctgatgccaagaggtacttgctgacaggagcctgatatggctgtcccttgagactctctggcaggacctgactaatacagatacggatgctggcagccaaccatcagactgagcaggggaaccccaatagaagagttaggggaaggattgaaggagctaaaggggattgcaaccccataggaagaacaacaaatcaagtaactgtacccctcagagcttctagggactaaactaccaaccaaagagtccacagagagagacccatggctccagctccttatgtagcaaagggatgccttatctggcatcaatggaaggggaggcccttggttctatggaggctcaatgccccagacttggaggatgctagggtggtgaggtggaagtgagtaggtggatgtgaacgtaccttcatagaggcagggggatgggatagggtgggggagtttgtgaaggggaaaccaggaagggacagaatatttgaaatggaaataaacaaaataaccaagaaaaaaagaaaaaaaagttcaatatccttctcaatcacagaaatgcaaatcaaagcaactctgatattccatcttatacttgttagcatggctactgtgattagtgttgtgagctaatttgcctctctctaagtcaactgtaacattcttttccagtaagcagtcccctgtctccactagaacttagggggtgattactaccctcaatgcaccatgttcccgtatgatctcttccaagctggaatgtgtcgtagctttaccatcagagctcataagtttcaataaagtgtgagattaagtcacttttgtaaagatctgagattaaactgccttcacctattcttgctggcagataaatacaagatcacttcattatttacttgatgagttcataattcttgcaaattttccc

SEQ ID NO: 1919 - DNA, 1400 bp, mus musculus
ctgtgaatcaagtagcaattggccttagccatctcatgaaagtgtagtagttttgtttttcattttctttgatactaagggatattcagagggttgcgattgacaggaatgtttgtcttatgcaggaaatagtaaaataagcaaagtaataattctttgaatttaaaacaggacttcctgggattacataaaatatcttgctataggaaaaaaaaggtttatttgatatctaccaaatttcttgaagtatctattgagtaaaacaattattgacttcagtgtatatttctatagaagaaaaaataaaaaaatctaaaattcatatctaagtttggaatctatgaagacttcattataaaaggcattgcattttaacttgattagatatttacttgacatttagtatggttctaaaagttggcgttgtatatgaacctcaaatggtatcatcaaaaacctgggtgttttccttcagcgtcactaacctataaggaagatggaggtcaacagtcaatgctattggacccatccaaatatttaagttgtcaaggttgtgggaaagcagccaaggacaaactcaacactcctctccttagccactgtctggcttagaatcttcattgtaactgaaagagatgtgttgtctatgagctaatgagtcggcactttctaactttacaccatcaccagctacttcagcacaacacaaagaaataagattagactatctgagaataggtgatgagcagcactcaaagattcagagttccccacaggtcactggcagcatccttcttctcaggcatgccatcctttgaggcttgcattctggagatttctaagacacttgctaaagagatcagactgagtaaatccaaacttaaagtgtatatattaccaatcttacgaattaagaagcattttttaggactggagagatggctcagtggtcaagagctgcttttccacaggtcccgagtttaattcccagcaaccacatggtggcacataaccatctgtaatgggatctgatgccctcttctggtgtgcctgaagacagctgcagtgtgatcctatatgtaaaataaataaataattctttttaaaaaagaagcattttttagacttgtgtttgaaaacttggcagcaccaaacatactctccaaataaatttaatttgtcatacaaatccattcagactgatgacattttaaacatctttagatgaaaactgaagtaaggaaacttagcagtgcaacattacaaacacaataatgtgttctaattataaactttctgaagcttaggaattaattcaaatgagtgcttctaacttacctgctcatatctcacatcaatgtataacaaagtatacatgtattggcatgtattctaaattc

SEQ ID NO: 1920 - DNA, 1000 bp, mus musculus
aatttcataaatatagttgctaaatgtttgttaggggcatgctgcagggtagatagggatggactgatttttacacagtgcttattagttgaaatgatactggtttaaaattctataacctctggtttggagtaaggtatcttctatcattcattgtccccatccctcaccccatgaacactctccaccccactcctgccccatgaatactttccaccccacacccctcgaactctctccattcagaagtaactgttggtcttttaacagcaacaacataagagacatgccactgatgcattatgataccgacctgctgcaaatataactttagtatgtccaatggaacaaggggcctacttgtcacaaactttatactgaggtcctggatcgggagcccctacgaccctgtcccctatgttctttattatgagatggtaggaaatctcggacttcctttgatgaaggaaaagttagcgcctttttgttttacatattttaggaaaaaataaataagacacaattttcagatgctggtcctgatgcaaccaccaccaccaccacctcctcctcctcctccttttgtctcctcctcttcctccacttcctccactgcctcctccacctcctcctcttcctccacttcttcctattcctccactctgtcctctttctccttctccacctcctcctcttcaacttccccttcaccctcctcacctcctcctccacctcctcctcttcctcctccttcacctcatccttatcttctttttcctatttgtcttccttctcttcttcctcctttccctccctcctcttctccatcttcctcatctttctccttcaccattacagtgacatgtttttgttccttctcctctgttcttcctcctcctcttcctttgttcttcctttctttcttcttttttatcttctccctgcttcttcatacagagtccatagtggcccaggctggtctctacttactttgtgccca

SEQ ID NO: 1921 - DNA, 1200 bp, mus musculus
cagacataactcacaacaaacaagcaaacaacacaaaacaacaaaaccagtggcttattcttcccaagtgggcaccacttcctaaagtttgcagaaaacttcctttatagcataacgagatagagacctagtactgaacacaggaccacatttaaactgtgtcatttttatgtgacctgtttgtctctacagccagcaattccatcacatcgctactattcggtataaactgagccaagttgcctattaatattgaaacttaatctaactttaaagtcaaactattacatcatttgtgtgcttttcctgtttatccctgacttctctctcacagatgtctgcttcatttcttttcctcacccaacagtggttccacctacgtatgcacttttaacttgtgactgcttttcttttagtttcttttttatatatatactttttattaggtattttcctcatttacatttccaatgctatcccaaaagtcccccataccctcccacccactcccctacccacccattcccacttttcggccctgccgttcccctgtactggggcatataaagtttgcgagtccaatgggcctctctttccagtgatggccgactaggacatcttttgatacatatgcagctagagtcaagagctcaggggtactggttagttcataatgttgctccacctatagagttgcagatccctttagctccttgggtactttctctagctcctccattgggggccctgtgatccatccaatagctgactgcgagcatccacttctgtgtttgctaggccccggcatattcttttagtttcttaaacagtaaaagtaagtaaataaataaagaatgctgaaaggtaacttccccatacttccccccacatcatctttataaactctatgtcacatgttacacttctgctcccacgagtttgtgtatgtcagttgctgggagctactgtaaagaaacacctgacactgggtattttcgtgtgtatagtgattcttttgaatgtctgaagccagaagcccaggttgccagtggctagggcctgggctatttgcttctgagagatgtgtgaaaaaatcatttccatctctatcgccaaagagaaaaacaaaacagtgtttaagaaatttcttacttttttttttttacagttttcaaagtaccaaaagagcccactgagcta

SEQ ID NO: 1922 - DNA, 1000 bp, mus musculus
caggttcaattcccagaatccatgtagtagctcacaactatctgtaactctagtcccaggggttccaatggcctcctctggcttctgtgagcatcggatacttgccggtattgcatagatatacatataggcaatgcacccatacacataaaatagtagaattttaaaaattaaaacaaaacaaatgagccacaagaggactggcaacccccaggctcgaggtatacgacttgctggagccacaggttcagctgcagaggcaccagcgtaactaacttctcgctcgtcgcagtacaggaacgtacacacctggcttgagacttaagacgccagtgagacatggagaagtatgtacacgaaacagatggagcgtgcttcagaacttgcatagtgtgcaagtggatcaaaaaagcccaaggaatgcgatgtagaatcctcatttttttgtacttcggggccactgagatgttgtagttcccccttttctgaatgaatcctctctgcttgctgtttctgtctatgtccagttccttgtttgctcagggatgtgaattgaatatgcttggcccatgggaagtggcactattaggagatgtggctgcgttggagtaggtgtggccttcttggagtaggtgtggcctcgttggagtaggtgtggccttgttggaggaagtgcatcactgtgtaggtggccttttatgtcaggtgctcaagctccacccagtatggaagagagggccttctcctggctatctacagaagccagtctcctggctgccttcgtatcaagatgtagaactctcagttcctccagcgccatgtctgcctgcatgctgccatgcttactgacataacgataacggactgaacctctgaaaccgtaagctagcctcaattaatattggcttggtcatggtgttgcttcacagcaaaagcactcaagctgagacaccggctgttagctgatgtcacaaaaggactcccacaccctgagcacagg

SEQ ID NO: 1923 - DNA, 1000 bp, mus musculus
catcacagtcttagaagaacttgctctgtatattatcattagatgcacatctaagagggtgaaacagcacttgcctcagtaatattagtaagtagacacagactttggtcactgctgttgaaattgtggctctgtcatattgaattgtgtatgcagcaggcatattgctcggccactcagactttcattcccatggcacacacttgaagtctgtagagctattagctcatgtcacgcgtgtagtgaggagatagaagttatactaccagtttcatttaaggagatgacttagagcagctgcttctggaaatgtaggtacaacctagggctgttcagagggagagtcctcacctggtgtcctaggtcctaggtgcagttctcagcgctgtgggtaagacacgaaagaggaacagctgcctgccctggtaagtttataggttagtcggaacattttcataattacagatatgtggactttacctttctatgggtacagtgaatacctgaagcaagtattcaatgagccaagtcttgagtactgagtagaggttataaggtatagagggactcaacaggttttcctaggagactacacagcgtacgcagtgtctggtggaagacagccatgctttggggcactgggtatctgacagcaggcagcatggttgagcagaggcggtgggaaatagagctgttgagagtgggccgaaatgcttcaggacctaatttttcttgctaaagactgcaggatgaaccctgaaggaagctactaaaagtttagtcatggaagtgtgctttactttgttttgaagtgatgtttcatgcgttctgcagataatgaattaaaaggggccaaggctagggccgtgtccaaatatttgcacagagttgtggcttctttttattgtcctgttgttcccaggagctatttaatagctctttgagtgttcaaggaagaataaataatggcttaatcagtaagtgcagtagaccagcagcc

SEQ ID NO: 1924 - DNA, 1000 bp, mus musculus
aaacagagaattcagctttttataaaaaaaaaataaaataaaagcttggcttgttctttttaaaatctgttataccttaacctaaaatattgaatgaaaactttatcatctgtctttttattacttatctttaatttttggaaaaatagaatcaagtgaaccaagagataaaggatatatccaaactgtgctctagtccttctatgcaaatgcagatgaggagaagtgggctctggctttgaccatggatgtctacccattcatgtcattgaacatttcttcctatcctttcaaggcaatgagagactcacaataaccaccagctggagcctccttgaagcatattgcgggcatgctgatttgcatattaggcattaaaatgcagttcagtttctgcaaaactatgcagtgtcaattttttaagtgttactttgccagatcacaacatcaacccagaccaggatacctgaccattgttcccattagaatgattatgtaacatctccaaatacaagaaaatagcatactgaaacatctcaaaattttgaattattgtttttagcattgctactgtatggcgcacacatcttatagtcaagccatttgctcttttaaagaaagctttagttagagtgatgtatgacattattgaacacttatttgcatattctagttaagagctttaaaatcatgttgaacaggaaacagtgtatcaataaccccttaacaggtcaaatttaattatatcatttttgtaaaggattatggttttgttttgttttgttttttcaaggcagggtttctctgtgtagccctggctgtcctggaactcacgctgtagaccaggttggcctcgaactcagagatccgcctgtgcctgcctctgcctcccaagtgctgggatttaaggcgtgcgccaccactgctcagcaaggatcacatttttttattttccgactgaaagccgtgttaggaactttatttaaccgtcagtctagaa

SEQ ID NO: 1925 - DNA, 1000 bp, mus musculus
ctaaaaattaaaaggtggaatttgcttctaaaatgaaaaagaaaacaaacctttgggtctcaaaataatcttcctactgactgattctttataatatatttaaactaaacaaatattaggtcatttgatgttgctgggagtgttttctggacccaatccttctgattggtatctgtgcctgtaagtggaccctgagctccagccctccccaacccaatcatacccagaaacagcttgatccctaggatttctgacatgcccaggctcacaggctcaccggacgggcaggctccagtcagagacagcaaggtcagctaataccagagatgaccagatggttagaagcaagcacaaaaacataatcaacagagagcaatgctacttggcatcaccagaacaaaattttcccaccacagcaagccctggataccccaacacacctgaaaagcaagattctgatctaaaatcccatttcatgatgatgataaaggactttaagaagacataaataatcccttaagaaatacaggagtacgcaggtgtactggctagttttgtgtcaacttgacacaggctggagttatcccagagaaaggagcttgagttggggaaatgcctccacaagatccagctgtaaggcattttctcaattaatgatcaaggagggaggtccccttgtgggtggtgccatctctgtcctggtagtctggggttctataagagagcaggctgagaaagccaggggaaggcaagccagtaaagagcatccctccatagcctctgcatcagctcctgcttcctggcctgcttgagttccagccctaacatcctttggtgattaacagcaagttggaaggtgtaagctgaataaacaatttcctccccaacttgcttcttggtcatgatgttttgtccaggaatagaaaccctgactaagacaacaggtaaacaggtagaagtccttaaagaggaaacaaatgaatcaaaaaaaaaaaaaaaa

SEQ ID NO: 1926 - DNA, 1000 bp, mus musculus
atcagatcctctggaagtggaatttcagatggttgtgagccacctatgggtgcaggaacagaacctaggttctctgtaagagcagtaagtgctcttagctgccgagacagctggccagcccctcagagcactggtttaagaatgagctggtaggcagacagtcctcagctcagtacctgctcagggtgagatttcatctacactgttggtagtccctgaaaatgtcagtctccctgtgatgcacaggaaattgttgagagcggctgaacacttggtgtccagtgcctgcaaaatcaatgtgggaataaacagctgactgctaaattattgttagggcaatgctgactacaaatataatgtctgtccctgccttcggtttagccacttctaactcatgggatggagtcaggaaggaaggaagggagccaagaagtatcagtagagagtgtctgtggaaaatcagagccatccataagagagaggccatttctaagctgcagtctggcagctctgacagtccagagtctaaaaacagagaaagcctttggggggttgctgagcaaagtgacgggttcctgtgctgggctcttgcctctcacgttctgagagcacacacaccctcatttcccatcctgaaactctggccccaagaacctcctctacctggcagcacaggtctcctcaggaaagcagtcacctagctgttctgaccagttctgagaacgactcacagtagggatcttggagcaaccagagtcctacatctttgaagtctctgtgggacctcaggggacgcttcccctgcaaggatctagctacaatgcagactctctcagttcctcagcccttggcttggattgcagctctgagagaaacactcctcaggattgggtggagagaaaactctcgctgaatgtcgatggtaaataaccaaccaagctttaaaatacttgctctagccaggggtgatggcacaagcctttaacccagctctcagaag

SEQ ID NO: 1927 - DNA, 1000 bp, mus musculus
tccagcgcaggtcagggcaagcacaggctgtctctgtatctggaaggagccttcctgctgactttactctggtgtcttagttacttttccgttactgtgctaaacacccggatcaaggtagcttataaatgaccatgtttaatctggcttatgttttcaaagggcagtagtccatgatggcagcgtaagctgctgagagctcacatcttgatctgccaagtaggatgcagagagaactcactgggaatggtgctgcctttttaaatctcgaagcccaccccaagtgacacacctcctccaacaaggccacaccccctaatccttcccaaatagttctactaccttgtgaccaagtactcagtcaatacatgagcctctggggtccattctcagtcaaacccccagacatggttagattgaataggatattgtctcaaaaaaaaagcaaaataaatttgcattattttaagctacttttatggcaccgagtctgtaggagtttgcaataaatttaccactaggggagctaggcatggtggcacccgcttgtgttctcaatacttggtagctagcggcagagggctcagagttaaaggacagcttcagctacagagcaagtctgagaccagcttgaactgcgaaaatttacatcttaaaaaaatccatatgcatacacatttacattcatgtacatgaacataacatatgctgaagcctgtctcagtggatgaggaattgaggaaggatgacctcgggacacacaaagggacacgtcagttagaaaacccactctaggcgcaccagcgctctgacttctgaatcacttcttgctcccagcatctttcagcacgatagagctcgcctctaagtggatgtggccaagttcttccattttccaccccgcccccttggagcagggtggggttgggtgggatgggatgggacagggcaccaatgttttcttatttcctcccagatcctggtagaaactccaggcaag

SEQ ID NO: 1928 - DNA, 1600 bp, mus musculus
aggtttgtgcgtgagtgcagtaccttgcagagaccagaagagggtgctgaatcctctggagcagagttagacgcagcagtgagcctcccagtatggtgctggtccctgctggcagagcaggaattgctcttaagcactaaggatctctgtatctcttaaatataatttaaatgttccgttccctcttcagggttagctgcaatcccagatagcaggtataagcagcatgacagtgaggagatcattactgcgagcgtttccagccttaccacaatcagcttgcaaagttccccagaggttgtgttcaccaaccgcgtcagaccttcgccctggacttcaccctgtgaatcactgtcaagtctttcccctctatctggattcaaaataaaccactgtcgccagaaattctcagggacagatggcttgcttcagcttctgggtctcgggagagaggggcgtgggggggggggggggatgttgccggcaggagcattgcataaggcaacatcacccaagcagcagttgcagcaacaatggataaggagcctgcctctaagttcggccaacaacaatgtggtctatccccagacctgaggtatgggttgggcatgcctctcaccatgatcagcttgggaaaaaatgcttttcaactttcttatcaaacaaactgatcactataattgaatacaccttttatgtgttttgtgaattctagatcacagttccgtaaactgtggatcatgatggggtcatgcaactgagtttagggcattatgaaaaaaaaatctgacatgaaaaataaagggtttgaacaccccggggacccaaaattcaaaatcaaaggtggctgctttctctgaggtggttctggctgctcaccgtactgcagccttggcttgctctgcactgagcacacttcgtagctcacagatcctgatccctgtcccagcttatgaggggagacaatttgggacttcctcccaggaggctgtgcgtcttcacagagcagtccaaccacggatcctccatgatgctcagacagagaagaaaatgtgggtgcaggcaattcatccatggggtaaacaagtccgggagtggtactgtttgaggaatcatgactatagcatgatagttaccctaaagcctgcactggagagctggccttttcatggctatgtctcccagatgtactcccataaacacaatgttgaaagagaagactccctacagtttcagacacacccgctctgctcccaaataaaaggttctgcaaactcctccaaggtctcctttcccaaccaggaggaagggagggagggagggagggagggagggagggagggagggagggagggagggagggagggagggagcaacacactgcatacatgggttcaggggacaacttgtgggagctctctccttccaccagcctgctttcagggattaaatcaggtcagggctggctttacctgctgagctatgtgctcagccaaatgaggttttactccatgccttcctgctctgctcttcccatgtgtgtggcttttccacgccgctttcttctattgcagtaactattaccaacaccctagctctg

SEQ ID NO: 1929 - DNA, 1400 bp, mus musculus
gctattgggtattaatacaatttcacaaacaggaacaataagtgtgagtacatcagaaatgtttcaggcgggcactgctggggcagaactcagaactcccagttggagattccttttacccacgtgcggattctgtgtgctgggagagctcaggttcgccactgtgagagcaaagcagggccacggtctgcaaaatggccacaggttcatcttcattgttagcaggcttagaatgagcgtggaaacagatttcttcaggggtgtgttagggtgtttcaggcgatgcttactggaaaggaaaagaaccccctgagtgtggcccatgccatctcatgggctggggtcccacacttagcaagaaagagaaagaaagccttcttctctttttcctggccatgggtgcaattgacagaccatgtcaatcccctaccccacagcttccctggaatgacagactatatccctgggaactgtgagcccaataaactcttctctctttaagttgcttctggtagcacaggatcactctgtacatgtggaggtgaaaggacaaactgtgggaatccattctctcattctaccacatgggtcctgggataaaactcaggttctttaaaaagaactgctgctgccaaccaccaacgccgctgccgcggccactgctgccaccgccgccgttgccaccgctgcattttacttatctttttggctgtgtgtcacatatgcagtgcccatggaagccagaagagtatcagatgtcctggaactggagttagagatggttgtaagtctttatgtggatgctgggaatttaacttgggttgtctttccagagcagccagtgttcttaaccaccaagatgaagctcagactcttaagttgggtagcaagcctttagggtcatctcattggccccacactgacctttaaaggccccagtgtcttggaaagtctacttatcaggtaccataactagctcctgaaagttgggtaatctggggatatgtggctgaggccaagggcacagggttggccttttggtggaagcagccaagcttcatgtgtttgaaagctgctattgggcccagagaggaaggggcagttgaccaggcctctaattcttcaattggcaaaaggttaaggtggctacctttctcccggcatgggtggagagtgagtctggtctgatgtcaccatacacaagggaacccattatggtgccttgatgtctactccccttgacctactgtgcccagtctatgaggggtagtggtctcccagctcctctttggacgtacaatatcctggatgcattcccaactcatacctgatctctgagcagggatgttctttccctggacctcctcacaaagctgctgtttcatccccttaaatcactg

SEQ ID NO: 1930 - DNA, 1000 bp, mus musculus
agaaagtaaacaattcagaagcttcaaaaagttcctaaaactgacaagactcactaggcccctctctcttcaagtgtatatgagcagtaaggacccctaagagatactcttagacaactcagttacctggaagcagctcagatcaattgaactgcctggaaaaaacaaacaaaacaaaacaaaaacctctccagctatcgatatgcccataggctgtgcagtgcactccaggtatccaccttttgtgagctgtcacccatgctggggtgggctttggtaatgtagctgtctttgagtcatttctgctcctgtgagtaactcctcaaccatacttctataagaaccccagtgaaactcattggttcaccacgttggacttagtggtttcctttctttgaagtgtgagtcactggtttcctatttgattagatgcttgttcatgactcctcaggaacaatgttgcatgagacctggaactggagtgcatggtgtgggtacaggagctgaacttgggtcctctgcaagagcagtattcactttgacctgctgagccatctctccatcccctgtgacatggattatctgtaagactcagtttgagagaacaagggagaaattccaagaggactggagcaggccaggttctgccatgtccgtcagggacagccaccaggctcagctcagcctgcaaaatcaccaggcagcaaggcaaccattgtcaggtgtcagccaaaagggtggaaggagctagcagcaaccttgcagggaagggacaataccacaaagaaccaagacagaacacagaacagcccacatagaacaaagccaccagcttacaagccacatcctgtcaggtgagacctaaaagacctcagtagttaaccgaatggtttgcttaaaatttggtaattggatcaaattttcacctgggaagaattcaaatcggctgcttcttggccacctgggagacagagcttccttaagaatcagagcagttgct

SEQ ID NO: 1931 - DNA, 1400 bp, mus musculus
gctaagtcatatgacttgcacctgacttcctcatataagacacaaacatcttgagtgctgcgcaggtgtaccaggatacaggtgaatccaatttggtggagatttgcccctgctgccctgattagctgaagctgcgtacctggtgaggtggcgtggcctgctgtgcgtggatgggaactgagagtataaaagagtgagaggcccgggttagagggaggattattattcgagagaggattgttattattgggagatataaacgagggagagatataaacaagggggagatataaacaagggagatataaacaagggagagatataaacaggggagatatagagaaagaagaaacaggactgaataaacgtgtgcagaaggatcctgctgtggcgtggttcttgctggcgagttgggggcgcgctcgagagttggtgccgaaacccgggaccggacaagaaacatcttcaggcacaagtgaagaacccctgctacagggaggattcagaactgcatcacggggaaggagtggttaataaagtgttcctgtaaaacagactgttgagaaggatccggcgtggattcagaactcttcagctggggaacggtactgatgaagagaaagaagaaagatgaagacggaataaactgctgttagaaggactggtggtcgtgtcgttcttgctggtcgagagcggacgcgacaattggtggcccgtacggggaaccgactcccccaccgagttcagaactttcagcagtcagtggttgccggcagggtaagttcacggtgagtgaaacttgcgaccccaggagtttgggaaggacctcggataaaatagaggcaagtataaagttgccaggaagcaggcacaaagtaactcagtatcccgggattgggattaggctctcggtaaagagacagtaaggctctcggtaaagagacaaataggctctctggctctggagacaaggaagtgaaagtaagagagaaagtgaaagtaagaggataatagggacaagttaaggttcctggctttgggacaagttaaggttcccggtttggggacaagttaaggaactatgataacctcagtgtagtgatcaatagatcctcgctgtgtagttatgcttttttctcccattgaccctttgtgggtaggtctgatagttttggtcttgtttgttctgatatatggactctgttactgtttgaatcaagaggcagtcaagacaggtcagaaaatccttatagagcaacaagaaagtatgtcggaagagaagggcttaaaaagaaaaaggaaaaagaaaggagacacagtgttatcaggtggacagaaaggacaaaataaaagagctgaggcggaggaggaaggcgaattagcttctgcgtcctctccct

SEQ ID NO: 1932 - DNA, 1000 bp, mus musculus
agaagggcgtgtttccgcttgctcctccgccatggctcgtggtcccaagaaacacctgaagcgtgtggcggccccacgccactggatgctggacaaactgaccggtgtgttcgcgccccgtccgtctgccggcccgcaccgcctgcgggagtgcctgccgctcgccatcttcctgaggaacaggctcaagtacgccctgaccggcgacgaggtgaagaagatctgcatgcagcggctcattaaggtcgacggcaaggtcagaaccgatgtggcctacccagctggcttcatggatgtcatcagcatcgacaagagcggcgagaacttccgcctcgtctacgacaccaagggccgcttcgcggtacaccgcatcacgcccgaggaggccaagtacaagctgtgcaaggtgaggaaagtcttcgtgggtaccaagggcatcccgcacctcgtcacgcacgacgcgcgtaccatccgctaccctgacccgctcatcaaggtcaacgacaccgtgcagatctcgctagacagcggaaaaatcaccgatgccatcaagtttgataccggcaacctgtgcatggtaaccggaggcgccaacctgggtcgcatcggcgtcatcaccaaccgcgagcgccaccccggctcctttgacgtggtccacgtgaaagatgccaacggcaatggcttcgctacccgcctctccaacatcttcgtgatcgggaagggcaacaagccgtggatctcccttccccggggaaaaggaatccgcctcaccattgccgaagagagagacaagaggctggcggccaagcagagcgggtgaagtggactctgagggacattgcggggaaggggcgtttacgtttgtttatacttaaaagttttttaagcagcatgttgaattaaaaaagaaagcaagcttctttctggttgcatatgtttcttcctgtgccatgatgggggaaccacccagatgggtgttcacctcattttgaaaaagaaa

SEQ ID NO: 1933 - DNA, 1000 bp, mus musculus; identical to SEQ ID NO: 1932

SEQ ID NO: 1934 - DNA, 1000 bp, mus musculus
cggctggctcagtccctgcggctggctcagtccctgcggctggctcagtccctgcggctggctcagtccctgcggctggatctctcagctgctcttcagtacatgctgaagtcctgaaggagcaggctctcatgccatgagggactggccttgccagcagagggatggaagcagacaaagagaacctcttgcttctcccacatcctttccccaggctgcaccagaaggtgtggcccagacttaacgtgggaagagaagatgtgggttaaaggtgagtcttcctactttcaattattttttatttatttatggggggaggatttctttgctttagagattgcggtctaaggcaggcattttaaaaagaactgaagcagaagccacggaggaatgctgcttattggcttgctccctgtgctcttacagcacccaggaccaattaagtaggtatggcaccacctacagtgggctgggccatcccacatcaatcattaattgagcaaataaccccacagtcttgcctacaggccatctgatggaaccagagatggcatcagaatacatggagatttgaaagatgtgtaaagcataagacggtatatgccccttcttgtggctgcatgcctttagtcagagggcagaggcaggcatatctccgagttcaaggccagcatggtctacaaagtgagttccaggacagccagggacacacagagaaaccttgtcttcaaaagcaaaacaaaaaacaaaaaacaaaccaaaacaacaaccaaaaaaatatatatatatttaccaattcccttctttcccagcaacagagaaataactagagtagagaggaaaacaattaaactgtttcctagagagaatgccggggcactcctcctgccattcattctttatactgtcccaggcccatgctggcttatcctaacagccaagaatggggcacttaggtattttagaagaaaataggaacagggaccggcaaagagaaaca

SEQ ID NO: 1935 - DNA, 1400 bp, mus musculus
agtggagaaatctcagaagactataggtacaatgcctgacctgcgcatactcattgtcctaggctgccaggcatgtatgcagggatctgatgttaccactgctagttctgtattcaggatcttgcctcagtatcctttattttcagttttagagcagatcttcacctctcatgtaggatgacaatgtagattaggcacttcggtaaaatttagaattgagattagcttcctagaagctagattggaaaaatgaatccctcttgatagcatgaaatgtttctattgtttctttttttattagatctttttaatttacatttcaaatgttattccctttcctgattttgccttttaaaaccccctatctcctccccccctccccctgctcaccaaccattccactctggcttcctagcctgcacattcccctaaactgggaccaagggcctctcctcccattgatgaccaacaaagccattatctactacatacgcagatggagccatgagtctcaccatgtgtactttggttggtggtttagtctctgggagctctgggggtactggctagttcatatttgctgttcctactatgggactgcaaagaacatcagctctttgggtcctttttctagcttctccattgggacgttgtgcgcagtctaatggttgactgagagcatccacctctttatttgtcaagcataagcagagcctctcaagagacatacacacagagagacagagagagacacacagagagagagagagagacagggagagagagaaggagagaaagggaacataactacaaatatagagcttatgaaattccttggtttagatgatcagttgatgagctgatgacatgggagaacaggtattcatcattgctgccaagcctagaaacctgaatatcttccttggaatgcacatagtagagagaacaatcctcccacaaagtgctctgttcttcatgtttgtgtgtgtatgtgcatccatgaacccatagtatttctttacaaaatgacttttaagaccatagtgaaatctaatgtggaggaatcctgcagatttctattagtaatctctcatggcaccttgcatgttacactacttcaacacaccctgaaacctgccagtgtagatgttcactgagagactgtggtatgcatcaccaccctgaagatcagcaatattttgatgtattgcattctgcaattcctaaggtgagacaaagcctcatctcatagagaggtaggtaggattcgctgtcagggaataaaggctgaattcagtcaatttgatacaaagagaactgtacaaagaatttgtgaaaccaagagcctgtgtgttcattaaaatcaacaaggtagacaaatgcttagccaaactaactga

SEQ ID NO: 1936 - DNA, 1400 bp, mus musculus
gctcttcactttgtaagctgagagctgtgactctccaaagaggggcttcaagctgctgggtccccctgctggtctgtcccctgacgtgggcctagatgggactggggagagctgagaagtatggtccttgctgccagcctcagactgccaacggaaagaggaagaggaggaagcagacgggctggaagccttccacttgtacttgctgggagagaggccaggcttggatggtgtggccagtttctccggcctcacctctgggtcaactttaggctgtggcttctctgtctttccaactgtacccaaagtggccttgttccccctctccagagttgttctgggactgagggctctccgagcgacccgtgggctcttttctgaggcagctacccatttgtagttgtttttccgaaacttgctggttcgacaggacacgagcagtgaggcctccctgacctgcctggctgttgctggtctgactgaagccaccactggccccaaggaagctggctggtctgagtggccagtgtttgctctttggtctccaatgaactgttcagaatagctggtagaatgagggcctaccttcctgcccagagccacagcagtgtgatggggcaggacagatgggaagtgtaccctgagggccacttcattttcactgactgtccgccgatgctcgggagagctgtcactcaccctgcccacagacttcactacccgaggcttgccaggctccttctggcagaccaagagggggtcgtccacactgtaacccaccttggttcttcctggccttgcaggctgcagttgtccaccagggacctcaacctcacttccttggggtctttggccactccaagaggggtcatcacagccttccaaggacccccgctggacccctgaagcattgatggcacctgactttgatggtggcttgatcttaataaccatattctgatctggactgagctggacctgtctctccagtacatactgctggggttcaggatgctggctatcctcagacctgagggatgtctgaaaagcaggatcgctggctgggtcagaagattccacaggctgattcacaagggagtatttcttgcgccacgaagggccatggtgtgaggagaagcccctccgacttggacgggagtagcgggcgccaaaggtcctgccacccgggaacacgggtggctgccaccgagtagctgatgagttgcccagggcagggccattgccgtggagtgttttatagtcatcaattagacctgagaaggcagaatcacacgctcagttaccctgcaggaggcgtatctgccgccgcagctgctccttttcctccatctccggagtccgccggtcctatggtttttatgaacagattctgccagaga

SEQ ID NO: 1937 - DNA, 1200 bp, mus musculus
acctggagggcatcatcctgagtgaggtaacccaatcacaaaagaactcacacaatatgtactcactgataagtggatattagcccaaaacctaggattcccaagatataaggtagaagaaggaaggagaagggagggaggcagggggagaaccaggatagggggacagactgacgcagagacccgagctgcgcgggccatggcagaggccaggcaggccgggatggaagcaaacagggaagcttggagagagacagacagacagacccaggggcgacgaggcacacagggaagccgggacggggcctcgcggtcggaagcggactcgggcttggtccccggggagaaggaacgagggagaaggagggagaaggaaggagaaggaaggagaaggaaggagaagggagaaccgggggctgcgggactcgtggaagccgggatgggtccctcgatggcggacgccgacgccaggcagccccgggtggaagggaggaggaggaggaggagagagagacttagagtcagacagagggacagagagagagacttagacacagagacagagagacagagagaggctctgtccctgcactcctacaggtacaacctggagcagcggacgcggacctgaacccccgtctgcccggggacgccgccgccacggccacaccgctcgtctggaaccacggctggccttcgggtcccagatccgtccccacgaggcagagaaccgggggtgcacttgcgcgtttttcgccaccgggtggccccggagatcggcgctgggccctagacgcactacagctcccatgagcgcctgggcccgacttcctgtccaaaatggaggcacttcctgtatctcacaaagtacaacctcccggggattgaccgatggaaaacgcgaccgcctcgcggggtcggatccaccagcctggccggcttcccctcaccctggccgggatgaagcaggcacatccgaccccttggaggaagttttttccggcgtgctctctgtcgccacctggtggtgacagagaagaatgcggtcatcgtgaccgttcgattttccttttttcaaatgacacttgtttttggtttttgatactttttaaaagaatctacgtgcacattcatttttcttttattatcattgatggctcaccactctttgcatatgtgtgaacccagaatatgtcaacc

SEQ ID NO: 1938 - DNA, 1600 bp, mus musculus
cacgaggcaggggctttgactgtgacaaaatcactcacagtcatccccctgcctcacacagtcactcgcggtcaaccccctgcctcaggaaatcactcagtgtcatccccctgcctcagacagtcactcgcggtcatccccttgcctcataaactcactcagtgtcatccccctgcctcagaaaatcactgcccgcctacttggcaccgccgcccgctgcagccgccctgccctcggccacttcgctgcccgcctcggcctccggctacgaggcgctgtgtgtccttcactctgtcccctgcgcgctgacctaaacccgcacgaggccgcgcctcgcctctacttgctcactcagcgtcatccccctgtctccgtgttcagcttggctgaaatgacttaaatgccttcctcatccgggacagttttgttgttgttgttgttgttgttgttgttgttgttttgttttcaagagagctgtgtttctctaggcacagaactcaggcgtggtgcttctaaatgccaccaaacaggcagtttagaccatttaaacaaaatgtgtgtctgtgattccgtttctctccagtctctgtcccctcctcgtagctttcccctttcagactccgaccccttggaggacttccggatcggaggtttttcccggcgtgctctctgccgccacccggtggtgaccgaggagaatgcggccgtcgtgaggattccattgtcttctttcaaatgacgtcaccaccgggaggctcgatggcggccgcgctgcagacgggaggggccgggggtccagacggtccgtgtggattcacgtgtcccgtctgtctcgctttccccagggcgggacccctcccccacccccaaatcactcgccgtgaggaccaaaggccacagggatcatccccctgcctcacacattcattcgtggtcatccccctgcctcagaaactcactcacagtcatccccctgcctcacacagcatcatgcccctgcctcacacactcactaagcgtcatgcccctgcctcagaaacacactcacagtcatccccctgcctcaaaaacacactcacagtcatccccctgcctctgactcccgagtgctgggattaaagaccaccaccatgccctgccctgcctcagaaacttacagtcaaccccctgcctcacacagcatcatgcccctgcctcacacactcactcagcgccatccccctgcctcagaaacacactcacagtcatccccctgcctcagaaactttttttggttttttgagacagggtttcgctgtgtagccctggctgtcctggagctcactctgtagaccaggctggccttgaactcagaaatccccctgcctctgactcccaagtgcagggattaatgatgtccaggcaccaccatgccctgccctgcctcagaaacttacagtcaaccccctgcctcactcagcgtcatccccctgcctcagaaacacacccacagtcatccccctgcctcagacagtcacttagcgtcattcccctgcctcacagttactcgtggtcctacccgtgcctcacccacagcagtcactcatagtcatccccctgc

SEQ ID NO: 1939 - DNA, 1000 bp, mus musculus
caggtccttaggttcactgagccctttccctcatgtaatgccagtagaggtcactccagggctctttgtcagagctcatgccctcccacaagccttgagaggtacagtccaccagacactgagtcagagggtatagttctagcaatctagcatacagatgtcaaaaaacaaaacaaaacaaaacaaaacaaaacaaaacaaaacaaaaaacaaaatactaaaaacaaaacaaaacaacaacaacaaaaaaaaccaaaaatcaaaacaaaacaaaaccaaaaacaaaaccaaaaccaaaaccaaaaacaaaaacaaaaaataaaaccaaaacaaacaaaaacaaaactacaataatttcgtccaccggtgccctacagtcggagacatgggagtctaccctgttggctcctgacccagatctcagtgctccagaactcaggtatttgggcgatcactaggcactcacctggggcagggctccaccagcagcctccacaatcaccatcaggctccagtggccagccgggccctgggatgtggccatccctcctcgaagcttggattagatcacacgggctgtcgaaaacctcagctctgtctccgtgacagaggaaaaacgcctcaactctaccattttcctgccatgaccaatactgataaaaccagttttctgtgaaccagactgacagatccagaaagtttcaaagaacctcctgcatgcaaatccaaaagtcccgcccagcttccttttgttgtcactaacgcgcctattttcattggctattctcggtgcaatgtcttctggacaatgtagttcagacgtgatcaatcgccaggaagtggacacacctccccagatggagccttacactcaatctgttagggagagtgttgtgattatagatgtgtcaatacttccttgagctacaaaagccggacttgctgaaacactcctgaattacagaactgctggcagaggcaagttgatgtttgggattag

SEQ ID NO: 1940 - DNA, 1400 bp, mus musculus
ctccatcaaagatctgaacaccaccatcacccaccctacaactcccccacccctgctacagcttgcattccaactcaaacatgagtgcacaggatttacccaaggattcacaggtctctgcctacacccaaattacccccaccccaagctaggaaaatgactagatcgaatctctcacctgttcaaaccttcttggccaccagagtctctctaaacaaaagtcaggtccttaggttcactgagccctttccctcatgtaatgccagtagaggtcactccagggctctttgtcagagctcatgccctcccacaagccttgagaggtacagtccaccagacactgagtcaagggtatggttctagcaatctagcatacagatgtcaaaaaacaaaaaacaaacaaaaaaaaaaaaacccaaaacaaacaaacaaacaaacaaagaaacaaaaccaaaaccaaaaccaaaaacaaaaaataaaaccaaaaccaaaccaaaacaaacaaaaacaaaactacaataatttcgtccactggtgccctacagtcggggacatgggagtctaccctgttggctcctgacccagatctcagtgctccagaactcaggtaggtgggcgatcactagacactcacctggggcagggctccacctgcagtctccacaatcaccatcagcctccagtggccagctgggccctgggatgtggccatccctcctcgaagcttggattagatcacacgggctgtcgaaaacctcagctctgtctccgtgacggaggaaaaacacctcaactctaccgttttcctgccatgaccaatactgataaaaccagttttctgtgaaccagactgacagatccagaaaagtttcaaagaacctcctgcatgcaaagccaaaagtcccggcccagcttccttttgttgtcactaacgcgcctattttcattggctattctcggtgcaatgtcttctggacaatgtagttcagatgtgatcaagcgccaggaagtggacacacctccccagatggagccttacactcaatctgttagggagagtgttgtgattatagatgtgtcaatatttccttgagctacaaaagctgaagtgctgaaacactcctaaattacagaactgctggcagaggcaagttgatgtttgggattagaaactagcctgtcacagtgagttccagaccagacagaaaacctctgggaaccttacagagtgaacatttccctaagctgggccatgtgaggagaggagatctgaaaagagaaagaggggcctccaaccaagaaggaccccctgagccaagagactagcacagctaaaagtggctgagttatatagtggtcagaggagctggaaggaggaaagcccaggggatcacctggac

SEQ ID NO: 1941 - DNA, 1000 bp, mus musculus
tagctcaaggaaatattgacacatctataatcacaacactctccctaagagattgagtgtaaggctccatctggggaggtgtgtccacttcctggtgcttgatcacatctgaactacattgtccagaagacattgcaccgagaatagccaatgaaaataggcgcattagtgacaacaaaaggaagctgggccgggacttttggctttgcatgcaggaggttctttgaaacttttctggatctgtcagtctggttcacagaaaactggttttatcagtattggtcatggcaggaaaacggtagagttgaggtgtttttcctccgtcacggagacagagctgaggttttcgacagcccgtgtgatctaatccaagcttcgaggagggatggccacatcccagggcccagctggccactggaggctgatggtgattgtggagactgcaggtggagccctgccccaggtgagtgtctagtgatcgcccacctacctgagttctggagcactgagatctgggtcaggagccaacagggtagactcccatgtccccgactgtagggcaccagtggacgaaattattgtagttttgtttttgtttgttttgttttgttttggttttggttttattttttgtttttggttttggttttggttttggttttgtttctttgtttgtttgtttgtttgttttgggttttttttgttttttgttttttgttttttgacatctgtatgctagattgctagaaccatacccttgactcagtgtctggtggactgtacctctcaaggcttgtgggagggcatgagctctgacaaagagccctggagtgacctctactggcattacatgagggaaagggctcagtgaacctaaggacctgacttttgtttagagagactctggtggccaagaaggtttgaacaggtgagagattcgatctagtcattttcctagcttggggtgggggtaatttgggtgtaggcagagacctgtgaa

SEQ ID NO: 1942 - DNA, 1200 bp, mus musculus
gattatcagcctgttgcagattcatctcgtggagggcatgggctatggcatgcacagcattgtatatgttatgactactctcactaaaggtcatgtcaaacttctgttccattagccaatcaaatgaggcatcagatgaattgttcttcagtattttacagttagatgctgagtcttcatagttaaaatatttccactcttgcattagtagatataaatctgtgtttctgacatggaaccatgtctgtacaaaatttttaaagccagaaatctcaccatggtggggtagaaaagtaagtgatccatagaatgtgccatgatttatgtctgtattactggtagggaaattccattctattgtggtgatccatattctctgtaaagtgggagggtccaacattctgaagatcaagtcaatgaaattgtatgtttctccataaatgataataatatttgttaatgacatcacaatttggctgtagtacatttcagttgtatgtggaagtgaaacgtcatcaacagagatcattttcacaaacgcaaagcaaatttccttgttttcactctgtttcttcaactctaaaagaaattggtttccttgatcgtcatctggaatgacaaggccaatccagttccatttgaagtaaagtatgaaggagaccattgccaatgctagagatgggccttttggggccatctgatagagatagggatattgttcatcatcactgaacacagattggaaaggtccataggtaagcataaggagctacaacacaaggagcagcatgaggtgaggtgcatgtgaaaacacttgtaatcatatttacctgcaaacagttgattacctgttactttttctcatatctctgattcaaattagcaaatgtggaagcctggcacatccacttctaatggaaacagcaagcatagctgtttgacaaagatgtaacaaatgtgttcacatgttataatgactgcctttctgtctttcagttttagtcttgatatctgtgtttcatatgtttgaagggaattttatacttttacaatttggagatatttgattaatattttttaaaaaagacttttatgccataatccataaatacttctaagattgaagaggaaagtcctgtacataatactgatatagcatttggaagagatattcttatattgccctacttgacagtaata

SEQ ID NO: 1943 - DNA, 1200 bp, mus musculus
aaatgataaaacaggctgagaaaaaaattagggaaacaactcacttcacaatagccacaaataacataaaatatcttggataactctaaccaaacaagtgaaagatctgtacaacaataacttcaagactctaaagaaagaaatcaaagaactcagaaagtggatgaattggaagaattaacatagtaaaaatggctaccctaccaacagaaatcttttatcccgacccgtgggacctagttatttggggggtcgaggggaaccaagcctgaaagagaaacgggcgagaaaagggagcaagaccaagcaaattgttgtcaaggtctactttactggaggctggaagcctgattataagcacacagtgagaggaaatagggaggggctgaggggaaatgatcaaagcacagagagggacagacatttggggcagatgctgagtgcaggcttgaaacattttgtggcttatctttgaatgctggttccatccaaacagccccaggtgtctggccaagacaagggtcagttgattctcatgatcagtcttgtgtgaaggagggggtggctcggctcccaacaaagggtcaattgattcttagtgtgggagctgttgaaggtctggtttccctcagtctggtctcccaaaatctttagattcaatacaatctctatcaaaatccctgcacaattcttcaatgacatggacagagcaattctcaaattcatctggaaagacaaaaataaaacaaaacaaaacaaacaaacaaaaaacccagaatagtgaaaacaatacataacaataaaacaatggctgggggatatatcattcatgacctcatgctttactacagaaaattgtgataaaaactgtgcagtattgatacaaagacagacaggttgatcaatgggatagaattgaagacccagaaataaaacaacacatttaagggtacttcatctttgacaaagaagccaaagatatacagtggaaaaaagaaagcatcttcaaaaaatggtgctggtctaactggctgttgatatatagaaaaatgaaaatagacccatattttgtcaccttgcacaaagatcaagtccaaatgaatcaaggatctcaacataaaacctgatacactcaatctaataaaagagaaagtgggaaagagccttaaattcattgacacaggaggaactccaatggct

SEQ ID NO: 1944 - DNA, 1000 bp, mus musculus
tttccttgagcggagccaagtacacacgcccaaatttccccctgcccagaggatgcccaatttcaaagtcattgctggtgaaatgcttcctgaatagatggaagagatggcctcgtctcagagactaggaagagttaggggtccacaacagctccccttcctcattcactgagctcacaacctcagctgtggtcttccatagggaaaatagcattttagatccatgagccaatgctcctcttgccctgcttactagtcacctgagtcccattttctttcttctggaaactttggcaaagcactcacctggttgaggtgctgggctccatctggccagtagctaaggaaagagagaggaaaaacgggtctggtgatgctcaatagcaaccctagtctgtgggaggtagacaaggaggccggagttcaaagtcaccctccactccatagcaactttgaggcccacttagtacacaagagaatcaccctatcagagactgggggagggtggcagagtaagggtatataacagaggggaaagggcatcaagaaagttgtgggggggcatggaagggaaaggaaaaagggagacggagaaaaagaaggactgcaggagaaggagaggtggagagtaagcccaggaaaggaggggagagagttaaatagagggaggagagggggaaaggagagggagagagcaagagggagtgagggaaagggagggtgaggcagagagagaaggttgaagccttcactgccaatgcacacacacacataccgcacccctggctgcggatcccagtgacctgtaactgtccccatcctgctgccttgtcctcctgctttcagggatctttcatatatgtgccaccactttggagtcagtccaggttctcctacctcttacttgagtgtgaagcccagcccgaaagaggtgactcttccctgaactctaaaggggtgagtgcaagttgaagtcctgctagttgcttagatcctggaa

SEQ ID NO: 1945 - DNA, 1200 bp, mus musculus
gtggggcagtctctggttggtcattccttcagtctctactccacactttgtaattcctcccatgggtagtttgctcccccttctaagaaggatggaaatatccacactttggtcttccttctttgttgcgtttcatgtggtttgtgaattgtaccttgggtattctgagcttctgggctaatatccacatatcagagagtatataccatgtgtgtttttttctgattgggttacctcacacaggatactttctatttttatccatttgcctaaaattctcacaaattcatcattttaatagctgagtagtagtgtgtatatgtaccacactttctgtatccatgcttccattgagggacatctgggttctttccagcttctggctattataaataaggctgctatgaacatagtgtagcatgtgtccttattatatgttggagcatcttctgggtatatgcccaggagtggtgttgttattacttgaaattgttttaatttgagacaatctcgttaaattggccgggttggccttgaacggaacttctcctgcttgagcctcctgaatacttaagattgtaggcatgggtgactaggcctggcttcagatccatcaaataacaatgcacacagcgcaggagggttcgggcctgggtaagactgacattatttctgtatggaatgtagattggagtgttgcatgtctggaacgttggcccaaaaccagggcaaatgtaaagctggtaaactgagtgctctagagaggacccccagttttacacatacatcatctctccttatataccaacttcctttcatttaggggttattttatgtgtgtgtacgcatgggtgtgcctctatccatgtgcagaagcacggggactgagtttgatccccagcaccctggtacaagctgggcttactttagtgcttctgtgatcttggcactggggagctggacataggagggtcactgtgttttatttaccagccagtcaagccaacttggtgatttcatgttcagttcagagatttatcctctagaatatgagatgcagagcactagagggagccacctgatatgggattctggcctccacctctatcactcatgtaagacaaacttttcaattcaatctacacactaactcactcaagcaagaaaattgatgctaaagtaatcagttttaattaacat

SEQ ID NO: 1946 - DNA, 1600 bp, mus musculus
tctatcacttgtattctgttgatgatgcttgcatctatgagtcctgatctctatccctagttttctatctccagggtagtctcactttatgacctctttattgtttccctctccatttttcaatcctggatgtgtagtatgcgagcctgaggcctacatgaactgggtatttctggaaggcaggctggggcagaaagagacttagactttgagaaaagattaatgaagccaagacaaatttttctgatcaatgcccgcgagtttactaagagagtgtacttataagggggaaggacccccaccccctcacccccaccccctgccagtccattcttggtgcctggagccattctgtcagcacttgttcatcaggctgttgcttattcaggaatgtctcaggaagacaggttcagcctctctacaggtagcagaagagcagggcagttgtcacttcaaaagaagtcagtcaagtctgaaagctgcaccacaggtggccccacctcggtggcgacaaggtctgtgacagcctgcttcaggctggaggaggctacatggatggttttgttaaattgcttcacctatttgattctgttttcctataattctttaagggatttttgtgtttcctctttaagagcttccagctgtttacctgccttcttctctatttctttaagtgagttatttatgccattaaagtcctctaaagtcatcatgagatgtgattttaaatctgaatcttgcttttccattgtgttggggcatctaggacttacaatggtgggataactgaattctgataatgccaagtagccttgatttctgttgtttaggttcatgcgataatctctttccatctggttatctctggtgttagttggtcttgctatttctgaatggagccatttcttcctgtgagcctgtgatcttaggtgtgtcatcactcctgggagaaaagctctctccagatgggacttgggtatggagagctgtgccacagggtaaactccagtgcacagagcaagactggaaggatcctttccccagtttctccacagttcctgtatcctttggtttcctgacaggtcccactttggccagttattagagaaaaagtgttggtcttgtctgtgaaattaggaatgacagcactcctgggaaacctgctttctctgggcaggatttggtacagagagctgtgccacggggttatcttcagggcacagtagactggaagccttgtgttcttgaatgagttgtgaggattactaaatttactctcaaaatgctttatagacataatcttacattggtaaaaatctctaaattttggcacgaaattgaattatacttccttatattggtgcaaaatttatatactggtacaagtttaaagcttacattggaataaaactgtatattgatacaaaatttaaaattaatggcgttactattagataagcactgtgcctatacaactcattctttaagtaactcaaattctggtcctgtacattagaagattttcactgtactagggactggtgtcaaagcagaggttcatagtgtgtaaatagaattcaggccagcacaggggaaa

SEQ ID NO: 1947 - DNA, 1200 bp, mus musculus
ggccttcaataacaagaacaacaaaataaaaaccaaaagccaatatacacatggaagttgaacaatgccctattcaatgataacttagtcaaggaagaaatacagaaaaaaatttaaaaactttttagaatttaatgaaaatgaaagcacaacatgccccaaattatgggacacaatgaatgcaatgctaagaagaaaaactcatagcactgagtgcctccaaaaagaaaccagaaagagcataaactagttgcttaatagcacacctgaaagctccagaacaaaaagaaacaaatgcactcagtaggagtagatggcaggaaataatcaaactcagggctgaaatcaaccaagtaggaagaaaaaaattacacaaagaattagcaaaaccaggagttggttccttgagaaaatcaacatgatagataaatcattaaccagatggcacagagacactatccaaattaacaaaatcagaaatgaaatgggagatataacaacagaaattgaggaaattaaaaaatcatcggatcctactacaaaagcctatgttcaacaaaactggaaaatctcaaagaaatggacaattttctagacagatacctggtaccaaggttaaatcaggatcacataaaccatctaaaccatcccataactcctaaagcagtagaagcagtcattaaaagtccccccccccgccatccctcccccagaaaaaagcccaggaccagatggcttgttcccaatgaaagagctagagaaaagacccaaggagttgaaggggtttacagccccataggaggaacaacaatgtgaaccaaacagcattcccagaactccaaaggactaaaccaccaaccaaagagtacacatggtgggactcatgatgccagctccatatgcagccgaggatggcctagttggtcatcaatgggaggagaggtccttggtcttgtgaaggctctatgccccagtgtaggggatagtcaggagcaggaagcaggagtgggtgggttggtgagcagggggagagggttggcaataaaaggatttggcttttggtgggaaaccaggaaatcggataacatttgaaatgtaaataaagaaaatatgtaatatattaaagaagaaaacaataaaaaagaagacctaataccaatactcttcaaaatattagaaacagaaggaacactaccttat

SEQ ID NO: 1948 - DNA, 1000 bp, mus musculus
ctgaggagaagggcaaaactgtaggggcgccagctcagttaatctggacccctgagatctgtccaacactggaccacccaccaggttgcatacatcagatgatatgattcccgcaacccacatacagtagaggaattccaggtttgtattcattcagagatgatgcacctaactctagagactggcggccccagggagtttagtggtcaggtggggtggaaggtgggggcatccatgtggagtcaggatggggaggagatttgggatttggagcagtccaagtgtggcctgggagaggctgataaatatggagtgtgaaaacataattaattaattaaaaggaaaaaaaagaaacaaattaagcctgatagatataaaactgaatctcattgtaattttgatttgtatttcccgtccagggccaataccaatgggaatcttttttcttgtctgttgttcttgaggcagaggtgagggaagagcatcaacagagagtaatacttggttttatgagatacaggcataagagtttgtcttacttgaaatttagggttgctgtataataataatgtttacttattgtactggctggttttatgagtcaacttcacacagactggggttatcacagagaaaggagatttagttagggaagtgcctccatgagatccagctgtggggtattttctcagttagtgatcaagggggaaaggccccttttgggtgggaccatacctaggctggcagtcttgggttctataagagcacaggctgggcaaagccagaaaagaacatccatccatggcctctgcatcagctcctacttcctgaactgcttgagttccagtcctgacatccttagtgatgaacagcagtatggaactgtaagctgaataaaccctttcctccccaaattgcttcttggtcatgatgtttgtgcaagaatagaaaccctgactaagacacctatctaagttaccttgctactgtagttgacatg

SEQ ID NO: 1949 - DNA, 1000 bp, mus musculus
gctcaagctctgtactggggtcggagtaaagaagggatgcacatagtgaaagaaaacatctccaaatgaaagtgaaaagaaggaatgtgatcttccctctggtcagcaccagctccaggtcaccttgggctcgaacttggcagacagtcccaaggtccccagaggactcgccactcaatcttaggatcactggtgagtacaacacaacatctgttccaaaccaatcgtgatgagcctgtgacagcaggatcaaggacacaggtcctgaccagcagttagggttccttgtcattggtgctggtatacctgggtttcaaacatgccagacagcctcacggtcctcagagaagacaccacttccaggtgttgtaacacacccaggatcttaggattctatgatcccaggataacaggagcttggtcacacaaggatctcagggtctcagaggaagcataactgccaagaactctgacacaaccagaatctcaggttcagaggagcatagaatcacaggatcacagagaaagctggactctgaggagtcctgaatcaaccaggattataggaaggacaggctccagtcagatatattgaaggcagcaagcacttgaaataatcagatggcaggaggcaagcataagaacaaaagcaccagaaatcaaggttacttggcatcatcagaaccaaactctcccaccatagcaagtcctgaatacaccatcacaccagaaaagcaagatatgaatctaaaggcacttctcattatgatgatggaggactttaagaaggaaataaataacatccctaaagaaatgcaggagccgggcgtggtggcacgcgcctttaatcccagcactcaggaggcagagtcagtcggatttctgagtttgaggccaacctggtctacaaagtgagctccaggacagccagggctatacagagaaaccctgtctcgaaaagacaaaaaacaaaacaaaaacaaacaaacaaacaaaaaat

SEQ ID NO: 1950 - DNA, 1400 bp, mus musculus
cagtgagcgggggagcccctccccatacagaatttcatatggagtgagcttaaattttcccagtgtgttcttaatgcagaacaagacaaaaggaaggagggctgtccagtaattttagctggtctctcaggtcaaattagacaaggtttcttttagagttctattcatcctttctacctgtcctgaactctggggtctataagcacaatgtaatttccaatcaatccccagttggatggccagtccctgatttacctgggcaacaaaggcgagtccattgtcagatcctattaccttaggtattccaaacagtggaaaagtttcttctaggatttccttaacctcaacattggcagtttctttttttgttggataggcctccacccatcctgaaaaaggtatctataaaactaaaagatagatccggccactttcttgaccagaggaaaggggtccacccggtgcgggagcgctttgcctgagcatcagcagcagacatcttggttccaggacccatccaagagtattctgtacaggtgagagtatggaatacagaagctaaaagcttctgggacaggcgggagccacagagcttctaaggaagcccccttttcgaactccagacagctgaccagttacccgggcagaggttagggcccccccccctccctggcgtgggagcgatttgcctgatcatcagcagcagacatcttggttccgggacccagccaagagtattctacataggccccagacatccggccactttcccagccagaggaaagggatctgccaggtgtgggagcgctttgcctgagcatcagcagcagacatcttggttctgggaccccgcctagtgtattctgcacaggtgagagtaagaaatacagaagctaaaagcttcaggaaaggccaaagcaactcagcttccagacaggtcctgttttgggccttcgtcttcagacaggagggaggtcctgaggccagatatctgtgcacatttcctgtaagaggagagcatgcctacagagagtgctctgaccactgaatctcagaggagagagctagtctcccaggtctgctgatagaggctaacagaatcacctgaggaacaagctctaaccagagacaactataccaactagctccagagattaccagatggcaaaaggcaaatgtaagaatcctactaacagaaatcaagaccactcaccatcatcagaacgcagcactcccaccccacctagtcctgggcaccccaacacaaccaaaaagctaaacccggatataaaagcatatctcatgatgatggtagaggacatcaagaaggactttaataactcacttaaaaaatacaggagaacactgctcaagagttaaaagtccttaaagaaaaacag

SEQ ID NO: 1951 - DNA, 1800 bp, mus musculus
gtagtgcgattgtttgaaattcagtttaggtcttaattttttattgttagagtatatgttcattaaataaaaggagaaaatagtacttttaaaattcttttaattcattattttattcatttttccagtccttactcccttagtacccctgacccacagttccacatccaacacatgctgtcagatattttcctctaacatttatgcatgcaaaagcaagaatgcatgtatgcaactgtctttggagttggagtaaaaaaagagtgtaggctctcctgtagtgaaactatagacagtggtgttctcacaggtgtgagcttggaagtcaactctgatcctctgcaagatataaatcatgtggagtaatcactctgagagcacataattcagagtccattggtagaaaatgatactttgtttagtatatatttggggtggctgtggattcatgcaacatagggacccactatcaagtcaactccagttatatgagttcctatgccctctccgtgcttcagaggtcaatacacgcaacaggaaccctcaaatacaggcacatcatgcaatcatatgatagaaaaacaataaatctgataaatactgtgagtaacctccccacagaactatatctcatttcttatgtacaaaataattttgtttattttcagcactaatagctaatatatgtgaatagaggtcagaagaaatttggcagggattattattctctttcatccttgttagtctcaaggctggaacacaaggtcaggcattgtaggaacatgcttgtccacaagagccgagccacctacagggcccttctgcactgctgctctttactttgatactgggtctcactgacctgccaagcctgccttgagttgccttctggcttcctcaacctggagtggctggtctcccagatctgaaacaatacctgacttttctgagtttgaggaataaccccattattcctttttaaaagtttttcttcatttttctttctttatatatttatttatttacactttcgattttatttccctcccaaccccaatcgaccctctgactgtttcacatcccatagctcctccccatcccctgagtctccacaatgatgtccacaccaatcatcctggatccatccagaactctaaactccctgggacctccagtctcttgaggattatgttcatcttctctgactgtacccagaatcaggagtcctctgctacatatgtgttgagggcttcatatgagttggtgtacactgcctgatttgtggtccagtacttgagagatcttggaggtccaggttaattgagattgctggtcctcctacaggttctcctttctcagcttcttccagcttttccctaattcaaccacaggggtcagcagcttctattcattggttgggtgcaaatatctgtatctgactctttcagttgcttgttgggtcttttgtaaggcagtcatgacaggtccttttgtgtgagtgctccatagactcattaatagtgtcaggccttggggcctccccttgagctgtagcctactttgggcctgttgctgaaccttcttttcctcagtctcctcttcatttccatctgtgaaattatgcttagggggagatcagcctgtctcccactctctcttaatgcagcatagtttgcagtgctccaggagttctgctacacccaaggcacataggaggcagggtacagacagagacatctcgaccagccaaacttattgggcacaatgaaagcagtgccaagggaaaaatctgtagcacaa

SEQ ID NO: 1952 - DNA, 1000 bp, mus musculus
aaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagatgccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaggatggaccatgtagagactgccatatccagggatccaccccataatcagcatccaaacgctgacaccattgcatatactagcaagattttatcgaaaggacccagatgtagctgtctcttgtgagactatcccggggcctagcaaacacagaagtggatgctcacagtcagctaatggatggatcacagggctcccaatggaggagctagagaaagtatccaaggagctaaagggatcttcaaccctataggtggaaaaacattatgaactaaccagtacccctgagctc

SEQ ID NO: 1953 - DNA, 1000 bp, mus musculus
catatggttattcctagtgtttgctggcctggttgcctctgtctggatgtagaatgcctcttttgtccctagcctgcttcaggtcacctggtaggccagtggccttgactgcagcacatgtcctgtggtgccttctgactgttgagtcttcacagggacatgcacactggtgacttgttgccctggctacagtggccttttggatgcctttgaactgtgggattttcaaagggacagagaagcttctgatatgttgccctggctgcaggagatatattgggatgccttcagactattcagtcttcagaggattagtcaaggtgttgtcctaactgtagatgttctttgtccatggaggcctaaggagtgtgagttctttttccctatgtgcagcagaactttagggaggctttcagacagttggtacagttactgaagatctgctgggaattcttcagactttggtgtcagttgtccagtttccttgtttgtagaagaaatcctaggatgtgattagtcattggtgtcagtgactgtgttttgagcacattgcctgggagtacttcaggctgtgttttttcaggggggggggggttgccaatgagctggttatcagttgtttggtgtgcagttgaacttctgagatgtctttagcctgtggtgtctttagtagagcagagaagttggtgggagttccctgcatgcaaaggaactcttgggatgccttcaggatgtgttttttcatagaaggggcagactaggtgttggtctgccttagcagaatttgcctgcctgaaagacaggagctaggacatttaaacatagggggagaacaaccaattgtcagcccatctggactaacagtctcttactaacactgctgtttaatgcatatttattgcaatactgaaaatacttgtaagattgggaaacagaggcagttgttcagaaagaatgaaggtcctgattgattcctgctccaaaaggtccacaacacatg

SEQ ID NO: 1954 - DNA, 1400 bp, mus musculus
cctattgtctcttttccaactatatgtctttaccttgtacaacaaacacgtccatcaaaaaatgaagataaaatatttcttcttcataaaaaagataatatattattattattatgattttggcagaagagattgctgttgtcgaattgacaacaaatttaatccctagcacttctctgacactatgatcctatctctttgctgatagtattgttttgagtaccagcatccttccataagttcccaagacccttttataacacttcatggtcctttgggatattagctcatagttgatggatgaactggctttcccatcacagatcatgctttgagcattgttctcaaataacacagagatttttgtttggtgaccttgtattctagatcctgagggaatttattacctttaggatgtttgtttctcagtgataggagctggacaaggctaggagagtcctcttgcaacactaactggatttccattttgactttctgcctcagcctcacagccatgcagatccatcttacctcccatattctttcttttatcctttaaactttggggaggggaagttaagaaaagctttctccttgtagccctggctgtcttggaacttgctctgagacctgcctggtcatgaactcagagatctccctgactctgctgcctaaatgctcatattaaaagcattcacgagcgggggatgttcagaagccctccgtgtaccagtcctgccaggggagatgtctccagggagtgctctgtctctgagactcagggaagatctccattttctctctagtgactgtcaaaggtggaaccaggcaggagtacacaggatgcagaagaggcagagcagccaggactgggtacttcctgcctccatctgcatccaggaggtagggctgtttctcatacctctgatcttgccaggagagagctggtcttccaggagtgttgacacaggtttacacatccaaaggaggaacaaactccagccagagacagcaaaatatctaacaccagagattaccagatggtgaaagtcaaaatcaagaatcttaccaacagaaccaagattacttggcatcatcagaacccagtactcccaccacagtaagtcctagatactccaacacactggaaaaacaaggcttagatttaaaaatcatatctcatgatgctgatagaagattttaagaaggacataaagaactcccttaaagaaataggagaacacaagtaaacaggtagaaacctgtaaagaggaaagacaaaaatcccttaaagaattacaagagaacgcaggtaaaaatgtagaagcacttgtaaaggaaacacagaaatcccttaaagaattacaggaaaacacagacaaacaggtgaaggaaatgaa

SEQ ID NO: 1955 - DNA, 1000 bp, mus musculus
ttcatactacacttttaaaatttcatatatgtacatattattttaaaatttgtcctcctccttttttctccttcccttctttttcctcctccttattctctttctcctttaagaaatcatgttatataacccaggcaaatttgaattcactagttagagatgaccttaaattccagagcttgttgactttatttctcaatatcagaaatggcaggcatggaccaccaagctgtgttgggttcaattaattagttaattaattatttatttacccccatgaatgcaattagagctgtccaaataatagttaaagtaaagccatcaactggagcatggttaacctaccatgtaccataaacttaaataaaactgactcaaccctgagcagcatgctctcctatgggtaccaccattctcttgctgcctttaaacccacctccatcagacctgatactcctgaaccatataggttagcttcccttctcccactcaccttcccagcttgctgagccctctgggacaagtcgaactgagacctgagcaacctgctatcccagggggacctccattctctcaccaccactccttcacctccatcatactcctgaaccattacaggaaaggttcccttgtcccacccatcttccctgctctctgagccctctggtccaagctaagctgctctgagcagcctgcaagcccaggtagacatctattctcttgccaactctctgtccacctttatttgatctgagtttcaagaaccatacaaaactgcagatccagaaccatacagcccaaggatatccagcagttgcctgtcacaccaggaccatcagagttcaccccttccaatacttactacaagaacatccaggtactaaaaacacccagatgactaaagaccctcaaaagaatacaatcaacaaaagtgaaggcaatatgatacctccaaagcacagctatcccactacaaccagccatgggtatcccaatacaa

SEQ ID NO: 1956 - DNA, 1000 bp, mus musculus
cattgtagatgtctgtgagccaccatatggtggctgggaattcaactcaggacctttggaagagcagtcagtgctcttaaccactgagccatctctccagcctgacgacccctttgtttctttagtctgtggctggctgggctctgctgggaacctcctctgtgggggtgcaggagctgagtgacaggtggcaggtgccaccatggagcattggtaccactagttcccatggcttctccctgtagtcttctccaccaggctcccagcctgctcatcacggtcccgttcagcaggaagtgggtgctatgggccattaagggcagggcctggatgtgcacagtgttatccctatggccctgtcagtcggatcagccctgagtgccggccacagacagtgcaggaaacataaactgccatacttgaccacagtgcaggcacccttggatttgaatcctggtatcaccactgattggctgtgtgatattcagagcgggttgccctctctgagcatttattctgtatttcaaaatcaggcaaacatctggcctttgttgtgcatgtctgtaatgccagccctgggagtctgaggataggaggaagtatgttcaaggttcatcttggttactagccagtttgaggtcagcctgggctacatgagattctgtcaaaacaacaaaaggaggtagtcataaaacttaaccccaagattcctgtatgatagtggaaggctctgacctagagcctgtggactggttgttttcagtggctgggagggcatggagtctgttgtcatgtgagaatagggcttggtacactgataaggactgtctgcccttgtgtctctgctttgtgatttcctctgggtgtgtcctgggcacaccattacctttctgcagagtagagtacttatgactgatgaccagtgccctctgcatgctctgaggccagtcgatagcatggcccacagccagcctaaggaacctgggcaagttatttaacc

SEQ ID NO: 1957 - DNA, 1200 bp, mus musculus
tttttctctggttaagtcttatgaagagaagtctgaacaagcatagcaagccagtaaggaacaccctccatggctctgcatcagctgctgcttcctgacctgcttgagttccagtcctgacttccttggtgatgaacagcgatgtggaagtgtaagctgaataaaccctttcctccccagcttgcttcttggtcatactgttttgtccaggaatagaaaccctgactaagacagggcgctagatcccctgcagctggagttacgggggttgcgagccatcggttctgggagtcaaacttgggttctctagaagaacagcaagtgctctcagctacctgtccaggccctcgagtggacactggtaacgcacacctccactcccacaggttagagacacaggttcacgaagggacttgcctgaggtattcacagagaacatttgagctcacagagagctgtgaggacggctcagctctaagtgcctgccaggcatgcattaggacaggaatccagacgcctaaatcccaccgaaatgccaggtgagcacggtggactcctcttggtccagccttgaagacagagatgttgtcaccaaagcaagatagccaggaagaccagacacgtgtgtggttgaggggcctagcctcacggataagatgagagagagtaagttctccaacagtaacctcaggcctcttcatgcatccacacagaggatacagagctggagagacggacagagtggcctatggcaattgcttcttttgcaaggtacctaagttcgattcccagcacccacattaggcagctcataaccttccatctttgactccagtcccaggggatccaatgcccttttctgccctcacaacatttattgtgagcaaacacataaataattaacaacatgcaaatagaaaaaaataaaacgtgactgaactgcagacactagcacaacagggcacggcaagtgcctggggtagctgagctattagccagacccttggaaaaggtcttagcctcatgttggaagttcacaaagattattccactataaaagccattctcgccaggcagtggtggcgcatgcctttaatcccagcactcgggcaggtggatttctgagttcgaggccagcctggtctacagagtgagttccaggacagccagggctacacagagaaaccctgtcttgaaaaa

SEQ ID NO: 1958 - DNA, 2200 bp, mus musculus
aatattctttgacagttctttcattctcttctactgtatcttctacacctgagattcgctctcctatctcttgtattctgttggtaatacatctgtaattcctgtcctctttcctaggttttccatttctaggtttgcctccatctgtgtgtcctttatagtttctacttccacttttaggtctttgattgctttattcaattccttcaactgtttgcctctgtgtgtgtgtgtgtgtgtgtgtgtgtgtttctttcagtgaattattgatatcctccttaaaggaccctattatctccatgagataggattttagaacagattcttggttttcaggtgtgttgttgtattcagggcttgctgtgttgggagagctgggttctggtgatgcccacgtgttttggcttctgttgcctatggtcttgtgctttccattcccctggtgtttgttgatctgggtgactgtatggaatctgcctcttttgtccctgggttgcttcaggtttcctggtatgcttgtggccctggctgtatcagaccacctgtggggccttccaggtccagagaagctgctgatctgttgccctggctgcagttgatctcctgggaggccttcagactattggatcttctgtggagcagtcaagctgttgtccaactgtgctgagcatagccggttctcaactgctctgggttcagaaggtcctcaacctctctgtttcagagaatcctctaggatatattgggatatggagtcttcaagggagcagaccaactaggagtctgccccagcagcaagggccaggtagaaggggtgggagggatagaaggagggggagtggtattcaggagggcgggattttgataggtaatgtgtcccaagttcaccaggctcccagcagcagctccaggactcagggtagtgtgggaggggtgttcttaccaactgctcttgagtgcagcgggtcctctaggatggattgggatatggaatctttacctcttcaaaaattcttaaatttatgtaaattctatgaatcccggatcaatagtctcaactccaatttccttaaagcagatactaaacacgaagcaaaagcatatttccttataggtttatacatcctgttctttgtgggtagctgggaacagctcttgtggtttcttagtacagcagacagcagtttttagtaacgattttcatggaaaaacagaaagataacagactcctataattaaaatgattccttacaaagttttaaatttatataagtaaagtggttagctctctttaatatcaagatgtagaactctcggctctcccagtacccaggctgccatgcttcctgccatgatgataatggactgaacctctgaaactgtaagccagccttagttacgtgttttcctttactttaagagttgcctgggtcacatctcttcacagcaatgaaacccaaactaagacccttctgtagctccagttctgggaaacctgatcaccccttctggcctttgtaggaaacgactttcatgtggtaggcacaattattattattattttaaagtagtgtcagattcacaccagaatttgagaaatcggaaacagaatgggctcctcagaaacacgcccatccactggttttcatataatgcaagagatccaagatagttcaggaagagagctggttcaacaaggatccccagtcagccaccatccgtgaggatagctgagtctgtgacaccatgccttctttcttcccttgatgtaaaggataagccttgaaagctgtacagtagccacccctgtaactagtaactacccctgtgttatccatggtttccattacccatagtgccccactccattttcatatgagttacctatgctcaaagttactcatgctcaaagacattacttaacatagtgttgttttaatctttaaaaagattgttttgcttcatctaatgtgtgtgtgtgtttctgagtgtttgtgtgtgcaagtgcctgaggaggctgcaagagagaattggattccctgcaactggagttccaggtgggtgtgagctgcctgacatgggttcaggcaaacaaacctgtgtgttctgcaagagaggtgtgctcttaacctcagagccgtctctccagcccatgttttaactttcattacaatgtattgcaattcatcttctacaccat

SEQ ID NO: 1959 - DNA, 1200 bp, mus musculus
ggagttcaagattattgttgaccacataaggagtttaaggctagcctggactacatgagaccctatctcaagcaacattccaacatagaggagggaggcatgaaatcccaactggcaactgatacctcctgagagagagttgaagttctttaaagatgatcatactccagtggaaggccaaacatccaaaagtagaggagagacagaagaattgtacttaaggctattcaaaacctggatacagtttagtggcaaagtgttaggtggcactattcatatagagacatgaactagttctattcaccccagataggaaccaatgacagaacaaagaatgtgccacctgaggccaacacgggtgagccagtgagttttattgagttactcagaggagcagaactgatgcaaagtctgctccacctcaaagcctactgaagcatgggtgagagcttacatcacaaagctagggacctggatcacatcgccccttctgcaggcagctctacaggttagagtgtcctttccaaacaggcagctggtctctgtttcttctaggcagtcatgctggtgtctacctccaagctgctggcatggtctctgaagcttgggggttgggaggcaggggatgtactctgcatagtctttactgttattcttcagtgggtgcagggaacactattgtatctggtccttctggagctatgttgagtgagatgctttctgtcttaaggagctctgactgggtggaatgtttcagctcccccacaaaacactctcttacactctcttgtgtcacgtccttgtaaaaaatcctgtcctaaaagatcctcttgttttcagatcactttcacatcctgtgttttatggagtttctctccaaggtggcagatttttaatcaactttatttttttttaactgatgaaacgattctggccagctggagcatggtgagcatggctctggcagaggccttgcccttcttcccaattcctttgtccttgctaaacccccttagaattcattcctaaagcgagccattcctcttgaggctgactaccaaggtccagctatcaaagtgtagacttccagcaatcaaaagccccctttggttcacctaattagcatgcccaattaaaattaaacacctcatcctaacttgggatttcccatttacctttataaagctccattttctgatg

SEQ ID NO: 1960 - DNA, 1000 bp, mus musculus
tgtattattattattattttgttctgtttagttttgagtcaaggtttctctgtgtagccctggctgtcctggaacttgctctgtagaccaggcaggcctcaaactcagaacgctgggactaaaggtgtataccatcaaggcaggcatggtggcacatgcctttaatcccagcatttgggaggcagaagcaggtatatctatgtgactttgaagccagcctgcttgccacaaagttccaggtgagacaggcctaagtagagaccctgtcacataaaaataaaaataagtcacagacaggccatggagaacaggcagctatgaggcttatgtgaggtcctgcctttccgactgctccttagactgttctgacccagcagatgtgtagaattgtgggggagagagatgtcttacttagggttttactgctgtgaacagacaccatgaccaaggcaagtcttataaaaaacaacatttaattggggctgacttacaggttcagaggttcagtccattatcattaaggtgggagcatggcagcatccaggcaggcatggtgcaggaggagctgagagttctatgtcttcatccaaaggctgctagtggaagactgacttccaggaactagggtgaggatcttatgcccacacccacagtgatacacctattccaaccaggtcacacctattccaacaaggccacacctctaaatgttgccactccctggtccaagaatatacaaaccatcaccggagagcaagcgggaagaagtctatctagcactatatccatcgcatggccccacccagccatagggatgctgggggaagtagcataggtgtgtgtcgggagccacgggtctcacagtggagcagacagaccattcagaacttagtggtttaggaaaatgcctgctgagagccaggggcagagttgtgcacttgtagccgcaccactgtggaagtgcagcaggagaccagcttgtctccaaaccccgaggcgg

SEQ ID NO: 1961 - DNA, 1200 bp, mus musculus
tctcccttttcattttgattttgtttggttttatactgtctctgtgccctctagaaatgttagctaagaggttttacaatcttgttgattttcacaaagaaccaagtcttagttttgtggcagaactttcccctaatgaataaaattttcagggtaccaataactgggcaaggagtaggtgaaacttctgggtcagggacaagaatagtggaggcaggagagagatacaggctttttggtcagggacagcttggaggacaatatgtaggtaaaaagtagcccctggtttatatggcaaatctgccaggatttgccattggaggatttacatttaatgtggcttacaagattaggatgcttgttgttgtgtcttgagattgagttacccgttgattccgaactacgtttgtgtggtgttttccttcattcagcaactcaactgggttctagagagaaaaggtatgttggcaaggcacactagccagctgcaggaatttggaagtgaaaggctggcgtggcagccacctgaactgccaatgggaacttagtgacccaggtggggagatttcagaggtccaaatcagaaactctccacaggatgagaacatgccagtgccttgcctgtgatagcactggctgcagagtttttgcccaaggcaaaccagcaaagactggaaggaacccaagttactgtttaggtggggttcctgtgttcctggatactgatggtcccagtttctcctggttgtgttggaacagatgttgtgtcctactcaccccgatcctaagatcctcagtgtgctagagtacttgggagtgtagcctcctctgggcactgtctgatttattgattgtgttcttatgctgtcatttaggcatctggttttccctggtgttggttggattatcctgatgatagcaggacttctcagaaaggtgtacggagctgtggagcagacaatggatgtcagggtacctgactctgatgtttgtccctactggcaaggattgttggggccatattcccaggtggtagttcttgtgttctttgtatgcctcacaggggaagcagaatgctcttgtgatccagcatgcccctctggaccaaagggtaagcacacacctgcacaatggcatacagggcaccatgcacaaatcagctctcttctgacttctaggaagacctctgtggttagtctt

SEQ ID NO: 1962 - DNA, 1200 bp, mus musculus
gggatttgacctctatctccactttcagtactgggtggcctgttgcttctaaaataaaagaaaagggggagatgtgaggagccgccctcacagtcgccattacaagatggcgctgacatccgttgctcatagtaaaatgtgcgcaggcatcagggtatcgttccattacctgagccctgcctttctcgtggcattaactgactgatagtgggcagccaatcccagtggtgcacgtctccaaccgttttttcgcagcctataaaagggaagggttttctgctctctgggtctcctctcctgaagctgatcatctatctctcgagatggattaaagctgtactgcagaaggatccgagtggcctgcgtgcattttgctggcgagacggtagcgtgggtcatctgtagtccaaactctcatctgcgcagactagtctcggaggtatccaggaaccaagatggctcccccaggtgctcccgtaaagccttcccgggcagagcagacacctatcctctggcagggaaggtgcccacccagatgtctggagcctgaagcggtcctctagggaccttgggggtgtccgctgactctacgcccaagttgaccaggtactggcaccgaccggaagggacttgtgaccctggtcagtccaggttttctgcttccctaatgctgtctcaggtcctatgtgattggaatggaacagaagttgtgttccattcactggtggtcataagttcacgtggcaagtcctctagggacgttgagggtgtccaccgacttcgtgcccaaggtgacctggtgctggtgctgaccagaagggatttgtgaccctggtcagtccgggttttctgctttcctaatgctttctcaggtcccacgcaattggaatggaacagaagttgtgttccactcactggtggtcctaatatcacttggagagtcctttagggaccttgggggtatccggcgactttgtgcccaaggtgacccggtgctggcaccaaccagaagggatttgtcaagagtagtcatcttatgagagcattaaaacagctctctgtgaccatacagccatacaaatctcagagcagcctcagagaggcttgtgtgactttcttttgtcttgctaatgctgcctaagtaagatcttgaaacttgcctctccttgcctcccaagggaagtttacttcaaatcttcg

SEQ ID NO: 1963 - DNA, 1000 bp, mus musculus
ttggttatagtcttttctacataagatttctctgtgtggccttggctgtcctttgtgttcctctgcagaccaggctggcctcgaactcagagatctgttgcctccgcctcctgagtgctgggattacatgtgtgtgccaccataattggctgaatatttatattttaaatatgtcagacctgaatctactgaatatgaagtatgcctattgtaattagcgagcctgggccgctgccttccccccccctcaatgctgaacgacctttaaatcccaaggagtcctggatcgcctgggactacatttactgaatgagtgacgctcaccctcttctcttttcattgttcgtgtgtgtgtgtgtggtgtgcacttttgcatgtatgagtgggagtcagtgtgctcacagatgtgcaaaagcaaaagatcaataagaaagaaacgattccaaacaatgcaaactaaaatgaaaatgtcacaagaatacaattgagatcattgtgttggctagttactcctggcatggagtctgccctgaggtgtggttgatatacccagcaagacaatagtggagaaatacaatttttccattgtcagtgcatattaacaacagagagttcacttgtcagaggtcagagcccatgtctactcccctcccccccacacacacaccccatcactgttgagaatctgtctggtgtaaacctgtgcatgctctgtgtgctgcatggactctgagagttcatgtgtgcatcatcagtcttgttgtgtctgtagcccttgtcactgagggcagaatgaacacagtgatcaccgctccacagacagacaaagtgaggggagcaaaacctgtcacccagagctcctccttccctcagtcatgagtctgggagacccgaggtctggcctcctagaacaagtgtgagttgagtggcaggcagacttgtggtggaacatgtgtgcaatcccagtgctggggagggcaatccaattggatcagtagtt

SEQ ID NO: 1964 - DNA, 1000 bp, mus musculus
tgatgggacccaaatttgatgcgtggaacccacagggtggaaggaaagaaccaattcccacaggttgccaaatggcctccatacttgtatcagggcatatgcatacacataaataaattaattaatcttatattagagcagtagacgcatgcactgtgagctgtgtgtagacacaccccagctctctccctgtctatccctccatgtaaccctcgtctctcccagcacttgcccctttgcttgaaccttcgctgtgcacgaggactccagccttggtgatccctcagctcttctgtcactcaagtctcacttcttcatttcccctccccctccaccaggtgaatggtctccgcgtggatctcccagctactgtgttaacatctgtgtctgtgaggaggatgcccgacggctccatgcttgtccaccagaaggctggggtcacggtgtggcttggaaaagatgggcttctggatgtgatggttggtgatgaccttgcagccatgctgtgtggggcctgtggaaactttgatggggaccaaaccaacgacgcatatggttctcaggggaagacaccgatagagaagtggagagcacaggacttctccccatggtgaggatggagaatggaggccagactttgggaattagagaaagaggtagtgtgggtggatgcttactgtgcaggatcaagtgctaagtgtctgtctcttgcagttccaactgatcagtcaccactggcactgaaggcatcaagacctgctccctcccagaagttacagtgattggaagatgccctgtgtgtcccttccctgtccctccccctttgctgagccactgaggccaaacctgaaagcattgagtaaataaatacctagacacagagtgtgtgtctcctgctgtctccccaactttctccccgctgtgggggacatggatggttgacaagtccttattagaagacaaaaggtgcatgtgtgggtacatgagtagatgaagggtc

SEQ ID NO: 1965 - DNA, 1000 bp, mus musculus
tctgtcctagacacactggcttcaccagcccactgcacaccttatctaagagtggcatgtgtggggtgggcctatgatgacagtcctcacccctgcatgttccctcctgacctccaggcaacctgatttacctgtattaaagttgactaggtaaaattgcccagagtcaattttcactaacaacagcaggttcctctcatcagtgatgtatgtagcccagtcgatgctgcagtttttacctgttgggggagagaaaaatccacagcagtctagaatccagctatccccataacctttcacaccatttctcaaaggcctaccaccctcctattccagatcccccacacacacaaaaaaaaatgagtacctggtaatttttcacatactgaccagccatctggcaccatctcgaaggacacgaggccatctgtggatcaagtcagatgccactctcaggccttttctagtccaccagcacctgcagggcatgctacccaaccagaactccatcggggtcctccacaccttgaacctcttagtccaggggttctagggttcaggctgactcccggcattctcatctttacacttgacctacacttaacctaatgtctcaaaaacctttttagatatggaggtgtgaccaatacaggccagtcagagtgcatcctgtggctgggtgttagaagtgatgtagtgaggtgtgttggtgcacaatgggtgacctagcatttactggtagattccatacagactgtctaatacttagccacactctggccctgcgtttgtcttttttagttcaagatggcttccagctcttggtccttcagccttagacttccaagggttatgactaccatctgtgcaccaccatgtccagtgaatttatttaatcttaatattaaccccctcccaatactacagtactgtcatctggtcccattttacagatgggaaagtgtgtgagggaactcctattacttggcgagagccacag

SEQ ID NO: 1966 - DNA, 1000 bp, mus musculus
gagggctcagatccattggagctggtgttacagacagttgtgagctgccatgtggctgctgggaaccgaactcggatcctctggaagagcagccactgctcttaaccacagagcaaccacagagctgccttttcacacccctccccctttttcttgagataagtactcagtgtgtaaattcatagcaatcctcctgcctccagtagaactattgacccagggagtaatttcagcttcctccaatctttctacctgcccctgcccttttctcttgcctatcttaggctccattcccgccctgtttggccccagatcccacttcgaataagctgttgcccaaagagacacaggccttggggtgggaggcctctctcctgctctgttctcagaatcccactctgtctgtaggacttcgtccaggagctactggccaagcttcggggcctgcacaaacagccgggcttcccgcagcccagcccctcagatgaccccagcctgagcccccgccaggaccgggcccacactgccccaccctgactgcgcccgcctctgcgctccacccccaaagcccagattgtttctaagttgtatttaatggttctgtaactgcctctggtgtccggattttcctctccccattaccctggccttctgcagccccttgtccttggtcccccaagccacagctggccctgacagacggagaaacattcctcctggccacagagcctgagaacataccctactgaccctgaggcgtcctggagactcacatcctgtccccacctcccccatatggacccagtcccagctcctagggaaggccagggccagatcccctggccttcagggtcacgggggatgtgcacggcccactgtgaccctctgtcatcttcccatagggcatcacacagcgatgaggccattagtccgctctatggagagtgtgcttggtgtaactgtatgagctgaggccacagaacagcggaacatagcatta

SEQ ID NO: 1967 - DNA, 1000 bp, mus musculus
ggcagctaagtagcaggtcattgctattgtcgtcccccaggtcctgctccaggttctctttgcagttcaaatcctccgtgctggtgaaggctgggtccagagtccccaggctgtgggctcgtgatgctgtgagcgtcaccatggctgaggctgctgaggccgctgaggccccagtggtggtgttgcgcctctgggccacggacaccctgttggcagctgcctcgttgaggtcaaacagcatgctctgcacatcaaaatgggcaaagctcttctggcagacccatggtctgctggcttctggggggcttcgactttcctcagtctctcccagaggccgccccacttccccctcgggcttactgctcctcagtttcctgaagatggatgagtctacagtgtccccactgcccaggccccgcacgggtttcttccggctcttctccttctctttgagaggctgtagactctggagactatctttggtgggctggccattgcgggggtctcccttggtgccacagctgccccctgagagggcgccaggatccacctgcaggagctccctgaggttctgggagccccgagcctctggctgctcgctgcggaactcattgaggatgtcaaagaaactctgctctggtacaccctgcacgtcgatggaggacgtgctgccatactctcggaagaggggcagcacccctgggtgccgggtcccccgtgggtctcctggttcctctacatcacactcactgagggtgatctcgctgctgctccgatgtcgtagagggagaaaggcccggccaggggaccggggccacccatcctggaattctacatctttggaccttctcctggacagtcgatggaaggctctggatcctgaggaagccggggtgctggaggggagctgtccattctgtaggttcctcatggaatgggctaccttggtggtcttcacaccatctgtgtcttgtgaggggctgggattgctctgttctct

SEQ ID NO: 1968 - DNA, 1000 bp, mus musculus
ccaaacctgcctcaaaatggtgacccttcagccttaatctccaaagggctgggttacagttgagaaccaccaggcctagctgggttttttttctggggctgggaaggggagggggtttcaggatgtcagatccagagccttgtgtatgttgggtccgttccctattactgacctatcccttagcctgggaattcagctctttttcttctaatgactgtgtggaaatattgcatttgtatctcaatggcctcacttccatttcgtagcgattggcatggttttgtcacatgtccctcctactaggagtgagaccatttctattagaagcacatggcttgagagtgtggttgggaatgttattcagggtgtcattactaaggatgtgaggatggggcaaaagcgtgtgtgcgtgtgcgtgtgtgtgtgtgtgtgtctgtctgtctgtctgtctgtctgtctgtgtgtctgtgtgtgaaccctttttgtttttgtcttatttttttaattagagtctcactatgtagccttggctggcctggaactcactatgtagccaaggctatactcagactcacagagatccacctgcctctgcctcccattcacttgtatttaaggtgtgcaccaccatgccccccccccacacgcatgggacttttgtggtcgtgaaaagccatgtaccaaagagagatgtaatgtgagtccactaaagggcatgttcatattgatggtgaacccagtgacattctgccctgctgtcctagggtcacgctgtaaataagtgtcctttctgtgacttacttaggactgtggattttttgattctcatttgttgttatttttgtaattctaagtagtccccaaacagaaggctaaaatgctctgtcacgttcctaagttcaagaagtttataggggctgtagagatggctgagccctggctgctcttgcagaggtctggagatcagtttctggcaggcactgggcgtgagctcacaggc

SEQ ID NO: 1969 - DNA, 1400 bp, mus musculus
taggtatagcctttccccaacgtgcaccactgtttacctgagcagattggggtagggataggggacaggttgggagctgtggtcaagcagctagcagttaaacatgctagtggaaccctgtggaatccccacaagccttactttcctgtctctgcatggtgggaacggtagatatgctatgatgtcataggtgatggcgctcatactttaggactcacaagaggacactgtgtgcaggtgatctgtctggtcctgactccaccctgtactagactaggatggagaatgagcttcgattttcccacctgtaatggggactcctcgcctcagagggtttctggaaggttcagtgagtgaatgtatgagagccccttgccacattgccagcaagaatcgagagctccgtgtttgcttctcttcttgttgatatgtggctgttagagcccaggggttcctgatctgagtgacaggtggcaatgggctttgaacaggttggaacagctcattagaaagtgtctgagctgttcaagcctgaaggttacctcaaggagcctcataatcagctgcaatcagctggttctgctccacccccacccaacctgggtatatcaagcctggtccagacccaagtaggctctgtaggccaaggagggcagagcaccaggcaccatggggaaggcagtgagtggcatctgggggattttgcggctggaggtggggggcagaagtcccagtggcagctgacatctcttttgttccatcccaaccccaggagaattatgaactgtactcagtggaactggggtctggccctggtggggacatgactgccaagatgagcaagaagaaggcaggaggtgggggaggcaagaagaaggagaagctggagaacatgaagaaggagatggagattgtgagcatgggggcggggcctgggcaggattgaggtggggtctgggagccaggcagtgggcagggtggggctgtgagagccagacagtgagtgacttgttccatcactccccagaacgaccaccagctatcagtgtctgagctggagcagaagtatcagaccagcgccaccaaggtgagctaggagtgggcgggtatagtgatgatggacaggaaagaggaacagagagagagaaaggtgtgagaatcaccagagagtgatgggtgtggggggaggggggaatagatggagcaatagaggagaaagaggaaaggagacatggcaaagagaagagactatgcagagaaacgaggaaggggagagggagggagagagggagagaagttagagatagaaggagaggtaaagagaatgggaaaggaagagaaagatggagggagacagtggaaagagagaaaggagaagaagatgagaggagggggtggga

SEQ ID NO: 1970 - DNA, 1200 bp, mus musculus
ttggtgtatcagtttttattaacaaatcagagaataaatggggggcaatgtttatacaacattgaaacagaagatactaagtgtaagcattacaatgccaggtctgtattacaatcagataagggagcagagaatcagcacttgaataacacaagtgcaaaacaccttatgcctacaggctttgatggctgagatattaacagatagcctgtgtaacagagatggaaaagacataggtacctgctacaagtgcatatagatggctgaggttgaagctaggaataaggcaaagcttccccaagtactgtgagccaaaacaggatggcctccatggctacatgtcctaagtactcaggatgcctttgttgtgagccataaattgctatggcatgggacgagaaaaaacagtagagttgatctatgagtgatgtccttgtaggggcgtaaactgatattcccaggaccaagtgaaaaaagcaagccagggtctgtgtgagaacggggaaaacagattgggagtgagtctaaggcagggagtgggaaagggactttcaggctaggcacagagcttaagatggcatttatctgttcatgtggccttcctggatgtggtcgacaggatgaccagtagaagaaagagcagggcagtctctcaccagcttcatactgtccagtgaaataagtcaggacatggcaggggtcttacttgctttgggacattttgggtagactagggatggagagcctggtgaaagacactgctgggttttttcctcctggtagggcaacgaaacgtttcagcatgacgctgtgcacttctggaggattaaggatgaaagatagagacaggtccatggtgtgatgctggaggactctgccctggcaacccaccttgcttctcctgtctcctgggctgaggtcttttccttttttcagagctactctgattctcggggtcatccatagattctattttcttctttgttttccagcataagttttgtgaatggcaggctgcctaagcatctacctttatcatcctgtagcttctcaacctagtgctcagaagcttgccagggaatgatgcagaataggagtcttcccacaagccagagatcttaccaggcaaagcttcatcctggcaggaacacagcctggaattgtccttctgccacatgctgccaataccctcccactgac

SEQ ID NO: 1971 - DNA, 1400 bp, mus musculus
acttgtgggtttctttattgtttctacttccctttttaggtcatggatggttttgttttattccatgtcctgttagattgtgttttcctgtaattctttaaggacttctaattctttaacagtgttctcctgtatttcttttagtgaattattaatgcccttattaaagtcttctatcaggatcatgagatatgattttgtatccgagtcttgcttttaaggtgtgttggggtatgcaggactggctgaggtaggtgtgctgggttctgataatggtgagtgatcttggtttccgttagtaagatgcttacatttccctttggccatctggtaatctctggcattagttgttagaattgtctctggttggagcttgttcctcctgtgattctgttagcctctgtcagcagtcctgggagcccagttctctcctgagtctcagtggtcagtgtattcgctactcaaaatctctcttcttggagggaatgtacacagaggtctggctttctgacctgccttctggctgaagatgaatgcctgaaatatggcctgtatcagaagatgtgttgccaaagcagtctgccagctgacctgcacagactgttctctgaggaaccagggacacaccatggctccctcacctgctctggcagtcagtgccctccctgtcagacagttctcctctgttggagaaggttaccagatgtcttgagcctgaaatgggatctgtcccagaagttgtgtcacttccgcagaccactcgctcaccctccacagtccgagacctgacctgggcagactggtctccaagggatccaggacccaagatggctccctcacctgctcaggccgtcagagacctccaagccagacagctctcctctggcacggaaggtgtccgaatatctggagtgcaaaaccaggtctgtcccagaagctgtttgcttctgcctgtcccagaagctgtgtcgcttctgcagtctgtactctcccctgagcagagtggtctctgagggactccagacacaaaattgagacttgaagtttttatcttaaagatctttcaactccttaattagagtcactcaaacacattttatattatttgtgactattgtgtatggcgttgtttccctaatttctctctcatcctgtttgtccattgtgtatagaaagtccattgatttgtttgtgttaattttatatccagctactgcactgaagttgtttatcaggttaggagtactgtggtgtaatttttaggttcacatatatactacagtattatctacaaagggtgatcttttgacttcttcctttccagtttgtatcctcttgatctcctattgttgtctaattgttctgggtaggacttcaagtactatattgaataggtaggg

SEQ ID NO: 1972 - DNA, 1200 bp, mus musculus
ctcagctcatcttaatggcaccagctcactcataattaaagtccctcgctcaaaagtgcagtttccatcactcctcacatgaatcttcaagcctctccacatgcagagaaaactcagtcccttcttgcacttggtgagacaaacagagaaaattgctcaaggaagttgccctggtcctgatcatctgggccaggttgaaaagacctgggcaggcacagctctgacttctaatgtgcatttggatgcactcaagtgcttcctggggccacaacaccttcccaggtagtgtgtccatgtggcagctaccaggggttaaacaaggtagttccaggctatgtcccaactgaagccctgccagcctgtaccacaatcacttaagcagtgtcctcctgagcctgacttacatagttttcttgagtttctgagttccttaactcgctgcagtcgcccaaactcagagtcttcaaatcaaatagacaaagcctcagcctgacaaaagctggaaggttcaccctcggacaacaagctgagtcttatgggtaatgaagttctcaaggcatgaaccttcataggcatgaacatcgtcatgttgcacaacagacacataaatattcttggttgcctcacttgctggtgttccaaagttctgctccttctcttgctacagtggtatacagagattaccatagaaaggactgaaactttgcacatgaaaccttctttctgatattttttaatattatgaaaccagatgacaaaggaaaccatatgttcacccaatgaccttgaaattaatattattccctaatttctattcagatgcatgtggtctgaccttttaatatgtcagctatgggactggtactgtggctcaatagctaaaggcacttgttccccagcatggcaacctgagataaaactccaagacctaattggtacaagaggaggaatcctaattctacaggttgtcatttgttcttggctaataaacatgaaagaaagaaagaagaaagaaagaaagaaaaaaaaagaaagaaagaaagaaagaaagaaagaaagaaagaaagaaagaaagaaggaaggaagggacaaaggaaggaaggaaggaaggaaggaaggaaggaaggaaggaaggaaaaacgatggtaaataaaacagagaaagaaagagagggagagagggggagggggagaagagaga

SEQ ID NO: 1973 - DNA, 1000 bp, mus musculus
agtactctctgcagacaaactctctccttgcaaggagggtgcacaaacatctgcctccttggtgatgatgaatgcccaaaacatggcctgtctcagaagatgtgtttcctctgcagtctgcatgctcatctgcacagactactctctgaggaacgtgcgacgcaagatggctctctcaccagctctgaaagtcagacccctccagggtgtacacctctcttctatcgtggaaagtgcctagatatcttgagcttaagttggggtctgtcccagaagctgtgttgcttttggagtttgcttgctcaccgtctgcagagctgacctgtgcagattggtctctgaggcatccgggacccatgatagttccctaaccttctctggcagtcagagtcctccttgggagggcacctctcctctggcagggaaagtgcccggatttctggagcctgaaatgaggtttgtccaagaagctatgtcacttctgcctgtctcaataggaatgtagtttttttagtcaacattctcacctatgcagactagtctctgaaggacctaggacccaagatgattccctcaccttctctggcagtcagagccctcctgggtgaacaccttttctctggcagggaaggtagctggatgtctggtgcccaaaataggctctgtcccagaagctgtgttgcttctgccttttccagaagctgtgtcccttctgcagtccaattccacaccctccacagatctgatctgcacagactgttcactgagggacctgggacccatgatgactcactcacttgctcctgcagtcagagtcctcccaggagggcacctctcctctggcagggaatgtgcctggatgtctggagcccgaaaaggggtctgtcccagaagctgtgtggctactgcctgtcccagaatctgtgttgctactgtagtcaatactctcacctcacagaatagtcttcaagggacccaggacccaagatggctccctcac

SEQ ID NO: 1974 - DNA, 1000 bp, mus musculus
gactgattagctagcattttatctggctggtacttttctctctcataacaagctgcttcctcctccaagtctgtttcttcagaggagctaaattttttatctgattcagagctactcgggtataggctccttctcctagaaacctccgctgattgatcttttttcttttgttttttctcctctttccttccaatctctccccaggtttttttacctaaccttaactttttctcgggtttaagacccgtggaaaggcctgtatacttaattggtgcaccatgtttcctctttgctcctactctctctccccgctttacttttgatagactatcttgaatttcgtccagaatttttcaccctatcttaaccacttgataacatgtgaaaaggaacaaaaaggctcctaacactggagaaagtttaaggccagaataccttgtaaagctgttccccactttacttctgatggactgtcttgaatttcgttagaaagtttaaggccagacataccttgtaaagctgttccccactttacttctgatagactgtcttgaatttcgttagaaagttcaaggccagacataccttgtaaagctgtaatgtgaccgtgacccgcagttctggttccggaatgagggatcttccttgagccggtgtgatggtagttcccaggtttcttggcgcctcttattgcccgaactggaatcttctgcagcaaaagctttattgcttacttctttaggagcaagagagagaatggcaaaaccccatcccttttaaggagaattatcctccgcctaggatgtgtcgctccctgattggctgcagcccattggctgagttgtcgtcacggggcaggcagagcacatggagtgaagaactacccttggcacatgcgcagattatttgtttaccacttagaacacaggatgtcagcgccatcttgtgatggcaaatgtgagggcggctccccacaattaatgactgcttctacttcttt

SEQ ID NO: 1975 - DNA, 1000 bp, mus musculus
agtctcagggtcgtcattctgggagcaggagctgaaaggaagaacaaatcatctctttttacactggctcatgacaactgccttgagaaagttgtccaagtttccagtgtgacttagaggatgggtccatttgctcgtcagaaaaaatagaagaaggcaggtaggtacccgagggagaggagctggagttccaggctggcctgggctacacagtaagaccttctctcaaaacaccggcaacaaaaagcaagcaaacaagctaaataaataagggttagggctgtctatagcttattagtgggggggctttctgtagtgggggatcctctcccttgaaatggaagggtttagcctcacatccaagtctgtcaggaaactggggaagggcaagtgtgtgaaattgcagggtctcctgttcagtcagtgagcgcatgccacctactctgcctggcatgcttggtgatccagcatggcgggtgctgggcacgggaaggtgtgccggcaagccaacaggatgtacatcttacttgggtggcatttcccaggacacacacaagttcctggtcctgtggaagttagatgaaggccaggagcatgcctgtttcatggatggatggacggtgtgttctcctcctcagtgcagcagcagtggccaccacaaagtctctgagtctgacattacatgcccccagaactgctgctaggcatccgctggctggaacccactctccggcttcgaggtcttctgtgtgtgcacttagcgtgagctgcactttttatgtagtcctgaggtcccatagagctggctgggagttgtttcccattttgaaattgatatacccagaggcctccctttagttttaaatgaagctttcagatctgaggggcctggagagatggctcagcagttaagagctcttgcagctcagctcagtcatgaagtccagaatttggattccggcacccatatcagctggctgacaaatgcctgtaactgcag

SEQ ID NO: 1976 - DNA, 1000 bp, mus musculus; identical to SEQ ID NO: 1975

SEQ ID NO: 1977 - DNA, 1400 bp, mus musculus
aagtccatatagaataaatttagggaaattgaattagtatctataaatccattttcttattaaaatccatataacagaaatgaattaaccttcacagataaattaagcctatcttggcaggtgtgatggctactgccgttaatcccagcacttgggaggctgaggccagcctggtcttcatgagctctaggtcagccaggactacacacaaagactccgctccccaccatcccccaaaaagctacccaaaatcagtgaatggaaaatttttagtcaattttctttaaatagtgtcatcaaaattatggtggaaaaacataaaacaaatcagaaagtgtttccacaggtctggccccatgccatagctcccgaccccacgtgaaagctaataactcgttttccgtacacctcaacttcaggaacccaagctataaagcttgtcaacacccacggactctgtccttccgggagctgcccctcgactctgggtgtgtacaaaacacccacattagcagcactgcagtctgctttcacagaacagtaagcgaccagaactacacaaacagcaccttgttcacgtcacccttagcagtgatggaaccaaccatgggactaatggggtcacgtctgtgtgacgcaaacttcagcacaaatatactgagctagtttctcagtatattttcttgcacactaacaaatggactctcttagaaatatactagccacttgccgaatggtgtttctgacaggaaactgcttgtgttgtttgttttcttgtggctagatgtacatgagtgctcaactgctatgcatagccccaggttttcaaagttctcaccaaaattttacttgaagactttattgttagtgttttgcctgaattatgcctgtgaactacatgtgtgctcggtgaggccagagtgtccagatccccagcacttgctgtaagtttcatatggttactgggagtcaaacctggatcctgaggaagagcagtcagtgctctaaattgctgagccatccctccagtccttttaaaaattattttgtttaatttttttgagatgagacctcactttgaagccttagctagcctggaacttgctatgtagatgaggcttgcctcaaactctgatatccacttgtgtctgcctcctgactatgtgaaccataccagtcttttattcaaacagactgaggttggaccatccttagtcacctgggttgttctattaagtgtaactacactcataaattcgaagcagagcaaaccgtaccagctgtgctactttgaggcacctgatcattcgacaagggatctttttaacctcatgaggcccagtcctgctaatccaggttggcctcgatcctgcaatcccctgctcacaacacctgtgaat

SEQ ID NO: 1978 - DNA, 1200 bp, mus musculus
ttgtgtagtgaaatccaggtataattataaacaagccaggtgttctgtactctgccttgcttgttctgtgttgcttgccttatgtctttcatggctacttcaggagaacatgcctttgctcctgactgtgagtgaggctgccacagcttggtgggaaacagccacagttaaaggctgcttgctggttagtttagtacacctgtgattcctttgaattaaaaaccctgctgaaaaccattgagggtttgatcttccaagccccagagaatccttacaacttgaggacctcaaaataaatataaactgtgtcctgggaagatgagactgtagcttatttgcagggtccacgactaatatgcatgaagtcctaggttcattcccaaacccacaaaacttgggcatgatagcatattctagtaaccctagcattcaggctgcaaaagccagaagatcaaaaagtcaaggttactgtcagctgcataatgattttgggccagcctgggctacataagataatgtctttcccaaattaaaaaaaaaaaaatctgatacatcaaagtatatagagctactaaaacaccacagaaaataagaaaattaagttttctttgggatgatattaatctttagcatgaagaagcaaactacttctatgactgtcttagttgccattctgctgccttgaaaagacaccatgacctaggcaatgcttacataagaaagcttgctcgaagcttgcttatagttttagagagttagtctatgatcatcatagtggggagtgcggggctgcagcagaagctgagagcttatgtcctgatctgcaggcaccaggcagagagagacactgggcctagaatagacttttgaaacctcagagcccacccccagtgacacacctgctccaacaagaccacacctcctaatccttcccaaacagttcaccacgctggtattaagcgttcaaacatatgagcctatggtgaccattctcaacccacaatggccctgtaactaggtcaaaagcagaacatacccacagagagaatgggcccaatcaaacacatctctaagcaggtaagaaagaagcagatctgcaatctgactccataaaaagggcaagcaagtaaattagagcccgactgagactctgaaacatcagcttgaaagacctttctacacagtaagcattttagggga

SEQ ID NO: 1979 - DNA, 1000 bp, mus musculus
agcaaaactaatgcaacttacttctgacccacggccactctgggtatcatagctcctggaaggggccagagcacattcctgggcaccctatagacgagcttcagggttgggaatggcctctagtaagctcaaaagtgcccacagtaatatcctcggaaggaacgggtgctgtgcttgtcatggccatgctgcctgccctttgggtctcaccatggagacacccggccaccacttcccttcctctgagtgcatctcttacctcgggcttccacttgcgcagcctgcagcttaagcacttcctgtaacattacttctacagagcaaatatttatactagtaaataccatcaaaatatgatctgcattcaagtgtttcctataggtggttgtgaggaacaagaagaagtcgctgcctaagtggagaggagggggaatggagcccatgggcagccctgacaactgacaaagcacctccctgtggggctctctgctcttgacgtaacactgcagcattagtaacatatgccttccaacagcaaggcccaggggtccctgatcgggtactcagaactcctccagcatgtagaatctatggtttgcacagactcacagccagtagcccatacaagtgctagtctcaaacacacaggcctctgtgccccatggtcttggaggagataaagcagaggacagtggtgggacccagagaccaatctgggaaaggcaagtgacttagtgtctgtgtagtagcacctaggtcaagtagaaagaactgcttctagaattttccaaaagttcttcaacacgttcatcccacctctggtgggatgaatgctaaagaaggcacatgcagaataaaggagagagagaaggccttgccttttcatgcccagaacggtactcatcaccttgatgcagtaggcctggcctcccagatctccttggcactcaatatcactgctctttgagaagttggccagtatgaaagacttatctgattt

SEQ ID NO: 1980 - DNA, 1200 bp, mus musculus
tggagtgtggggtcccgggttctgaggtgactaagtgcattgtttggggtgtggggaggtgtgaatagtaaaggaactgagccaccaagtgcatttttataaagaggggaggactgcgaatacccaaagccaaatgaaatcccgtgctaagctgtctcctgtgcttgcctgtgcagggctgttgcccttttgagaataagttagccgaaaacaggtccgagccagctgtcttttgctttttttattttagagaaaggcatcagtgatggtcacatgtaagtgaggaagggtctcttttgctcatggtttgagtctttcatggttcagaattcgaagcaaagcagctcccaccatgatgatgaggaaagggtgtggggaaccagtgcaagataacgccccatgaactcacacacacccagtgacccacttcctccaaggagtccccagttcccacctgtcaccacctcccaataatgccattgtagaacccattcactggatagagcacccaaggatgcaataggctctgaaatgccctcacagacatcccagacctagccacggtggtctcctggcctctccccatccaatcaaaacaataagtgaaggttttaatcatgacagactcctggacaaaattaaactttcatgacaagcaactctttcatctgtcccgcccatctgattcccccaatgaacactgagggtctgggacccagagagtcaacccctagccacagtccaagtgagtctgtgcagagcagggacacagtcagatctctggtttcccagttcggtgtctccccagcagcccgtgtacaaaggtttggtgagtcgcaccactaagcatgtcccattgtggccactgtgtcagccccatgtataccctttgtctgaatcaaggacttctcacggctccttcttcatcctaacagactggggacattgcaaccatcctggagggctgcatttttcaaaaagcaaaagaactgtgaaagaaaaaccagtctactgctcacagattcaggcctgactggtgtgtgtgggctgttaatggaggaccacgatagccagctgatacatcccaggtttgtcttaaggtgataacaactttccgagtagcttggagtttccctgcctggcatccacactcaacttctggtaggttctactagaacacacccaacccctagtctcaga

SEQ ID NO: 1981 - DNA, 1000 bp, mus musculus
gtgagttgctgtgtggttgctgggaatcaaaactctctccctacaagagcagtaagtgttcttaacttctgagccagttctctggttccaagatccacttctcgaagagaagatcatccaagccaccatctgaggacctacttgtcaaagtggcacatagatgtaggaattcccgcctacagtgtctgtcctgccctcggtgcttcttttacctttcaaagccattctcttctgtgctcccttcccttggtgacgctccctcacccctcatgttgggtatctggcttgctcagagttgatctccaggtcaggatctgctctctctcactaagtcccagttaacagttcgggggatgtagcacttctccaactttgtcttcagatagaatacagaccccgtgcgcttctaaacctctggtgtactagttaggtttcagtccccgtgatagaacatcatggccaaaagcaactcggggaggggaggatgcatttcatttccatttccacaccacactctgttctcaaaggcggtcagggcagaagctcaagcaggaacctggaggtaggaactgatgcagaggccatggaagaacgctgtttactggcttgctcttcacttactcagcctgccattgttaacagagttcgaaaccaccgggaaaagaccccgggcttactaaaaattataattagatgaatttattaatactgctagcagaaagacagcctccaagacaagtcgaaggtgtgtcactcagaaggggctacgagaaggggttttaaaggtggagaccgtgattaccctgtttccgtggaatttgcagctgcatgggaaattgctctactcctctcagctgttaagtagctgtctctctccccctggtccatatcgataagtgggtttacaaaagccggagcaagaccgtaattatctcaccacagtcacatcattcgggggtgggggtcaaggaatcagagttgccttgagcatatcttttag

SEQ ID NO: 1982 - DNA, 1000 bp, mus musculus
agctttgcagtttcatgaggtcacatttgtcaattctcaatcttacagcacaagccattgctgttctattcaggaatttttcccctgtgcccatatcttcgaggcttttcccaactttctcctccataacccataattagcctccaaacgatgacaccattgcatacactagcaagcgtttgttgcaaggactgtgatatagcagtctcttgtgagactaggccggggcctaacaaacacagaagtggatgttcacagtcaactattggatggatcacagggcccccaatggaggagctagagaaagtatacaaggagctaaagagatctgcaaccctgtaggtgcaacattatgaactaaccagtaaccccggagctcttgactctagctgcatatgtatcaaaagatggcctagttggccatcactggaaagagaggcccactggacaggcaaactttatatgccccagtagaggggaattccagggccaaaaaatgggaatgggggggaggagagtggggggaagggtgtgggagacttttgggatagtattggaaatgtaattgaggaaaatacaggcaggacctgatgcagaggccatggatgagtgatgtacactggttcctcagcttattttttaaaacgatttatgcatgtattttatatatgtggatgcctttttattttttattagatattttcttcatttacattacaaatgttatccccaaagccccctataccctccccaggccctgctcctcaacccaccgactcctgcttcctggccctggtgaatgccttttttaaatgcacatcataaaatgaaatcagatcccattatagatggttgtgagccacaatttggtttctgggaattgaactcaggacctatggatgaatagccagtgctcttaaccaatgagccatctctccagccacactccaccagttttcttaggggttctaggtccatcagcctaggaatggcaccatgt

SEQ ID NO: 1983 - DNA, 1600 bp, mus musculus
aggttgaaatggacattcttcctcacatattcctggtgagatggtttatgatgtaggctagtgggtttgcttttcatttatgcttagtatggttattagagctatcatatgtaagtggaagcaagaagaaaccaagggaaggcattgctagataccttttaaagtaagctatatataccacatgccctacagaaccacaaaccataacattcaaggtcactcaatttggcaagcaggagaaagatagtagtaaatactgtttgctcctgagttcccagaagatgaaagcaaattctctcattgcttttgaggttcctggttttctttagagttgaacctctgactattctccactgatgtgccactcggtgatgtattttccaatatgtcatacagccagttgtttcaacagacttatttgacagaatcctgaagtttgttctgatgaaattggaactcttgacactttctttacacaacaatagtattatatcaagtctctctaccacggactgcctgtttcaaactcttcattggcccatggaaaaccccacagtgttaatcagacttgtaagcttgagatctacaaacctctctagctgccttcctatccatcatctcctaggcaccttctttttgccagacctggataaatgactctcagtcatcaaaacggaaaccccatggcctcatccccattaggttttcaaacacagtttcccattccttccttttaactctctattactgtgatggaacacttgacaaagctactaaaacgaaagatctgctttggcagcatggtgctcacatcctggcagacaggaagcaaactttccctttttcccctcaaagccctagccttgagggtggtgctacccattgtcagagttggtctgctttctttagttcacgatctagagtgcccagagatgtgattgagaggttcaggtgcctctcagtcataccaagtggacaatgacatcatcatttctttccttctttcataatctatcacctcttccttaactcttatgtccagggttaggctccaatatcatccttttccatctctccctgaggcaagaatctctgttgtaagtgttaaaacacatgaagttcatcatagatggtggaacagagaatgggttctacaagaagacaaagccacttgaaaagatacacagctctgtttactttattttactttattacttaatataaatgtatttattttaacagggttctattaattctttcagaatttcacacaatttgattacattcatccctcactgctcttacagccactctttccaccctccaatcccttcccaaacaactttgagattttcagtttttcctcctaacaagtctagtttgtgttgctctgctagtcttaggaatggagcctactctggcatgtggtctcccaaggatcttatcttcaaataaaactgactatgactctgtggttaaaattccttagtgctcttgcagaggacctggtttcagatctcagaatacacgtggcaactcataactatttgtaactcccacttatggaaatctcactgagatccctgccccagagagagat

SEQ ID NO: 1984 - DNA, 1200 bp, mus musculus
gtgtatcaggactagacagaaaaattagtaagcagtaaaacatggaagagatttatggatgagtagagagaggatttatattgttactcaccacgacaaaataccaaacacatgcaatttaaataaaggaatcttcattttgggctcatggttttacaagatactgtggatccaaagcgagacggagcactgtggtgggagcaaatgttagagcacagctgctcacctcgtgtcagccaggaagcaaggaggaaataaagaactaggcctgcataatatatagtcccccaaacaatcctccagtaccttaactccaaccaggcctcacctccaaagatgttcatacactctcaataataccatcaacttaggaatccatcaatggagtcatcagtgattagatcagatccctcatgatccagttacctctccatgaatagattcaccagttgaagaccaagcctttctgatccttgggggaagaagtatttcagatccagaaagaggatgtggttgtctccacaaggatggatgagtgggttgaaaatggatggaaaaagtagctgctgggtagatgggaagagggatgtgggaatgggtgtgtggctggttgaaaggggctagacaaaaggataaaagatggatgggaagatgggtgagtggggaccaggtgaaccttgctcgatacctggtttggggcatgccatcatgcctaggtgtagaatttctggcacacataccaggaaagatgccatagaaagaaatatcccaggcagtgatgtgatcagaatgttattccactctatgttctgtgcccacctctgaaccactggatacagaaggtagagctgaggcacagccagcccacaggtcaccaccagctttctggtacaggtgtcgtgtaccctccagtgactggatactaagttatctggggaacacagtgtggccctatacttcttgatgatcatcaaacgatactgtaggtttgtctccgcagacctatgtctagtctctaggtgaatggatgaactgtatttgctttaaagcttaatgtaacaagaaaatacacaagggcatagttcatgatgtgttctgttctagagtcatattttaatgcttgacacattctgggccgttccttggcactggttttatttaatgaacacatgttatacaatttttcaagcactatccctc

SEQ ID NO: 1985 - DNA, 1200 bp, mus musculus
ctctttcctaggttttctaactccagggctgtctccctttgtgatttctttactgtttctatttccattttttgatcttggatgcttttgctcatttccttctcctgtttgattgtgttttcctgtaattcttcaagggagttttttgtttcctttttaagggcttctagatgtttacttgtgttttcctgtattttcttaagggagttatttatgtccttctcaaagtcctctatcaccattatgagaagtgattttagatccaaatcttgcttttttttccagtgtgatggtatatccaggacttgctatatgaatatgtaatttgtttgtttttagagacagggtttctctgtgtctccctggctgtcctggaacttactttgtagaccaggctggcctcaaactcagaaaccccactgtctctgcctccaaagtgctgggattaaaggcatgagcccaccacctcccggcttgttgcttatattctttttgtttgtttttgtttttgattttgttttttgagacagggtttctctgtatagccctggctgtcctggaactcactttgtagaccaagctggccttgaactcagaaatcatcctgcctctgcctcctgagggctaggattgcctcccactatctggttatctctattcctacctgcccttgctatatctgactggaacctgtccttcctgtgttcctggttgtgtcacaactcctcaggtttcagctgtctctgtggtcctgacattctgtgatcctgtgatcctaagatcctgtgtgtgtcagagctcctgggagtcaagctgcctctgggacgctgagatcctgttgtgaccaagctcctaggatcctgggatcttgtggtcctgggtgtgttagagcacctgggagtcgagcttattttgggcgttgtggaactggctgcagagctcacacccaaggtctgctcaggtcactggcccagacaggaaagagttccttggctcttgtatagactggctatgttggatattatcaagactaccactctataagagttacaattaaaaagggaacaagggaagaaacaatcttattcatggaaaaacaaggctcccattctgtaagaattacaattaacaaacgtaacaaagatagaaacaatcttattcatgaaaatgccttctaataagtatgcaaatcctaataat

SEQ ID NO: 1986 - DNA, 1000 bp, mus musculus
aacccatgtccaagaacataagatcaggtagacatgttctctaccactgagtctcacacaaggccaccaatttcaaattctgataccattttccattccacttttaagattgtgaaacatggggctggtaaaatcattagttgtttaaatgcttgccttgcagccgttcctaagtgtgtttagatacttaaacctacattaaaaaacaagatactggggtcatctgagtaatgacattattcaaaggatcaggtaagattttggaaattatggaccagacaacctagttccacgaaaatgagagtcgctcttaataaagacaaaggggaagaaaagtgaggagcacacttccaggtaatttggtaactggcctactgagggttttctgccacaaaccatacaaacaggaagaaaaacaaaaatatctgagaaagcatgacatgcaatgatctccagaaacaaagcagtcaccatcggtctgcccacaggggtagcatccaagctcttcatcaagagctcataggaatgtcctcccactgctgcaggggccaaatgctgtggtctatgaaatgggtcggggtggggagcatctcatttgcccaaggcactgacttcttccttcacccttttccagtggttcaaatggagacatccctgggattgccaccttcaggccagacacactgtcagctgcagagtccagaactctgcaacacctgtgtccaggtttcccaaataaggccaccagctgtcaatggggacaaggcattaacagcccccatccacagtccttcagagttcctggccttgcctccagctccaagcctggaacaaccagagaacaaaaccatgcctgagataaaagagggcacaaaagaaaaccaagacaggccagtcctgactttggagcaccctgacttgcagcagcctctgcactgcactgacactgagagcctcaggcagaagcctgattctgataatgcccatttgggatgcatct

SEQ ID NO: 1987 - DNA, 1000 bp, mus musculus
acttctcctgtctaaaggaaatgtatggaaaaagagtggagcagagactggaggaaaggccatccagacacttccctacctgcagatccatcccatctacagtggctaaacctagacactattgctaatgccaagaagtgtttactgacaaggacctggaatagttatctcctgagaggctctgccagagcctgaccaataaagatgcagatgctctgatgcttacaactgaccatttgactgagcatgaggaacccaatggagaacttagtggaaggactgaaaaactgagtgggtttgcaaccccgtaagaagaacaacaatattgaccaaccaggacttcccctcccaaagagctaaccaactataaagtacacatggagtgacccatggctccagctgcacatgtagcataggattgccttatctgttatcagtggctagggaggtccttggtcctgtgtaggcttgacgcccaaattatggggaacactggggcaatgaggcaggagttggtggcaggagcaccctcacagaatgaggagacaatgggacttgtataggagtctgctggtgttagaataaataaggggaagaaaaactcgaggagaaggtccttgtgatctcttggtgacaggttctgatagaaaaggagataaaaatattctcttatagagttggaaatgagagtgggggattttatttaaggaacagtagatgtgctgctgtacatcagcgttagcctgatttttgcccccagaaaagcagctcttgggataacagaggggttttgttgaagaacaagtggggagtggaaggcaaaggtcacgatctgtggaatccacagaaggtgagaacacggggccacaaagggctgccaaaattattctgctagacagctgggaatggtgtgggggattctggtctaagaaaacacagagagtaagtagaaggtcttggggcagatcacttggctttctagaggttatagtctacattt

SEQ ID NO: 1988 - DNA, 1000 bp, mus musculus
cttccaaaggtcctgaattcaaatcccagcaacctcatggtggctcacaaccactcgtaatgagatctgacaccctcttctggtgcgtgtgcgacagccacagtgtacttatttataataaataaatctttgggccagagcgagcagggaccgagggagcagaattgaccagtgtgagcggggcgactggagcgagcagaggtccgaaattcaattcccagcaaccacatgaaggctcacgaccatctgtacaactacagtgtattcatatacaattaataaatcagtctttaaaaaaaaaaactgtggaaactcaagaggtttactttagaagaccataaaccaaattctctgaaaaagaacaaattcagaatgcagggggctcgatgatgattcagcgtgtcaatggctctctggctggggatttcgattacaaatgtgtccatcgcaaaggtcccacagagcagcctgtctcaccaagcccgaagtccatgatattgaaaggtctgaagaagaatatcagttgatcattcttgcatatgatggtatctgggacgtcactggaaacgaagagctctgtgactttgtgagatccagacttgaagtcacttatgaccatgaggaagtttgtgatgaagcagtagacacctgtttgtataaggaaagtcgagacaccgtaagtgcgattttgatctgttttccaaatgcacctaaagcctcagcagaagcggggaagaaggaggcggggctgagcgagtacctggaaagcagaggagaagaaatcataagaagcagggggaaggcgtccctgatttagtccacgtgatgtgcacggtagccattgagcacatccgcagcctcccaccagggggtgaattggcaagcaagcagaaagtaattgaagccatttacaatagactaaatacttacaaaaatgacgacaatgattctacatcaactgatgacatgtggtaaagctgctcatctaaccatggttcac

SEQ ID NO: 1989 - DNA, 1400 bp, mus musculus
gaatacaggtcaccttgaaaggtttgtaataaagttagggatgagattcagggactggacaagaaggaacagtaggagggaggggaagatttgtagcaagactactcgattccctggcaggaatggcctgtgggttagtatagagtacctactggtgttggaggctggaatcaatcaacaagttgtagggggtggaggttaggagaagaaggtctgtggaatccataggagatgtgggcacagggaaatgggaagctgcagcagctgttttgttgcacagctagggatgagtttaggaggttggtttggagaggttgaagtagtgcaggtattcagtgagcttacctcttcctctggtctgctcagcttgtgtgattctagggaatgcctagtggtgttggaggctgggataatgggaagcattggccaaagtaacgttggaggaggaggtcttcatcatccattggggattgggtcagaaaggaaaggaagatggtaacaggtggtctgctatggagcttagaatgaacctgagggatttatctagaggagaagaggtgaagatctgcattcaacctacctgcttccatgtcagaagtctagatatggattcttgataccactgtggagatgatagtcattagaaaaagaggaggtcctacgggctcctccacagtgagaaaataggttgattatggtgtatttgtcagaatgtgtacctgtcagtgagtagtgtatgaatgcctgacttagcagtggtccaacccatgtctaggcactcagtaaatctttgacatgacttgaactcaagccaggtgctggactctactgaggtttcctgtttctaactcaatctctctaagttctcagttgccacattctcctagatttgtctttctgaatgatgcacaggttctataacctgaacacatctttatctggtatcctcccttgtactgaagtctggctctccttcaactttcctatccacggataatgtttttctgtgttgtcatagtacccagttcccagctgtcttgatttatttgagctcccataacaaagtatcataagatggacagttttaaagaaacacatttggacttctggtggttctagacatgggacatctaaatacggtagatctggctccttgattttttttttttttattctcatgtatcagaagtaaaggatgaaacacatgaaactcaagaagaatgaagatcaaagtgtggacactttgccccttcttagaattgggaacaaaacacccatggaaggagttacagagacacagtttggagctgtgacgaaaggatggagcatctagagactgccatatccagggatccatcccataatcagcttccaaacgctgacaccattgcatacactag

SEQ ID NO: 1990 - DNA, 1200 bp, mus musculus
tcttctttccagatctgctggtaggtatcgtggaccctgctacaaagagcgagggagagctggactatactgatagggccgtttatgcctgaggcagggaggataacacaagggtaggcagtttaagaacacagccacacaagaaatctccgaggccacttcaacttttagccatgagaaaggaacccttggagaggggctctagggactttggacatctatgcagaagtccctgtgggtaaaggagccatgactagcaggtttgcttggcctgtgcatagggtggagtagaggacagtctttgattgacatatgccagagtttgttctgatgacagtagccagagttggcccacctggtggagggacccaagtctgaattggtggaccactaattagatcgttgtggagggatttgggccaggatggccttaggcattcttaaacttccttgtacttcctctgctgcttccttggggtgggaagagtcccccagccctctttgtatctgctcctggaagtccagagtggaaggaactgctgggcctacatgggcatcttcagggtgagaagccagggtctgccctttggtctggccttggttattccctgccccaggggagaggaggctggtgtctcgcccaaagggctcagcctctgtggtgatttgaatagatttggtccccatagactcatgtgtttgaatgcttggcccatagggagtggcataattaggaggggtgaccttgttgggataggcatggccttgctggaggaagcttttcattgttgggtggactttgaggtctcctcctatgcttgagctccacccagtgtggaagagaccctcctcctggctgcccgaggaaggcagtctctactggctgccttcgcatcaagctctagagctctcagctcctccagcgccatgcctgcctttcctgacatgatgatgatggactgaacctctgaacctgtaagccagccccaattaaatgctgttcgttataagagttgccttggtcatggtgtctcttcacagcaatgaaaccctaagctgacagcctcctaccctgtttggttccccactggctcatagccgtctccctaaaccctgtactgtcctttccccgagaggaccgtcccacactcactgtcctagcattaaggggtctgtgataccccgctgctgccctcgttc

SEQ ID NO: 1991 - DNA, 1200 bp, mus musculus
gtctcttgatgaaacagaagtcacattgactgatatattttggaactgtgccaaccacttttttttttaaatctctatggaatctcaagagtattggcattttttcaaacaagggacaggagcttgggatatttaaggatacacaggcagggagaggtatagcagaggtttgtctcttgggctgctccactctgtctcaagggcaaggaccatggcaggctcatatctgaggtctaggacctgacttggggcaatgtccaagggacatggagctctttgattcatgacttacgccctcaagcttgtccctatctgactattggcagccgcttgcctccaccacaaacacaaagccggcacatgctgaaggactttgagtaaagcccaaggctgtcaacaatggtccgtttttttcttcaagtgtggtgtccccagaggaagtggctcctgcctgggtttgagtgctggccctgccaagcccaggagagtccataagaattctgttcagtgtgctgcagggaggagccagtgggtttcctcccgagttttgactcaatcattggccccactcctttctcttttaatgtccttgaatcatttaattgctcagccctggtgtctccctctgaaaaaggctcttagagccacataccatacacacaaaggccttctaaccgtgtgctctgtaggcttggatgggctgccagataccacatcaatgctgtcacatgcagagcctctgagatgagaccgtattagaccgtattatgcagatatgattacaataagggttctggggtagggggtaagcaggttgttctggtttatcttggttggccctaaatggtaccacaggtgtccctcacttttggtgctagatttgaatgtggagcctgtctatgctaacacactctgcactgagctaaagcctacgccataagtatacttttaaggggaaggcaaggggggattcgatagaagatgaggtgatgtgacagttgggagagacactggagcaatgtggccacagatgaagaataccagtaaccaccataagccagaaaaagcaaagacttggtttccccctctgaggaaatcctctgaggagaggttgcagatgcaatgaagttaaggatgtggtgatgaaccccagatggactatgtgacaaatgccggtgagagatggataatggcaaggag

SEQ ID NO: 1992 - DNA, 1800 bp, mus musculus
atgggactttaattcagagtcttgcttttcttgtgtgttgtagtatccaatgctcactgtgttgggagaactgcgttctgatgattccaagtagccttagtttctattcattatatttttgccctcagttcttgccatctggttgtctctggtgttagctgctcttgctttctctaactgttgtttgtctctcctgcaagtctgtgtgtcagtactcttggtagatgagttctttttgggaggaatttgggtatggagagctgtggtacagagtcagctctggggtgcagatggaaactggaaatatccagttccaggctcctctgttcctgtgtactgagggttccaggcatgtccctttgagcagaaatggtggtcttacctgtgctcacaggcttgtctgcactcctgggagaccagctctcttggtggtattttggtatggagcaccgtgatacaggatcatctcctggctcctttatctttacattcaggtacagaacaatcacaggcaagagagtcatggttctggacctttgttatttccatggcaacaaaagtcccaaagaaacagcaagaaagcttcaggggaagatagcatgagaatttgattaatgtcaagaaggatgtagacatgatactttctgattaatgctattattcaggagaggtagaaaacaaagtcagtggagagctcttggagatggtggaccactgaggcatgtctagtcagtaagctgagaggagagtggacagtggtcaagtacatcagggcagtgctcactccaaagccacctctgagctccaggcagaggctcttcatcatggctctgctttgcctcttgacatctctaccatgttttcagctgtctcaggagtgtcctgcagtacattctggagaaccattttgagggtttggtgcttcaaccgatgcctgaaagagcccacgaagaagtaaatgatggggttggcacagctgttaacagcactcaggacgagtgatgccagaaaaacatcataagcaaatacaccataatcaatcttaatccagattaacaggaaccagtagatggcagagggcaacccacagaggagaaaaactaaaactgtcagcatgatggtcacgaataatcttgtaaatttcatcttcccagcaccacagaacaacctggccagcagagccagagtggacagacagaggactacaaacaaaaacatcaggtatgcattaataaagaaattcgatgccagacacccattgtcatttttatatttggtatctaagagaccacagaaatacgtattcagaaagcagatcaacagggacaggtcccgtatagcagcacatatgacagttgatgtgtgttttgtgcagtgggagcgataccagatgggacacaggacagacaggcagtgcttagtgttgatggcactgagcatggtcaggcctgtgttgtagagcaccatcatgattgtgtaaaaacggtaaagaaaaataatgttgaggtaggaaaccttgagaagttgcattgtggaagctatgatgtgaccaaggaggaaaaggaagtcagctatgaccaaatttaagatgtagattgagaaagcattcctgtgcaagtggaagagcaggagccagaacacaatggcatttcctgtcagtccggccagtccacacatccactccaacctttctgtccttgattcccctacactgggtcatctatcgatccttcataggtacaaggatctcttcttccattgatgcatgacatggccgtcctctgctatatgtgcatctgg

SEQ ID NO: 1993 - DNA, 1000 bp, mus musculus
gtacaaggaacgacatgtaaacagtctgagtagcatcaaggtctcactgtattcagcaaggctcaaggcttaaatgcacaagcaaaaggggaagtacttctcagcaggaggtatggggcattggaaatgcacaagcaaaagaggaagtacttctcagcaggagggatggggcagcagaaatttttcttttggcagctacactgggaagcaggaacttggtggtatcagggtgtggtcaggacatctggcgctgacttagggctggaacattctgtggttattcttggaacggtgcatcggtggcccatttttgacccccttttcttctctgggggagaggcccaatttggagatcaagacaatagagttgtcttaataattcccaacaactagggaccaattaaaaggagaaaccacacaaaaataaaggaatatgtaaaagtatatgtgtacatttctggtgtaagatatgaagaagtcacaaagcccaccttttagcatttcaacaataataaactagtgagaaagtggaataattcatgagtcaaaaagtaattcagttagaaggggcagaaatgactgaccaaataataaacccaaattgaaccaaacaataggtacgtgtaactctgtgcttcaaaactcagcaacaagaatgttctagaactcaggatcgagagactgatactgcctcctggagggagcgatactgagagaacagtttccttttgcaggtataaggtgggatgctgccagaatggaagcatctcaaagcaggcttccagcatttcttttcctattttcttattatctatagcaagatggaagaaaggatgcagacataaccaggttaattggtaggggtagctcaaacaagggtgaatggcaccacacagacacacagactcacacacgtgatacatgcacccatgcatgcacccacaaatggtggttccaagtgtcctgttggcactgttttacaaagtcctaatggttggat

SEQ ID NO: 1994 - DNA, 1000 bp, mus musculus
agggaaaggaagatagtgcagtgtgagtgcctctgcagagagggaattgaaacatggccaagtctctctggggactgctaagtgaagtacagtaaataagaaagacaaacctaacacaacacaagccttctctttagtttcttctggaaaacgaggagttttctgtaatgatgaaagctttctatgcagatagtctgaagaaaagatgagagtgaatagtgatggcatgtaatcctgaagaacaatgccattgttatgatgaatacattgcttttattgaaaatatagtgtttcatataatatatgctgactatggttttcccttacctaattcctcctacatactccctgactcccacaccaacctaaatccatgtcctttcttgttcctctcattagaaacaaccagcatcccttcctgtcggcgcctgcaccgggtcacctagggtccggagtccgtgaacacccccataatccccagaggactctccttgcgatcttaggatcactggtgagtggaacacaacatctgctccaatccaatcgtgccagacctgagacagcaaaaaggaatcagaaaaccggcctgatcaggggcacaagtcccttcagttggctccagcactgggtcacatgggcacagaatcagcagacacccacacagtccccagaggactcttcacgtgatctaaggatcactgactggacagctttatggacctcaaaggagacaccacttccaggcactgtaacaagctcaggatcttaggacaacaggatcccaggataacaggagctgggtcacaccagtatttctgggtctcagaggaagcttgactgccaaaaactctgacacattcagaatctcaggttcacaggagcccacaatcaaaggatcacagagaaagctggacactgagaagtcccgaatcaactaggattataggaaagacagtctccaatcagatatatattgagggcagcaagcacttgagataat

SEQ ID NO: 1995 - DNA, 1000 bp, mus musculus
tcaagaagaaggaagactgaagtgtggatacttggttcctccttagaatgggaaacaaaatacccatggaaggagttacagagacaaagttcagagctgagaaggaagaaaggaccatccagcgattgccccacatggggatccatccccaatacagccattaaacccagacactattgcatatgccagaaagattttgctgacaggacccttatttagctgtctcttgtgaggctatgccagtgcctggcaaatatagaagtggatgctctcaatcatttattgggtggaacatagggcccccaatggaggagctagagaaactacccaagaagctgaaggggtctgcaaccctataggaggaacaacaatatgaactaatcagtacccccagagctcatgtctctagctgcatatgtagcagaagatggcctagtcggccatcactgggaagagaggcccttggtcttgagaagattatatgccccagaacaggggaatgccagggccaggaagcgggagtgggtgggttgggaagcagggcgggggagggtataggggactttttggatagcatttgaaatgtaaatgaaggaaatatctaataaaattttttaaaaaaaattaaaaaaagactgagttgttttcttagctctcattgtccttcactggagaggaaggccagggttttaccctctctctactgctgggaaagttacgaatcattgaaacacacataccaagtgaatttaagcttccaaagtccgcactgtgtctttgatgtatatcttttcagttaatttggcatttgtttaagaagcttggtttgtgtgtcccgggtttgtgacatgtacaacctccatgttacaggcttggtcaccatgtctgccatccacaatattaccaagaccattaccacctttccttctccttctccatcccctctgcccctccttcctacttattccctcgccttccttccctttcaaaagtgccccgt

SEQ ID NO: 1996 - DNA, 1200 bp, mus musculus
ttgacatggctttacttgacatattatgtggggcaatgggctacgcacagacagcctggtctccagtagagtttaggtcttgaatcccggtgggacccggtgggtggtaatttccacctccacggaatggaaggcattcgatcatgtctcctggacccctggctcctgttgaagttactgcccccatagccctcacagcccccacaggggaggtctgtggctatcagtcacccagatagtgtcccaagtttctgacattctagttagactccacccccacagttacctgactctagccaggtatgctcctccccacagttacctggcaacagcctgatagcccagcccactataagagggcctgcttggcccctccttgctctctttaagcttttacctttcttactctctagccctctttctctctttcccttctcccctctccccacgtggccatggttggcccctctctttcaaccttctttcctttctccctacctttctacaataaagctctaaaaccatagactgtctcagatcatgaaggcctgcgtgcttaaatgatgggataggcttctcctagtgagccatgtctaacctcccaccataaggccatcctgtgctccagcacctgaccaaggactctcgcctgcatgggaaccatccagcactgcttgcctcgcccctgccccagggccccaatttgttctcagttcctctgccatatccagcatcagatgccagaagctgagaacctggtacctggggctgccccttgtccaccacctgccgtgtggggtcagtggcttaacacagccagatgcccaccggggaccacgtggaaagcgtgcgcagttctcctgtgcctgcccacccagaacaccagaactctggcaagacacgggttccctcccactcccctctttcccccacacctatggccccacaatattaaaatgaaggcccctttccctgatgtcctgtggtggtggcagagttcaggacatttccttctccacaggatagacccttggaaagaccacaagaactccaggtgccagtcaggggagggcacagtgctgggtgccacccataaaggaaatgtgacttgtcagcatggttttacagaccccagatccaacagttctcagtctatgtcagtgaacttataggtcttgattgattctggtttgttcttct

SEQ ID NO: 1997 - DNA, 1200 bp, mus musculus
tacttacatggtttccactgaaatggggttattgtcttattgattgtcatagcacacaatacaatgttttcattacattttcacacacacacacacacacacacacacacacacgcacacaccactgcagttttctcttatttcccctcatttcccaggttttttccactttccacttcttgtctgtttccccaccactctggaatgaattcttaatcatattcattttaactgcttatattagctctaatcctgaaacagaaacatgtcttttctattaattaatttatttattcactttacatcccaatcacagccactcctaccagttcccttttatattgcctctcaccagtatcacccctattctcctcagaggaaggggaggcctgtcctgggtaccaacctaccctggaagatcaagtcactgcagtgctaggtgcatcctctctcactgaggccagacaaggcagcacagttaggggaacagaagtcacacactggcaaccgagtcagggatagcccctgcttcacagaaacatatttttaaatattcaaagaacatactgatgtttatcccttgggtacacttagcaatgtttccattttgacttggctggctccaggaaagaaaggctgtgcctgctttgaacaagatgggaagtagacaatatagattcagagctaagaagtttattctgtgagctctatggtgcatttgcaaggcttgatttttggagtacatctgtgcatatgttttcctaatcacaaaaccttcttgaccttacttcgcaacaggatgggaagatattctgccggcggacagcttgtgattgccagaatccaaatgttgaccttttctgctgcccagagtgtgacaccagggtcactagccaatgtttagatcaaagcggacagaagctctatcgaagtggagacaactggacccacagctgccagcagtgccgatgtctggtatgtcctgtccctaaggatcctggtgcctttactgtagaaaacgttataaacttgagagcttttgggcaggagttccaagatgttcccagtattatacagagtatcatgggttatgcttaaccagtggccatgtgttatgcctggagatatttacattgcatttaaaatgttgcaaaagtaaaaataatgaatttatagaacagatttaacctgagcagtttg

SEQ ID NO: 1998 - DNA, 1200 bp, mus musculus
gggtgtgttggggtgccctggactgtgcgaagtgagagtgctgggttctgatgatggtgagtggtcttggtttctgttagtaagattcttacatttacctttcaccatctggtaatctctggagttagttgttatagttgtctctgtttagagattgttcctctggtgattctgttaccctctatcagcagacgtgggagactagctctctcctctgagtttcattgtacagagcagtctctacaggcaagctcacctcttacagggaaggtgcacagttatctggcatttggacctcctcctggtcgaagatgaagggccaaaacaggacctttcccagaagctgttaatttcagtagtccacactctcacctgtgcagacaaatttctgcgaagtcccagaaacaaaatggctcctgtggatcctgaggctagggcctcccgggcagggcggacacctgacctctggctgggaaggtggctggatgtctgaagcctgaaaatggcgctgcctcagaagctctgttgctctcgcctggcccagaaactgatagcttccgtagtccacactctcgcctgtgcagacaactttctgtggagtcctggagccaagatggctccctcagatcctgaggcaaaaactttctgggctgggcggacccctgtcctctggccaggaaggtggccggatgtctcaaaattcaacattatgatagtagtacttagcatatcctctttcaagatgttgtaagatgttagacatgtaaaacaagtcatagtgcagtctttagtttagaaacaaagagtcagctcagatataggaatacacatactctgagaagggccacattggtcttcccagccttgcgtactgtctgtgacatgcctagatcttaggtctgggctattggtgtgtgggagtgctaaccagtttttcatgtggcttgtctccttggtgatcagtgatgaagagaacataatatctacttgatggtcattttccttataaaatatctaattggttattttgtccatttttttcttttgctattatataattctattttgcgggcaaggtgttcgatgcctatcaatagatgctttgaaattttttccaccaatctgtaggttatccttttattttgcagttcctttattggataatacaataccaattgttcattactgttttcttgtctg

SEQ ID NO: 1999 - DNA, 1200 bp, mus musculus
attccttcacacatctcaatgatattccagattatcacagcacacacggtgcattgatcactaatttctcaccaactataccttgctacctttgtttcaaaagatatttaataatttacctcttataatagtatcctgatcttcagtagaacatcatgctacatattttccaccttctttctgataccctgagctggttctacttaaaatttttaataagggagtgggtctgtctgggataccttgcagagttgagtggcatagtaatttcctgatccacatgtctgtctctgggcttgctctttggtccagaggaaccttgtaggacacaaatagcatcctacctcctcatggaaaccttcaggggccttcaaactaaccagcttggaatcccactggcaatgaaagctagtcttgccattgcagtgggccctcttgggacagtttgcagactcagctccacctgccataccagttgagtctgactgggacacagtctgcagagtaggtagggtcggccctggatatagcctgaggcataaccagcaaagtcaatttggtaccctgacctccactgtcaggtccacagctctccctaccttcctgagaagtcctgttgccatcaggatcatctagccaacatcagaaaaaaacagatgcttaaggacagcttaggaacacaatcagcaggactcagagcaaaaggtacctctagagccttaactatcctgctagagttaactctggataccataatgaaactgaagcacaagaagaggatcttcaattcaatctgatagagggttttaaagagggcaagaataaatcccttaagggaatacaggaaaatacattcaaatagacagaggcattaaaagatgaaacaaataaatataacgaagtagaggtaaatagaatcatacaggcaaaggataaaaataaaactgtccaagacctgaaaagagaaatagaaacaataaaggaaacaaacactgaggcaactatgcatatggaaaacttaggaaagaaaacaaaaaatacagacataagcatcaccaatagaatacaggagatggaagagagaacctcaggtgtagaagataagatagaaaaaaatcaacatatcaactgaacaaaatgtaaaatctaaaaaggtcatgatataaaatatccagaaaatttgtgacatcatgaaaggcc

SEQ ID NO: 2000 - DNA, 1000 bp, mus musculus
ttttgttcatttccatcacctgttgggatgtgttttcctgttttgttttgttttgttttgttttgttttgtttttttgacttctacctgtttggttgtgttttcctgtttttctttaaagtttctcctgtatttctttaagtgagttattaaagtcatccttgatgtcctatatcatcatcatgagatatgcttttaaatctggttgtagcaattcgggtgtgttggggtgcccaggactggctgaggtgggagtgctgggttctgatgatggtgagtgatcttggtttctgttcgtaaaattctcacatttgcctttcaacatctggcaatctctggagttagttgttatagttgtctctagttatagcttgttcctctcgagattctgttagcctctaacagcagacctggaaaactagctctctcctgagtttcactggtagagcactctctgcaggctagctctcctcttgcagggaaggtgcacagatatcaggcatttggacctccctcctggcagaagatgaaggccagaaacagggcctgtcccagaagctgtgccactttggcctgtcccagaagctgttagctttgatagtccacactctcacctgcacagactagccttggagggattgggaaccaagatatctcccccaggtgctctggcaaagccctcctggctggggcagacacctctcctctggcagggaaggtgtcctgatgtctggagcctgaaatggggactgcctcacaagctgtgtggcttcagcctgtcccagaagcttttagcttctgtagtccacactctcacctgtgcagactagtctctgagggatccaggaaccaagatggctccccctggtgcttcagcaaagcccccctaatgtctcttttgttttgttttgtttgtttgtttgtttatattttgcatgacagcatatttacagcagtaagataccttatgtgatgacacactacaagaaatacagaatttt

SEQ ID NO: 2001 - DNA, 1000 bp, mus musculus
ttactggttttcaaatttttcttgatgtgacatttgtctataatttttctgagtgcttataaatttagagattactaatggataatgaaagaaataaacagaaaatttattaacacttgttctcatggctttgattgatattatagtttacacaatgtacatacaattatttcataaacaaaaacccaagtaactaaatatatactcttgtggtaaatcacattttatgtgataaacataggtgcctctaattttcatactgtttagtaaagcatacagaaccaatcagatgcgttgacagcagaataatcttgaaaatgggtgtagatactgtagctatttgaattggcttagcccccatagattcatgggtttgaatgcttgatccatggggagcagtgctattgagaggtatagccttgttggagtaagcatggccatatttgagaaagtttatcactgtaagggtaagctttgagtctttatgcccaagcttcacccattgtggaattctagtctcttcttgcctgcctgtgaaagtttcctcctagctgcctttagatcaagatgttgaaactcttggctcctccggcaccaagtttgtttgcatgatggcatgctcacaccatggcagtaatggatagatcctctgacattgtaagccagccccaagaaaatgtttacctttataagagttgccttggtcatgatgtcaattcacagcaatagtaccttaaccaagacagaagttagtaccatgagctggggtattgctatgatagcgtgaacatgttttcattgggaagaatgtatatttttgaactatggattaggaaagcagtagaatactttggagcttactaagccatactagtagtaggaacatggaaggtagttgtactgagagtgatttgaactctgggggcttggctcaagaggtttcagaggagaggaagtttagtgtgttgcctagagatggtttctgatactttactgaaaa

SEQ ID NO: 2002 - DNA, 1200 bp, mus musculus
actgacttgaagttgcccattccggtggcaagaaatgacactgaagaaaatgaagtgatacctccatgatctagagacctgatcaaagagaagcctgtgtctaaagcaggaaactcacttcagaaagtaggaaatccactgaaggcagtggaaaatgagccagccttttggctagcagttcctcaggaccttatcagttcccccaaaagtcattaagtgagtcttcagttaagtcaatgaaaatgggttcctccgctgctcccactgaaaagaattccctgaagacaacatgttttccaggatgtaaagtcaaactcaaatggactgttaaaattacttccacctcttcatcctcgactaccattttatccttctttgctgtgtttgtcatagatggcctactcctttgcatccaataatacctcatatacctcagctacttgtttgaatatccatgttggttcttcatttttttccagctgtcatttaagtgtctgtttcccatacacctttttaatatcctccagtgaaacaggtttctgtatgcccaggacttcataggaatccaccattttttaagacagatttttggaaaaattccacgacccagttgccagcagaggtcgggtggggtagggtaggggcttaggaggaatagagaaactggtctccttgcaggtctggcacagctgctctgatggtagtggcattcacagaaataggtaacgttttaatggttaatcaatatatcaatgcaagcttatcacaacatgtttaataaaataagcgtagtaaacactgcttaaatatactgaaattctcccatcccgagactgtgtaggttagcactgcagctgtggtgacaggaaggtaatgttgaatgaattacacgtacaggaataacaaatacatggctcagggaggttatcgttcgtgttttgtagttctgatcacagaagcaaacaatctttgtggaagcaattgtatgctcaccatgaaatatttaatttgtaaagctattagcatcagataagtaatgaggaacagtggaaatcacaggaaatagaaaccaagcttctcatttgcatagaaactccctgacttattgcttctactcaggtcatggtgtattgttgcgcagagaattctgggacaccatcagttccaggaaaagctcaaaaccccaattttatgcgaagg

SEQ ID NO: 2003 - DNA, 1000 bp, mus musculus
atcatggcactattgagttatcccaggactaaggacatggaaggagaaagatctctgactaggcaatacagaaatcctatgccatgagtcatttgcccttaaaactgactgtatcttaattatgtgaatattaatgtatttatgtgagactcgtattttgtaattattatgtaccttgggtatcgggtctgatgtagggagaaagtgaagcctagtattttacataggaaatgaagaaggaacttagtcaacaaaactacaaatttaatcaggctgacattattttcttttccttatgaaaactgacacagcacattggatgaaaactatttcaggtctgagtttaaaggtacatgtcaacctcactcagctaaagtcccggcactatcaggtctgctcagttctgtggactccagtagacagtgaacttcaatgtccttttcagctcctacaggggatggtacttctctgatatctcctacttctgtctttaaaaccagcaaaccacaatcttccattttctcctgatcatgacctaagcttttgttatcctatctcctaccacaactgaccttaccttccttttagaaggactctggtgacataattggataagcttggatccaaaccttagtcccaatgccagtgtgtttgagctcatcactctgccaagttcatctcaccatgtcagcccaggcacaggttttgggattcccaagtgtgcatcttcctgcctctgtgtgggaccaggtacaggtatgcagtgctttttttcatacagacaggttctttttctgagcctggtacttcaggttgcctgcagccagcaagccacagagattctcctgtgtccctatcctccatgctcagattctaggtgtgtgcatgactatgcccagattttataaggatgctggggtctgagcttatatcctaacatttgtgcagtaagcacttctaactgctgaatcatgtgcctaaccccatagtcatcttttgt

SEQ ID NO: 2004 - DNA, 1000 bp, mus musculus
gagttctttatatatgttggatattagtcccctatctgatttaggataggtaacgatcctttcccaatctgttggtggtctttttgtcttattgacgttagtcccccttctaagaaacaatgaaacagccacattttggtcttctttcttcttgagcttcatatggtttgtgatttgaatattgggtattctgaacttttgggctaatattcacttaccagtgagtacatagcatgtgtattcttttataactaagttacctcactcaggatattttcttgtttcatccatttccctgtgactttcatgaagtcattgtttttaatagctgagtagtactccattgtgtaaatatatcacattttctgtatccattcttctgttgagtgacatctgggttgtttccagcttttggctattataaatatggctgctgtgaacatagtggagcatttgtccttcatttcatgtgaccatgtttgttatttcacccaactccctaagttctgaactttatgtaaccataaaataatattcaagatgaagttaacattgagataatactattaactaacctagctcaatttagcaagccatttcctttattatgtttttatagttcaggtttgaaccccaccctctactgtggtgttagaagcatatctcacatctggacagaccacacaagcccaaaactgttgcaggagaaaagggcaaaggtggcagcaaagaaaagatagaaaagaaagagaggtcagaggagtcttccttttatttcgacagtgacataaccactcgcaggtaaaggtgagaggtgagccaattggattctgggaatgtgtggtggtttccttggcaacagatgtgcaggctcctgtcaccgatgtgtgatgtcactaggtttggagctaatctgcagcactgataccctgataccaacaactactaagtacagctttgaattgtttatttcccctccatccagaacaaaagcttccct

SEQ ID NO: 2005 - DNA, 1400 bp, mus musculus
tcccaatgttatttttgattcaaactacaactctacttttcaatatgtttaatatccctttctatgctttgtgatccttccagcacttgtgctgaaatttgccttctagtatagcaccattttgtggtaggaccctaaaggggtgaataattcatgagtacctcttctgaataaatgaatcatgttatcataagaaagggctagctaccttgagagtgagtatttttaaaagtgttcgaccaaatttccagcctgtctcattcctgcttttatgtcttcataatactaaatgccaaactgcacatgctgcactatgaattctgatttgtttctatgggattttatagactagagcatatttgaatacatatttatctttaagggtttagttccagaaaagtaggtcacagcagctatggatatttgtacaagattggtccctcctactctccactataggcggaaaaaaaaatccatgatgccacatcccttcttgggtagctaaggactgtaaaatgttcatattgttgttccacctatagggttgcagaccccttcagctccttgggtactttctctagctctattgggggccctttgttccatcctatagatgactgtgagcatccacttctgtatttgccaggcactggcatagcttcactcgagacagctatatcagggtcctttcagcaaaatcttgctagcatatgtaatagtgtctgggtttcgtggctgattatgggatggatccccgggtagggtagtctctggatggtccatccttttgtcttagctccaaactttgtctctgtaactccttctatgggtgttttgttccctattctaaggaggaatgaagtatccacactacccccagagctcgtgtctctacctgcatatgtagcagaagatggcctagttggccatcattgggaagagaggccgctcggtcttgcaaactttatatgccccactacagggccaagaaataggagtgggtgggtaggggagcaggatgggggagggtgtagggaactttcgggatagcatttgaaatgtaaataaagaaaatatctaataaaaagaagaaaaaactgggaagaaaagaagtatgggatgaaagatttatgtatcacgtgagaacctgcctcagttaccatgtacatacattgagttgattaccaagttctgtgaaaagatgtccaaaaaaaagtttctggaggaagagatgatattttctctagtggtgtagccactaggggactaaaggaaggagcttgaaatggagaaactgagatgacaaagaggaattgaaggctaaagacaataacaacaaattttataaatgagattgtcaaaaagggaaaaaagagtacacttagggaacagtttttcaa

SEQ ID NO: 2006 - DNA, 1000 bp, mus musculus
ctttaatatgggccacaccttctgctgtcagccgggcatggcacatgcctttaatcccagcactcgggaggcagaggcaggcggatttctgagttcaggcccagcctggtctacagagtgagttccaggacagccaggactacacagagaaatcctacctcaggaaaaaaaagaaaaaagaaaaaaagaaaagaaaagaaaagaacataaaagaaggaagctggccccctttcaaaaggaaatgagagacattttattagaattagaggaaagtaaacaggtcaagcaaaatggaggtctcagcagcttctagaaggaggcagactgtgttgagaggaagagagaaacctatgcattctaacgttcaagatcgcagaccagctcagcagtgctggagacctgagattgcatacacggtgggtgggggtggtcggctgggaggatggctcatttggagagcatgggagtgctctgagtagttgtagagcagactggcttagaactttggccagtgttcgtagagttctgcttcaggcaggcttagcagtgagggactgtaaacattaaagatgaatacttctagcttagtaagtacatatgccattgatagggggaaaaaccattttgtttaaaaaagaaagcaaaatctagccacactttgctgggaggagacagcttttccttgtcacgatttgccgggaggagatggctttccttggtgggcctccaccttttcaaatggcattttcagttttgagagggacagctgtggtgccttttacatgccatttcaaattctaaggaggaggagttctgatatttcccccttccttgaaactagtgtgttaccagggaaacaagctgctcctactagctgacctgctgtcagtttggagatgtttattttcctagttttcttcccaattctgtccattttgctgtggaatttgaaggttttgggttcgatgcagacagagctaaggccattctgccatcagag

SEQ ID NO: 2007 - DNA, 1000 bp, mus musculus
cctgaaggctcagctgcccagagagtcactaagatgagcaagtaactggtgagagaggaaagagagagaagaagacaactggtgtgtgcaaaatggtgagagatggaactagagacttgagggtagtaaggaaaatccggatgtgagtagccagcaacaccatctaaggctgtgctgagaaccatgtctgggtccatggccctgtagctgcaaggtttgttaacaccaaaggataagcagatatccctggtttgggcctgctgtctgagcagagctggccccacccctcagcagctgcaacacaacaccttgctcagtaagtatagtagagctggccctgtttgcaggaaagaggggaatgttgcaggtgagccagcactaagaacagaaactcaggattgctggtcctgttccactgagactggggtacagatttgctccccccacccatcccttgcagcctgtggcaagcaggctggagagtgagccctataccttgcctgggcagcacaatggagctgcctctggagtgagccagccctgagtgcctaagaactgggaaactgactctaccccttgttgtttgtgactttaggtgagccagccagggaagtgctggagagctcaccctaatgggttgggtgtggaagagctgatgggctgaccagatcagctaccaaccagtcccagatccagggctttgagttggtccatcccaacgtctaccccatctatgaactgatggaacatgtgaaggcttggctctgtagatccaagacagaaggatcttcatgacacagggcaacaatagtatatctgaaaggaatccagataaggatacagttttgataattggtggtgagcagaagccagaggtctctggccagaccaatgattcattgccacggacatttgcaagtaaagatgtgtggacaaaacgttatactttgggacacactgcaacatgctatagcttccacaacaagattcttttttcttc

SEQ ID NO: 2008 - DNA, 1200 bp, mus musculus
tcaaattttattcttctgaatgtgggcatccagttttcccagcaccatttgttgaagatgctttcctttgtctttatggtttagcatctttgtcaaataataagtggctgaagttacatactacggacttcgatttagttgtactggtctataggtttgctttgtgcctgcatcatattggtttttttttttttattacagtttctctttaacatattttgagacctgggaacttagttcttcctgcactgtgatttttgctcaggattgtttggtctaaccagggtcttatgtggttccacatgaattttaggatagtttttttttctagttctatgaagaatgaaatatatgctttgattgtgattacactgaatctgcaaatagcttttggtaaaatgaccatttttttcacattattaattctaccaatccgtgagaatgagatatctttctattttctagtgcctttatctatctctttcttcagatgtttaaagctttcattataggtatccttctctttcttgttcaggtttagtcctagatattttatttttctttgagactattgtgactgggagtgtgtccatgagttctttctctatttgttattgatgcacagaaaagtgattggtttgcacaattgattttgtttcttgtcacactgctggatttgttcatcatttataggtatttttggaaactcccatatagtctgcaaatagggttgcagtgtcttcttttcctgtttctgtccctttgctttctttctctggccctctcgctccagccagtgcatcaagcacagggttgaaaaggagtaggggtagtggccatccctttctcattcttgacatcagtggggtggtgctgagcttgtctccacttagaatggtgttggctgtggttttttcatgtagagcttttattgtgttgagctatgatccctctgtctctatcttctctagggctttttatcatgaaaacatgccagtttttaacaaaggctcttcctgcatgcattgaaataatcatgtgtcttttggttttaagttcatttatttggtttattacatttatttctattgtatgctgaaccatccctgtattccagagataaagccaacttggtcatgatgggtaatcttttgatacatgtctgtattctgttttaaaatattttattatacattaaaa

SEQ ID NO: 2009 - DNA, 1400 bp, mus musculus
tcttacaattatttaagacaggtgtgagagtgcatgcttttgctttcagcgcttgggaggcagagataggcaaatctttttgagatcaaagtcaatagtcaatctggtctacacatcaagtttcaagccagctagagttatacagtgagaccttgtctcaaaatacaaaaacaaacaaacaaacaacccacaaatatttgaatctattattctgtagactctggtaaaatcttccacataaatcttctcatttaatccataaaacaaactaagcaggatatagtaatggtgttaatctttacacaaaggcaaaggatgtttgacatcaagcctgaccacttgtggaaacaactccatgattcaacacacatgctgtggctggcaagtcttaccattctgtggtatgcgtgtgcacacacacacacatacacacacacacacacacacacacacacacacacacacacacacacacacacatttatttaaaacaattgacacaaaaagcagaattgaataaactctcagaatcatgcaggggcatttaattctcttttcatttccctgtttagctctacagacctgaaaacttctaaagataggaggttctgtatatcagatacctaaagaaagaccttcctttattcctactatctagctcagcttgtctcaaagaagatttataacagactatgaaaatgaaaccctgtacagtctacaactgacatgtgcttagtgttcaggcctgatgacccaacctggaagccatatagagatggatgcagaaggccaattccatgaagctgtcctctgacattcatttgcacagtcacacactcagagattctgctgagatgagagcaggtgggcctgcccactggtgcctggctggccagtccaccagtgcattgccagcatagtgtggattgtttttcttaatatttcatgcaacagggatccacatgactttgctttccaaaacctggtattaaaggcctgagccaataccacctggcaataaaaattttaaagaatttttatgaataattctgatgtgtataactttccatttgaaactttaaaaatctaatcctaagaatcatcctcactgttactgtcttaaccaagatatgaacacatgaacatatggcatgtttcccaagcaggattttacagagcagatatacacgggaattatgaagtaaagaaacatcatataatccacactattccccaaactgtgcctttcttctttgtccacttctacatctactattaactataggtatgagcactgtactggaagaaacataaaggatatgagagggaaaaatcaagcaataacatgggaaagctgactatgcaaactgttaaaattttataaaatggaatggacagca

SEQ ID NO: 2010 - DNA, 1800 bp, mus musculus
tggaaccaagatggcgaccgctgctcctgaggctgaggccacctcccgagccaggcggacacctgtcctctggtccggatggtggctggctgtctgcggcccgccaagggtgctgcctcagcggctctgtgcttccgcctgtcccagaagctgtctggttctctggtgcaccctttaacctgttcagactaatttcctaagttctgctgagtcccggaaccaagatggtgactgctgctgctgaggctgaggccgcctcccaagccaggcggacacctgtcctctggtccggatggtggctggctgtctgcggcccgccaagggtgctgcctcagcggctctgtgcttccgcctgtcccagaagctgtccggttctctggcgcaccctctaacctgttcagactaatttcctaagttctgctgagtcccggaaccaagatggcgaccgctgctgctgaggctcgttggtctcttcttaatcattgctattttcttagcttcagctaatccacatcaatcatcccagtaatgcaaaggttttgctttagtacttctggtatcttgttaatcgtagttgattcttcagccccagctaaccaaaaccacagaaccttcacaatcaaattagtaatggccctgagaagagtctttaatcttccatctgaaaatttcacaagccaggcctccatcatttgcactattctcaacattatcttcccggcttctacaaaacatccaacatagctcttaacacccaatggctctgctagcccaaagttccaaagtccttccacagtcctctccaaaacatgatcaggttgtcaaaggaatatgctgataccaatttgtcttagccagggtttgtattcatgcacaaaacatcatgaacaaaaaacaagttggggagaaagatttattcagcttacagttctacattgctgttcacaaccaaaggaagtcaggactggaactgaagcaggtcaggaagcaagaggtgatgcagaggccatggagtaatgttacttactgacttgcttcccatggcttgctcagcttactttcttatagaatccaggactaccagcccagggatggcaccacccacaatgtgctctcccacccttgatcactaactgagaaaatgccttacagctggatatcatggaggctcctttttctgtgataactccagcttgagtcaaatttacacacaacaccaaccagtacattttgtttaatgaagggaagaaacacaaataaaatgtggtatatcagaaaattcttccagttttgatgagagagaagaatcctggtgacattgatattcatagattcttcttgaatctatggcattcaagaaaatcctaggagaaaacctccacaaactaaggaaagatgcacacatacagatacaataaaaatgcagaaaagcaaataggctttccacagcatatcatacctaaaacaaaaagtgtatagaacaaggaaagtgaattcaaagcatcctgaaaagtgacctccaaaggaaaacccaccagaattataggtaatttctcgaagagaactttgaaagactaagaatcctggagcaaagcatttgagtcctaaaagactcagtgccaatatcctactaacatatacatcaaggccatctgctacgtgtgaaagagaaataaaaacactccataatattaacagcctaaaaaatgtatgtccaacaaaccacacctagataaaaatgcatgtagcttttaatttctctcttaatttgtcttgacccactttttattctgtggagag

SEQ ID NO: 2011 - DNA, 1400 bp, mus musculus
cactgagctgcatggtcatatctagtggattcttgtggagacttgactacatatgcatggttgaaggaatcgccagctttgggcgataatatttaacctccagcctctctcctctgaaattagtgagtcttaatttcacaatatcaaaccttaagaaagaatcaggaggaaaaagagggaaaaccaaaggcaaaggaagataaattggggtgagataagccattgtgtgcaactgaataataattcacacatgaaactttaaactttgagtaagtcacaaaaatagtatgtgtgtctgtgaatcttatggtgtgcttggagtccagaagagggcatggcattcttgggaagtacagttatttgctgtcgtgtgcgtactaggatttgaacctaagccttctggaagagcagccagtgttttaacctctgaactatctctccagactcaaagtttttctttaagagtgaatattcttgtctttcttttcttttcctttcctttcttttctttttctttctttctttctttctttctttttttttttttttttttttttggtgttgttttttgagacagggtttctctgtgtagccctgactgtcctggaactcactctgtagaccaagctgacctccaactcagaaatctggctgcctctgtctccccagtgctgggattaaaggcgtgcatcaccactacctggtgaatattctcttattgtctctcggtagtaatttctattatcataatgcctatggactttgtacatgggagaagataatatgaaaacttttattcttcttttcttaagacatgtttgtatacaatatagctgtattaaagctcttagagtgtactgagaagaaatgaatcgcttttggcaagttacagtatcaagtttctcataagggagaagaaagatgagaaatagccttcagaaaggcaccgagagtcagtgaagatgtgtctgcgtgctggagtacttatcttccccacacccttggagtgatccccagcaccataattaaaaataaaaatgtatctttcttctgaaagaaagaggaaagtcatttatatggcttcagcaaagagcttctgaaagcctgttttgacagaatgggggttctgagagcatcaagacataagatcaaaacgcccacaagactaagatgagaggagaaatgcctcccttgtgaaactcagccagctctcttttaagcaaatctcttgtaaagttttttttttcaattcagtgtctagatttgcacaatgtaaatccagagcagagactcattggacaatatattatttacagtcatgtctggaataaaaggcttacagttgtcagcaaagacatagtgagtcttcagaaatatttgttttttaaacatgtttcata

SEQ ID NO: 2012 - DNA, 1200 bp, mus musculus
gcaaaacagcccttatttggggatttcattcatttcattttagttcagagtttcatttaatctcaatgaatgaaaaatcaaacagtgaaaatggcgatctaacctgtatttggaaaagccagtctaacagtctcagcaccaaaccctgaggacaaggctcctgacctaccctttctcagcaccagtgtgctgatccattaaactattgtttctcctactgcactgcagagggtatagccgaggtttagaaagagaggcaagtctgagggttggatgtgagctgtatgcaacgccaaagagcagagccaccaagatccgcaaagccgcgcgtacagagacaatgcctccagcactgcagggactgaggactcagtactgccgcgcaggcgcaaagacagcctgccgaaacgcagggcggggcgctagagacggaagcagctttgaatgattcaacagacttaaactagaagttgttttcgtcagttcccacatggtctagcggttaggattcctggttttcacccaggcggcccgggttcgactcccggtgtgggaacagcagctttttttttttttttcttgtgacgtgctcagcgtttcacagtatgacatacaaacagtggtcaagctgttagattctgaaaaattccctggtccttagtcccctatggccagttgttacgaagtgaaaaacttagaaacactatcagtgaacagaggaaccacctttcaggacctgcccagttggagccctgctttctttggaaagaagctttgtgaaggggaatcgcaaaggctgagatactaagaaagcaaactcccagaagaaacaactttatggacaagtgcagagtaatacaaaaggcaactggagaggccacattcatttattcatctcctcacactttgcctaataacttacaggaaacaggcatggaagcagtctctgggtagaattacagttttagttaggctcaagcttccaagcaaagccatattttcagaagtgggagaccttgaaatcttcaatgctgcaaacaaatccaacttgcgtgtttgccatggtaacccaagcctgcatgtgttagtgcatacgtgcaattgtttcaatgtttgaaccaatccctgtgctattcgtagagcttaggtaaaccttgtaaccaaccgcaccatgctccagttgcttgccttaatgcagtg

SEQ ID NO: 2013 - DNA, 1000 bp, mus musculus
ttgacattactgtggccgttgtcactgttctgccaccacagacatggctgcagccatatcccttattgagacagtccatcgtacataataattccactcatgtcaacgtgtccatggctgaaggattggccagctggatcgccacagcagtctcccacctgaatgagtgggctgacattggtggacttgccatgtgtccaattctcattggcatcttggccttctggtgcatctgccgcgtacagagtcatcagcacagagcccaagccttgatgatacaggcttttgtggcagtggaaacaggataatctcctcaagtgtggcttggcatgctagagaagtagtcagtgatgggtaagactccctgggcgtgtcaccaacctaagacagggatcaaaccaacactgtttgtctcctgatgatgggtaaggggcattgccgcagggggcaacctaagacagacattctctctgccaatgagtaaagaaggggaggatgtgaggagcgggtgtggcagcagccccaatatggcgcccggaactgcagccaagtcttatgacttgcacctgacttcctcatacacctgaaaataagccgtgtccatcgtgagaactgcacagatgcaccatgatgcaagatcggaccatatgatgagtggtgattctggccaatgaactgctgttaaatggactgggctgatggggcatggtaggagggttatataaggtattgcaattgggggtggggagagagaaaaaagaagagagatttttttttcctgcatacatgttgaaaggttcctgaataaactgctttgagaagaacgctgtgccgtcgctcttttctgctggtcagagacagaagcgacaactgtgcttttatgaaagtgggcttaaagaattgctttctgttacccttatgtgaggacacaacacttggtggacttacaagaatccatcagactggcacttcattttagacttcttaactccagaaatgt

SEQ ID NO: 2014 - DNA, 1000 bp, mus musculus
ggtttggttagacatgattcatgttgcattcaatattagtcaatgcataaacaaaaaattcactaaaaaaatccaagtacaggaaaagagtactcatttatagttcagtaatatacctgggggaccattagcattgatgtttgctaggtgaggaagtgtcactttaaaaaaaaaaatgtgaccactggtaaaaatacagagaacatattttgactaaagagtgacattatggttccaggactccaccgagactactctgcacaggtgagagtgtggactacagaagctaacagcttctgggacaggcagaagccacagagcttctgaggcagcccccttttaaggctccagacatccgggcaccttccctgccagaagataggtgtcagtccagcccgggagggctttgcaggagcacctacgggagccatcttggttcctggatacctgtgagactagtctgtgcaggtgagagtgtggtctacagaagcaaacagcttctgtgcaggcctaagcaacacagcttctgtgacaggttctgttttgggccttcatcttcagccaggagggaggtctgaacaccagatatctgtgcaccttccctgtaagaggatagcttgcctgtagagagtgctctgaccactgaaattcagaggaaagatctagtatccaaggtctgctgatagaggctaacagaatcatgagaggaacaatctctaaccagagaaactataacaactaactacagagattaccagatggcaaaaggcaaatgtaaaaatcttactaagagaaaccaagaccactcaccatcaccagaacccagtactcccccctcgcccagtccagggcaccccaacacacctgaaaagctaaacctggatttaaaagtatatctcatgatgatggtagaggacatcaagaaggactttaataactcacttaaagaaatacaggagaacactgctaaacaggtagaagaacttaaagaggaagcaca

SEQ ID NO: 2015 - DNA, 1000 bp, mus musculus; identical to SEQ ID NO: 2014

SEQ ID NO: 2016 - DNA, 1000 bp, mus musculus
tggaacatttataatatctttgtgttgatgaacttaaattcacaagacttttaatcttagaaaccactgcatgaaatgtatttacaccagcaaggctacaccatcgaaaccataccaaacaaatccacagcttaggaaccaagtgacatgcccaagtgaggatgcctcagtcccacttgggagagagaagaaagcaatcacaagttgggagggaggaaggatcttagaggaaaagtggatgggatgtggggggagtggggcagagtggagaacctgatctggtattgggtgagggaaaaggactgaagccccgaggaccagcagaaagaatgtaaacagaaatcctaaggaaataggaggttgggggcatcccccataatgcaccagagacctgggaggtaagagaatctcaggactcaaagggaggggctttagatgaaatgcccaagagggaacttatagagcccacctccagcaggaagacaggacatcaagtgagggatggggttgccatcccacagtcacatctatgacccataattgtacctgtctgaaggaattacagggataaaaatggagaggagcctgaggaaaagaaggtccagtgaccggcccaaaatgggatccaattaaaggggaggtcccaaggcctgacactattcctgacactaggagcactcacaaaaggggatctatcatgactaccctttgaaagacccaacaagcagctaaaagagtcagatgcagatatttgcactcaactgatagacagaagcagccgacccctgttgttgaattagggaaggctgaaagaagttgaggtgaagggcgatcctttaggaagaccagcagtctcaattaatctggacccccaagatctcttaaacactgggccaccaaacagacagcctacaccagctgatatgagggccccagcacacatacagaagaggacttctggctctgtgttcattcagagatgatgcacctaacccccaag

SEQ ID NO: 2017 - DNA, 1000 bp, mus musculus
ttgggcatatctccaaaaaaaagaagtccatatcatactatatagacacttactcatttctattcattgcatgtatattcatattagtaggaagaagagacagcctaactgcctataaatgaggaaatggttaatgaaaatgtggtacatcacacaatggaatattactaaactgttaaaaagtaataaaactcagagaaatgcagcagaaaaaactcatcctgagttacccgttacctcccacacaactcagaatattgcctaagctgttgattgctcttcacaaaccaatgatagctctaatgcagattacacttacatttttattaaacatagaaaagataagcaggtgcctaactaaaacctttaccttctgcatagtgttgctggcattgaaaattattccgaatggttcctgaggggaaatttaaacaacaaacccagctctatactctttgatctgccacagacaggacagctgccaatatgatactctgctgtaatagttgcccttttgagggttaagcaattactatctgactggattagaggactactccatgagacaaaatacatttttgatgtagttctcatggcaaaatacctgagaataaggtaaaaacatgtaccattgtctgcttatgatatggaccaatacaaacattctgttatacccatagttcattataccattgcaccttcatcatagaagctaatatatacattagatgaggccagatacatagacctataaccggacaatgtgcagagtaaaagactttggctcatccaatcataattcatatattgctatgcaaactcctccttcatgactcagtgaaatttgtagaatacattgtagaatgacactaaggccaatggtgtttggagcaatgccaacaaggtaacaactcctaccagacattatagggctgatgcatatatgaaatcctacagagaatgacacttgcacagggtctgtataggtcaaagttatttg

SEQ ID NO: 2018 - DNA, 1000 bp, mus musculus
cccactccctggacatccagtatcttgaggttaggtgcatcttctctgactgagtacagaccctgcagtgctctgctgtatatgtgttgggggcctcatatcagctggtgtatgctgccttgttggtggctcagtatctgagagatcttggggtccaggtgatttgagactcctggttcatctatagagtcaccctcctacacagattcttccagcttttcccaagttcaaccacatgggtcagcagcttctgtccattggttgggtgtaaatatctgcatctgatatctgcatctttcagctgcttgttaggtcttttgaagggcagtcatgataggccccttttttgtgagcactccatagcatcagtaatagtgttagtttttggggcctccatttaagcaggatcccactctgggcctatcactggatctccttttccttgggcttttctccatttttgtccctgaagttctttaagacaggaacaaatatgagtcagaatttttgactgtgggatggcaaccccatccctccagttgatgtcctgtctttctgctggaggtgggctctacaagttccctcttcccactgtaggacatttcatctaagattccttcctttgagccctgagaatctctcagctcccaggactctgatacaatctggatggtcccccacctcctacctcctgaagttgcctgttcccattctttctgctggctttcagggcttcagttttattccctccaccaaataccagatcatgttcccctgtcctctttcccatccaggtccctccctcctctcccctcctgaaattgttttcttttttgtagaggtttccatcaaccttcctgtttcgttgaaagctagatggcgctgtgagcacagacataatcacttcttcaaacctggcttcaggttttaaggacaagaatcaaatctgtgtctaggatctgtgagtattgaagggactttctgctgtgagaatacattt

SEQ ID NO: 2019 - DNA, 1000 bp, mus musculus
taagcacagccttttttttatacttgggtctctgaatttttttaactccagattttatcccagtccaccctttgactattcaacattccataccttctccctcccatcctgcctccaagaggatgtcctcccactcccaccccaccagacactccactatctggggcctccagtctctgagagttaggcacatttactctgattgatacagtcttctgttgtatctgtgttgggggcctcgtaatagctggtgtatgttgcctgtttgatggtccagtgtttgattgatcttgggagttcaggttaattgagactgctggttctccttacagggttgccacagcttcttccaggattcctctaactcaaccacaggggtcaagtagcttctgtccattggttagatgtaaatatctgcacctgactctttcagctgcttgttgtgtcttttggagggcagtcatgataagtacctttttgtgagcactccatagatcaataatagtgtcaggccttggggcctccccttcagctggatctcaatttgggcctttcactggacctcctttttctcaggctcttctctatttattcccctgtagttctttaggacagtaacacttatgggtcatagtttttgactgtgggatggcaaaccctctttcacttaatgccctgctttgtgctggaggtgggctctacaagttccctctccctactgtagggcatttcatctatggtccctccctttgagttctgtgagtctctcagctcccaggtctctggtacattctggaggatccctccacctcctaccttccagggttgcctttctccactctttgctggctctcagggcttcagtccttttctcctacccaattactggtcacactcccctcttcccctccctgtccccttttgaagaggtttccatcaatctttctgttttgttgaaagctagatggcgctgtgagtacagaggtaaccacttgttcaa

SEQ ID NO: 2020 - DNA, 1000 bp, mus musculus
gaaaactatgaaatgaaagaatccataaacattactagcatattaagcaaaatgtttccttatgttcactaaaacctcctttctcctcatatttaggcagagatattataagtggagttgcagaaatgtttttaaaaaggtgtagcaaataacattttaaataacctataatgtccaaatcaattgacatatatatatatatatatatatatatatatatatatatatatatatatatatatatatatataaaaccttaagtttaaaatacttggtaaaatcatgaattattcatttgaaagagaatactaaaataaattcacttaaaataaaaagatcacatttattgaaattcatatgaaaagactcaactaatggaagcacaggcttggtatgctcatatagttagcatggagctgatttccctgccttgttctcagagacatagcagaggcctacatcattagctgcctgagcacctaccaggtgtgccaggagtgctaggtatgtgtagcaaaagggccccccaccatcctagatctctctctgttctcctgtttctctctctgttcctggcatatgatctttctctactcccctttttatctgccctccctgaactgctcctttttatctgcttatctacatgtgcacttctctgcatctatcccttgctcatattcttactcctcaatcctccccaataaatccctttcataccagatctgctgcatggcttaatttctcaggggtgcacattcctggactcaccaaagttaccctctcaaaacattatttttcacatatacttttgacatacaaaaagtgtgcttatttagtcagtcaattttcaaataaacacaactaatttctatgtttccccccccccagagggactgtaaggcacagcaaacagcatttgccatgcagacccagagaggcattacaaataggtcatttgtgtttattggtgccactttcttagactcacagatttcta

SEQ ID NO: 2021 - DNA, 1600 bp, mus musculus
agtttaattttattcagttgcaactgctggatcacaggcatctgcgcatctcatattcagtataaatattacccaacttttcctcctatataccatgcctttgaaggtatatgcgtggcaaagaaatcatttgtagttcatttctgattcctttatatttctttcttattagatattttattcatttatatttcaaatgttatcccctttcctggtttcccatctgcaaaccccttatcccatcccctcttacccggcttctatgagggtttttcccccacacagccaccattctgccccaccatcctggcattcctttacactgtagcatcaaccctgcacaggaccaaaagtctcgcctgctattggtgtcatataagggtccctcagctccttagtcctttccttaactcttattacggttcctgtgctcagtctgatggtggcatgcaagtatccacatctgtattggtcaggatcgggcatagcctctcaggagacagctatatcaggctctggtcaacatacacttcttggcaaccacaatagtgtctgcatttggtgaatgtatacgggatggttccccatttggttcagactctgtatcgcctttccttcagtatctgctccatgctttatccctggatttcttttagacaggagcaattatggtttaaaaatttggaggtgggtgggtagccccatccctcacactggggcccctgggtaacctctggatatggtcttgacaggttctccctcgactttgtagggtacttcagctaatatcacccccatggggtcttgggaggctcttgccttgttggtatctatgactttctggttcctacatccagttccccatctcccaatgctatacacatctgttcaatttcctgaccttctatacagctcctccatttcttcccattcctgattcttcctctatcttcccctccccctcttctcatcctccaaatttcctctcacactctatttcccttgataattttattcgcccttctaaataggactgaaatatccacctacactttggtcttcctccctcttgagcttcatgtggtccatgagttttaccatgtgtatttcatactctttgcctgctatcaacttattattgagtacataccatgtgtgttcttctgtgactgaggtacctaactcaggataatattttctagatccatccatttgtctgtgaatttcatgaggtcattgtttttaataactgagtattattccattgtataaatacacaacattttatccatcaattcctttgttgagggacatctgagttgttcccagtttctggctattataaatatggctgctatgaacatagtgaagcatgtgtcccgataacatgttgaagcatattctgggtatatacacaggagtggtataactgggtcctcaggcagtagtcaattttctgagtatttgcaagactaatttccagagtcattgtacaagattgcaatcccaccagcaatggagtagtgttcctctttctctatgtcattaccaacatcttctatcacctgagttttgatcttagccattcggaactggtgtg

SEQ ID NO: 2022 - DNA, 1000 bp, mus musculus
attacaaggatattatttaacagtaaatcctcatgatatccttcaagagaaaaagaatatctaagaagtagcttatatatccacatgcaaattctttagtctcatgaatgctggacattttttctaacagagccaatgataaagtcaaaggtcaaaactaaaaagatgatatacagtgggtcaagaatttgaacagagatgtgtaggaatggagaaatcgagaactgggagtagccatgagcaagaacagatgcctcgaaggcaagaggcttctaggacccaagagggattagtttagatgaaatatcaaacaaagtggaggaagaacctgtagagaccacacccagacactcgaggaggcacctggtgggggatgtggcgaaccactcatctccaaatttttaaaacagaatggctactgtctaaatcaaataaaggaacaaaggttggagaagagactgaagggaaggtcacacagagattgctccacctggggatccattccatatacagacactaaacacaaacactattgcttatgccaagaagtgcttgttggtaggagtctgttatagctgtctcctgagaggatttccaatagcctgacaaatacagaggtggatgctcatagtcaacccttaggctttggtcaacccaggagaagggataacatttaaaatgcaaataaagaagatacccaataaaaaataaaaaaaaaggaaaaataagaaagtggatcatttgaaaaatgcaaagagtcagaatgagtggggctgaaaagacaggcactgatggaaggattatagaatatctgtctgagaaatgttgatccccaaaaatgggactccagaggctgcaattttgaggtactttaagggttttttctaaaaacattcatagtcagaatttatggtgatcagatcaccatttatgataagccataagtttataaatcatggttggaatagatagggatgtcaacagtaccctatttagctaa

SEQ ID NO: 2023 - DNA, 1600 bp, mus musculus
catgctctctcttatgcattttatttccagagagtaattaaacttattacaataactactacaattatgatagtcaaaataaactactaattttaacactaatagaaaattgtgagctcattgttactaagtgtagacatatgaaacaatataataaaagatttcaaaggtataaaattgagaataaaatatcataataggtattaccctaggtaaaatatcatcctaggttgccttgaaagcttatataaatgtaaataaaagtgtcttacctgcatgagtaattctttgagcacaaattttccaaagaagctatgcaaaaaaaaaaaggaaataaaaaataaaaaaagatcaacatgttaagccttatgaaagcacaaatcaaaacagtcttaacatagactgtatgactctaagagctctaatctaagtgaagaagcaaattttgaaataattttcaaatgggtaattcatctaagaaggtagaattggcaatttaatttactctatattctgtatatggtgtttgcatgactttgaaagttttcttatgtctttcacttattttattagaatttcatgtttgagtattaaatttaccaatatttctaccacatcaaactcttcctgtaattgtaggcacaattactcatcatgtcttcttctcctcctcctggtgtttctggtcctccaggtcctccagatcctccaagtcccccaggtcctcctgctcttcttgctcctcctactcctcctattgtttcccctcttacactgctgttgctgctgctacagttcctggcactgctggcagtggtggcactgctgttgctcttcctgctgctcttgatcctgctgctgctgctcttgttgctgcttctgttgctgctcctgttgttcctgctgctgctgttgttgttgcaggcgctgtctctgcctctgtaatttaaatgccaaatataggtaataggaataccagattttaaaccctcaaatatttcaccatgcaatcatcacttgtttctctgctcagaattccagatgaagatcgatgagctttcctagaatatcagaagttcatgtctccttttaggacatcatattagtttataggattgatttcatagtgttatccctagaaaataatatattttcttttggaaatataacaataattttaagaaaaacaaaattcaaaatctaatatatgtaattcaaaaatttaaatttcacttaaaaagaaaacaatttgtcacactatacacatgcaaaaatgataagtgtttacctttcaggaggtataagaagttattcataaatccaaatctgattcatcataataattcatcataatttattctctgtctctctgtctttgtgtgtgtgtgtctctctctctctccctttccctctcctcttgctctccctctctctctagctctccctctctttcccccctcctccccctccccctctcccctccctctctctgtctctatctctctgactcatatatttatttaggctttgaacacttgtagaagataaattgaacatcagtgattgaaggagatggattcaaagtgggtatacgcaatag

SEQ ID NO: 2024 - DNA, 1000 bp, mus musculus
aggacccagatagagctgtctcttgtgagactatgctgggacctagcaaacacagaagtggatgctcacagtcagctattggatggatcacagagcccccaatggaggagctagagaaagtaccctaggagctaaagggatctgcaatcctataggtgtaacaacaatatgaactaaccagtaacctcccccaccccctgccccggagctcgtgtctctagctgcatatgaatcagaagatggcttagttggctatcattggaaagagagacccattggtcttacaaactttatatgcctcagtacaggggaaagacagggccaagaagtgggagtgggtgggtgggggagtgggtgggggagcatatgggggacttttgggatagcattggaaatgtaaatgaaataaatacccaataaaaaaagaacattaaaaaataaaaaaagatagttcatcaccaaaaaaaaaaaaaaaagaatagcacaatagtgaagttatatcaaattgaggtaaagtcttctggaaagtgtttcttaaatgtcaacacacagagtggttggaaaggttgctcagtggttatgaacatagaatgttcttccagaggacaagggttcaatgtacagcacccacatggcagctcacaagtgtctataactccaagatctaataccattaccaaacatacagggtaaacaccaatacacgtttaaaaaaaaacgagtcaacacacagatgtgttccatgatcttttaaggtgattcctcctgttagcagccaataccagtactgtaaatgtcatacagctctggatttgaaggcatgagagctgtagggcaagtgtgagctgaaagaatgggactggaataggagtgaggttggtaggtttctaaccccctaaaatcacttcataaaactacagtcttatcttgacagcagcaagaataaggactccctccctaaattctttgcctgaatgctgcagggcatatagccccacaa

SEQ ID NO: 2025 - DNA, 1000 bp, mus musculus
ccagccgggccaaataattacctcttaatgagaaacattgtctttcagctcatagtgtcagagacttcagtgtatgattgactgctgctaggcttgtggcagacaacaactcacaggaggagcattcaagggaggataaaatctgagaaatcgatgaagggaagcgaaaacccaaaacgatatcctctgtaagtttagctaaaggtgatctagtcattaattgaactcataatggtagcatagcaatgtacaacgtgaaaacattttttcattggcttcatgacatagcaatgtgctatattaattcactcttcaactggaagacgccttccatacttgaaatatgttttatactaggtcattgtgtgtaatatttccatgcattattgcagtcagtttgcttatcttttgaaatattttgcacttatttcagaagaaaataatttacctgatgaaggactaatatctgaaatcatataataaatatggaactactgaagctcaaatattccagctcaaataacaggtgagccaactgaatacatatttgtccaagaaaactagtaaatatgcagtaagcataaaagtgctttaatatcagttagagagatggatcaatagatgaactccttgccacacaagggtaaggacctgagtttggatactcagaacatatacaaaattcagactgggatagtctgattctgtaaccccagcattactaccgtgatttacaaaccagagacagtagaatccctagatcaatctaggccaatcagccttacaaaaccagagacagttaagagatcttgtctcaaatgaagtggaaggtgagaactaacacccaaggatttcttctaacattcacaattatgctgtggcacatgcgtgctctcattgccacaaaaatgttcacatacatacatacatacatacatacatacatgcatgcatgcatgcatacacatgcacataataaacaaacatacataaacaaaat

SEQ ID NO: 2026 - DNA, 1000 bp, mus musculus
ctgaactgagatgtgcacatttgttatgcttttctgcacaagtctcctctatctgtgaaaggacaacataaaccccatttgtcctcatttaaggaccacatttgtctccattttgaggaccaggactgatttccagacaggctgtaagggcccagtttcagaaatagaccacaagtcgcagaaattagatcctaagacgccagctctaggaacagaccataaaatcctgaacaagatcataaatccctctcccaaagatcagcctggggataactacaaaaaatggggaaatatcttatctcagaatgggacatctgagctggacagccctatttcatcacatgaatgaaggctcatggaataggactggagaccacctgtgaccccctagtacccaccaatgaaattttagattccttaatccttctagagtcctagggttccctataagaaggcatgcttgcctttatctgtcattgccatttcaaagaatgattgacccccgcatgataattgtttctgtagaataaaggttctttgtttgggcatactgagtctggggtcttccatcagcgatttttggacctttacatctgtacaataattattagtagaaaaaaaaagcaggacaaacatttctgactaagttggtcaatgattttttacacaaatctcaaagtcaaatcaattgtgaatcgcatgaaactacaaagatttttttccactcaataaaaatgatcaatagcttccaaactttatcaagaattacacagagagtgttgaaatatatatttgccctttccttataagtatgaatatacatttttttcagttaaggttctggtccacgtttgatataggtgatgcaatctcagttatgttctgaccctgacaatggaaagaggagactgaaagatccagataatgactttagtttagaatcaggccacagggctaccctctgctcaatgcaaaaacaacaccttcttattccagttct

SEQ ID NO: 2027 - DNA, 1200 bp, mus musculus
aaggatatataaacctaatggcttccattatcaatgaaaacaacagagatttaccctctaactgtaaagccaacctggcccttcgatggtaatctccatggatttcctggagatgatttactttctaccaagccagctgtactaggacagtaggaaacatggcaatacaagtgagttccatgaacaaaattccaacctctacactgttttggctctgaatttctagattagaaataatgttatcaacaagatccttccggtttccatctgtgctcagagctgagcttgtgtcatagctctccttacccaaataccagccaggagtgctgcaatgtctgtgagcacaggtacatccaccactttcaattgaaggaacctgggccagatccctcaggacacaggaacaaaggagcagcctaagactggaacattccatttttcatctatggccagagctgaccctatgacagagctctccatacacaaatactgcccagagagagctagtttcccaggagtattgacacacctgtgagcacaggtaagaacaccacttatgctcaaattcctggcccaagagtgacctgttcatagctatcaggacacagaaaccaagggataggatccttcaaggttatatctgcaccctatagctgaacctgtaccacagctcttcaaattcaaagtcctccctgagagaactggtctcccaggagtactgacacacaggcttgcagaagagaaaagctatagttagatacagcaagaccagctaacaacaaagacaatgagatggtgagaggtaagagcaagaacataagcaacagaaaccaaggctacttggcataatcagaacatagttgtccaacacagtgagtcctgtacaccccaacacatcagaaaagcaagattctaatttaaattctcatctcatggagactttaagaaggacataaataactcccttaaagaaatacagggaaacaggtagaagcccttaaagaggaaaaacaaaaatcccttaaagaattactggaaaacacaatcaaacaggtgaagaaatggaacaaaaccatccaggatctaaaagtggaaatagaaacaataaagaaatcagaaagggagacaaccctggagatagacaacctaagaaagaaatcaggggtcataaatgcaagcatcaccaacagaataaaagag

SEQ ID NO: 2028 - DNA, 1000 bp, mus musculus
acacactctgctcatgcacatgtctatccattcttacccataatgagcatacatacaatgtgcacaacccatacccacaggcattggcatacagaagctcacacacatgcataaactcacatgggcatacacacacacacacacacacacacacgcacacacacacacacacacacacgcaagaattgcgtgtgaacatgctcatcatgggtgtgtaaacacacatgcacatgacccacggcctgactagagtcaagtgtagcacagagtatgagatgtaggctattttattatgttttattacttgttcatgtccatttgttctggcaccatttgttggaaagtctctcctatctcattggattgctgtcctacctgtgtcaaaagtcagttgtgtgcttcctgctacattgatgtatgggtctatctttccatactcattaggctaccctgtctacatctacccacttgtttggatttccccatctgaattttgttatcttgatacgctctaatttctgcaggatgcccttgctgtatacaccatttctgtatacatctttttccctctttccctggctatgcacttcatcgttctgcacgacataaacacacacacacacacacactcacacacacacattcaatcacatggagccatcccattgcttccttgcaaaatccccaatgctcctggggcttgctgccatcccataacatccccaaagcctcctgtatcctctcctgtctcctgtctagggtgatgaatctttataagtgcctccccactatcctgcttctctctaacactaaacagcatgtaaggtacctactttaattttttagactatcagcttggctactcctagaagtcagaccatgcctaatttgggagtgtatccatgtcacatggcacaaagcaaggactcagtgaaaactgactttctgaaaggcatggaagaggagcttgacagtactgttggggcttttctctgtgtca

SEQ ID NO: 2029 - DNA, 1000 bp, mus musculus
cagtttttttttttttttttttttttttttttttttttttttttttggtggttgttgttggtttttgtatttgtttgtttatgtggcagggaacacacacatgccacagagtaaaaggccagaggacagcttgtgggagttactgctctgcttcgatcataggggttctgggggttgaattcagttcatcaggtttggctgcaatgcctttactcacagagaaagctggttctgggttatacttttcgtgcttgccctgaggtttcctggagttgaactcttgagactggtccacctcagtcaattggagcaatgttaggctcctaagtggtcagtgattccccactgtccactccacccacacctacatcctctcgcagcctgatttctgtagctttatttccctaagcaccatcccttgaagctgcccagctcctggcagacagcccctgcctggtttatccttgttttaccacccacccactctgccacagtcttccaccgtggccaagccgtagtgttcttccttgatgactccagctaaggtgggctcttaccctctcatcccttgacctcaagttgttagtcttgtttgtacctcagcatggattcctgctctgtggccccctcagatgcctgcttggcttgctctatgatttattccattgtctgtttatataccagctccctgacccccccctccatatgttggctctgcttcccgattgttaatggagctagtgtctctccttagcacccaaacccattggctcactcatatatgcagcactcattgtttcttgtctgtctcttactactcaaatgtaaagaccgttcactcctgtatccctagcgtctagaactgtgcctggcacatggcagatcctcggtgctattgtgggatgaatggatgcctgaaccccaagggcgttgttatctttgcctttccctataactacggctggaaccaaatggtcttcatatttggatcctgatacct

SEQ ID NO: 2030 - DNA, 1200 bp, mus musculus
tcttatcttgcccatctactctagagactctttcctacgcaggcacaagggaccagagggcctgcggcacctctttaactctcacagtactcagctgctttcctaaccaaagtcccaacttcccaaaatgcagcaggatcaggcttgtcacagcaatacccagctcctggaactagcttctgtcttagttatttttctacttttgtgtacagagaccatgatcaaggacacttataaatgaaagtatttaattggtggcttgcttacagttctagaatgtgagtccatgactagcatggcagggagcatgcatggcagcaggcagacaggcatggtgctgaagtagttactgagagcttgcaccacgatgcacaagcagattgagagaagggggtgcaccaagtggcaaagaaagacagagactatgtctggcgtatttttttgaaacctaaaaacctgctcctggtgacaaaccttttctaacaaggcaagaccttctaatccttcttaaactgtcaaccaacttggaactaaatattcaagtatgtgagcctaagggaagccattctcattcaaaccactgaataactagataggctggttattgtatgggtgactgcatatataggcagctgagtgtatgggtgggtgaatagaagggtgagcaagtaaatgaatgaatgtatggatgaataaattggtaaatgaggagatgggtgcacaggcacatggataaatgagtgatgggtggatggataagtatgtgagtagctaaatggaagcattggtaaatagacagatgggtggatgcgtggataggcaggtgggttttgtggatagataggtagataactgaatagtgaatgagttaatgggtgatcaggtacatgggtagacaggtgaaaggaagagaaaatgaaagcagagagaagatttgctttcattttcccaattatctatcacagaggccaacagttcagactttcttgccctaaattcaatgaatattcatgtcggtccctcttgccacactgggatgaatggcttggctagcatttggatcatgtctaggcttcaggaccaggcaaagtagctaacacattcattagcagaggtggagatagggtatggagctgtattggggagagcagtgatagtaatcgaaatttctggtttctttggagattcagttgtatcatg

SEQ ID NO: 2031 - DNA, 1400 bp, mus musculus
aaatgagatgcctttttcttatacataaaaacaatttctgagtttacaacataaatcaataggaaaccagaatttgatatattatactttctctagaagcaactggtcaagaatacatttattctacaaaacaatggataatttaattttcatatcaattctatgtacagggcttgtaagatgttgagatcatttattacttcagtgataattttgtaaattttttttatcatagtcacccctcccttgactcctcccagattcaccctctccccttccggccaactttatcttttttttagacaaagtcatcctctcaacttatcaagttcccactacagaggcgtctaaataggcacagtttctgtttccctttaaacattcagtcttcaacacataggtctaaactagctatgcccaacttaaccataggtatccacgagatgagagctaggagattttatgctatttctcatcttgcatacaagccttacttaatatttatccctctgtgtgcttgtgaagtagatcctccttcctctacatgccaccatgatgtatcatcctttccaatgatgggatacttattttaacctcccctattttatcaaccatcctaatgtactacaaacctatgtaggccttatatcttttttgctaagcagtctctgtgagctgaaacgaggacttaacttcaagctggactggactggactacggtaatgacacacattaacacccaattctccagtccaccaccctgccactcactgagttgtgtctacagttctatctgcattcaggtaaacttctacactgacctatgaaagcacattttcagtactgtgaagagtctactgagcttgcagaagctgttcttaaaacctctacaaacttcccagtgataccatccttccatactgaacatgctctgaacatgaggaatgagaagctgactataatagtctctgaaattcttttttcttcttccctctaaatcaaagtcagtcaacttttcttaaaactatagacactataggtgtgtgggttcatttcagggtcttcaattctattccattgatcttcctgtctctgtaccagtaccatgcagtttttatcacaattgctctgtagtacagcttgaggtcaggcatggtgattccaccagaggttctttcattgttgagaatagattttgctatcctgggattttgttattccagaagaatgtgcagattgccctttctaactcagtgaagaattgatttggaattttgatggggattgcattgaaactgtagattgctttctgcaagatggccatttttactatattaatcctgccaatccatgagcatgggagatctttccatcttctgagatattctttgatttctttc

SEQ ID NO: 2032 - DNA, 1000 bp, mus musculus
taccttcacagtgaaaaggtggggaacaacccgcagccaatggcatacgatcaatactggcgagaggaggggtgtgtgggctggacagcagtttctcttatttctttatcccatctcatctttcctctaacaggactacttgtcagatgtcgaggccgggaaccggtttggagattcttgtgtgatcgtttgagggtgtatggacatccacagagtgtcactgcttagccagtgtggtccatcttgttagaccatgactgtgcatgcatggccagtcagaagcctctcaggaggtgacatacatgctggcaacactggggaatgggccacacatgtcctgggtcactcattctcttgacttcctttactatgttttatctttcatcgttctaacaaaatatatgaatctgggtgctgtaccttcagtgtatccagtaggctttgtcagtaaggttttggtctccaacagggcatccctaggaggtggaggaaatcttaggggtggagcctagtgggagccaagtgggacctatctattaggtcattttggatgttgtcaaggggattgaggaacaccagtctcttctcttcttttgtcccctgtcatattgtgagcttggttgtcctaaataggggtcccatgatcatgtgtcatcacaggccgaaagcaatgggtccaattggtcacggaccaagacctccaaaactgtgggccaaaataaggctttcttctctataaattgattatctcaggtctttttgtgtcgtgtgaaagtctgagtaacaaacttggtaacttaaaaaagaatagcttatgtgcctcatggatctggaggaggctacatgctaagagcagggtgccagtatcttgttggtacctggtcaggcatgtgatgtagtgatgcagaacaagctcttaggaaggggaactgagcatggcatctgagcctgccacatagaatagggctcacccacatcatgcacaccagccagtgtggtc

SEQ ID NO: 2033 - DNA, 1000 bp, mus musculus
aagagtacagtacacaggataaagtggtgttgatctcgggagctcttgggtttctttacataagcaacaacaacaaaagaatcttacctcagtaaatacatgtaagaacatgtttgaagaaaatccagctctatttttgatcgtaagagaaaaagacaaaaagctccttaatttgtcaaaggcttcttatgaaaacttccaatgaacataatattaaaggtgaaaggctaagtgcccccacactaaggtgaaagcaggatggaaatattgctgtcaagaaattttcattccttattgcatcggaagctcttgtctaaccgtcaggcaaaagcttacattagatcctcctattccagtccacttacccccatccatctgtaaatatctatttttatttcccttctgagggagacccaaaacccccatgccccctccccagtctcttactctatacccaacctctgtggttatatggatcgtatcctgattattgaagactcaacagctaaatattttctttattacttgtccattggtggatatgtaggttgtttctaatttccagctattataaacaaagcagcaatgaacatgtttgagccaatgtctttgcagtaggatgtagagtcctttgggtacaagatcaagagtggtacagctacatcttgaggtagatctattcccagattcctgaggaaccaccgcactgatttcaatagtggcagtacacctttgagactcctccagcgacaaaggcgcattctccttgtcccacatctttctcaccatgtgctgtctgccacttgcattgttgatcttgccatcctggctggtttaaagagaaacctcaaagtagttttgatttgcatttccctgatggctaagaatgttgaacatttcattaagcatttctcagccatttgattttcctctgttgagacttcttggtgcctagtgacctacttccttcaattaggccctgccttctaaagcttcaaga

SEQ ID NO: 2034 - DNA, 1000 bp, mus musculus
ttactctgctaataacaaattggtgccgagcacaactgccatcagaagtattatcccacaactaatgggcacagatgcagggacccacagccaaacattaggcagatacaggggaaccctacagaagatggagaggaaagctcataggagccagagggtagagaacaccaggaaaacagggtctacagaatcagctaatcagttcttataggggatcacagagcctgaagcaacattcacaggctcgccatgggcctgagctaagaactctgcacataccttatggttgtgtagcttggtgttcttgtgggactcccaaaagtgggagtgggggtgtttctgactcttttgtctgactttcagaccctttccctgctacttggttgcttcatccaaccttgatatgagggtttgtgcctagacatacggaaacgtgttatgcctcaggcagttggtatgactgggaggcctgctcttttgcagcagggaaaaggaggaggaatgagtggacctgggggcggggacggagggaaagctgcagttgagatataatgcatgagagaagaattaagaagcaaagactgcacagaacacattatgactttggtgcccttttaggatatcattaaccctgacgtagaacactaacataaagaaataaaaattcatgtttgggcataataactgagaggccaataacactcgagttggaaaattgggaggcaatgtagatggatgtgctttatgttggtattgtctaaactctaaccccacagctcctgacaggagccaggtatgctcctccccacagttacctgcaacagtcaggtaggcctcgcccactataaaagggctgcttggcccttcctctttctcttactctcttgtctcccttactcttgcttcctgcttgccccttctctccccattcccttcctcccctctcttcatggcagcttccacttctcttcactctcctttctctgactttctttgccta

SEQ ID NO: 2035 - DNA, 1000 bp, mus musculus
aacagaggtcatcggagagggacagggccttgaggcctaagggaagcttggtcaatgtgtcctaagttgtgagagaggaacaaggaatgtggtgtttagttgtcaccacagggtgaccacatggagcactactgtactgtatggtttaagattctacattttcataagacctgattttttaactcaataaatgtatgctaagacaaacatatttaacatgatttaagtgtgctttatcagcatgtattgaaatttcacataataccctgaaagtattcaaatcttcatatttttatgtatccattaaaattttaaaaattcaaacaatactcaaactaaatctaatataattggagggaaaatggaaaaaatgcagaaaccagtgaaacaatttgtaaaacacaagaaaatcaagaagaaggaaggccaacatgtggatacttcattcctccttagaatagggaacacaatacccatggaaggcattacagagacaaagtttggagctaagaagaaaggatggaccatccagagactacccaacctggggatctatcccataatcagccaccaaatgcagacactattgcacatgccagcgagattttgctgaaaggaccctgatatagctttctcatgtgaggctatgccagtgcctggcaaatacagaagtggatgctcacagtcatcgattgtttggaacacagggcccccagtggaggagctagagaaagtacccaaggagctgaaggggtctgcaaccctataggaactaacaatatgaactaaccagtacccccagaactcatgtctctagctgcatatgtagcagaagatggtctagtcggtcatcattggggaagagaggccccttggtcttgcaaactttatatgccccagtataggggaacgccaaggccaagaaatgggagtgggtgggtaggggtgcagggcagagagagggtataggggacttttgggatagcatttgaaatgtaaa

SEQ ID NO: 2036 - DNA, 1000 bp, mus musculus
agatccagtcaaaacaaaccctttcttcatgaggtactcagtttgtgggattatatgacgagcagcagaaaattgaataacagtagaggtaacaacttcatccaatttagttaatccacatcaaccaattttcttctatgtaaagtgaaaattatagcagcagctacctcacaaatttggggatatgtatctggggtcagggagacagagcatgtaaaataccttactgagcagctcaaggagacgatgtaacaaatgagaactcttaacgccacagtgagttgggagtttgttgcaagtttgccttagatatttcttgttttcctcatcactgcaaccaaatacaggacaaggtacactttaaggaaaggggaccaaggggtttatttcagcacacagtttcgtggaagaggtgccatcgtggttcttgttgtgtcttggtgtggaagcttgtggctggccacacatctattactaaagcaaaataggtccaggctatatgcgtacactggtctccactgaccaatttctatgagctagccaggcctcacctcccaatggttcagtcactcccaaagagcaccaccaactgggcaatgcttgttcaaatgcttgaacctctgggggagaacatttccatcaaaccatcacaccttagaaaggagttggaagtctaagaaaggcaaggggaccattaggaaattgcatctgcgtgaaaacacacatcagcctaatgtctctctcaagtcacttgtcacagtaatgatagcaaaggcaaagaaaatttattattccctagcctcattctggtaccaggcactattctggacttcttacatgaactgatccatttcactatcacaagaacctcatggagtagatacaaagtctccattaccattggcttgcaggtgtacataaggaggttctgttagagtgctggtcaccacgtgtttttccttagacatgtaaatttaatccaatatcatgaatgtagggg

SEQ ID NO: 2037 - DNA, 1000 bp, mus musculus
aagttatacatggagggcaaattgtcctagcccctcaatttttgtctaacaggatcctcatctttgatatgaatttcagttgaataaaacgagatcaaataccactgggtaaaggccagacaatggctctgacagagcaggaaaggtgaattctaaaacctatttatcaggtagatgttcttggaacattgagaagtatgccctttctcaggaacaaagccgtatttagacatatcccaacatacagttgatggcttatccttagtcagctttgcagtaccacaaaacaattgctaaagctaactcacagagaagccaagtttctctcactgtttggcaggctgaaaatcccaaataatgcaggcttatcagtttggcttctgatgagggtaaagacggtaacacatagcaggagtgtgtgtaagaggccgtggccatagcttaagcccaagtacttctttgttgccgtggtagaattacatggccaaatgtagcttagatgggaaagaagttcttttggcttttggtcccagcatgcagcaggaagcttaccaagcacatttcatcttatagacaggaagcagaaagaacaggaagtagagtgaagcctatatgctctcaaacctatgcctggtgacatacttctgccagcaagacccctcttcctaaggcttttataactgcccccaaacagtgccaccaacaggaagccaagtctccgtgtgcgtgaacacatggaaaatgtgtcccattcaaaccgccataccaaggaaagagtgaaaggcaatgtgtacacagtcatctttttagataccgccgcttctccccatgaagtgggaccatgtcactaaggcctgtctcttaaactttcaacaacttcaagataacattaccctggggaccgaactttcactgtgtgaaccactgcacgacccagtattgcacctgtggtaggaggatggagccgttgtcattctcagacttacaaatcctgtccttt

(The sequence listing continues in the following parts.)

What is claimed is:

1. A method of treating a subject who has Rett Syndrome, the method comprising administering to the subject a therapeutically effective amount of a nucleic acid oligonucleotide that targets a sequence within SEQ ID NOs. 7957, 7959, 7961, or 7962.

2. The method of claim 1, wherein the nucleic acid oligonucleotide comprises one or more of DNA, RNA, PNA, HNA, MNA, ANA, LNA, CAN, INA, CeNA, TNA, (2'-NH)-TNA, (3'-NH)-TNA, alpha-L-Ribo-LNA, alpha-L-Xylo-LNA, beta-D-Ribo-LNA, beta-D-Xylo-LNA, [3.2.1]-LNA, Bicyclo-DNA, 6-Amino-Bicyclo-DNA, 5-epi-Bicyclo-DNA, alpha-Bicyclo-DNA, Tricyclo-DNA, Bicyclo[4.3.0]-DNA, Bicyclo[3.2.1]-DNA, Bicyclo[4.3.0]amide-DNA, beta-D-Ribopyranosyl-NA, alpha-L-Lyxopyranosyl-NA, 2'-R-RNA, 2'-OR-RNA, 2'-AE-RNA, alpha-L-RNA, and beta-D-RNA.

* * * * *